United States Patent 12,577,609 (METHODS FOR CELL-TYPE SPECIFIC PROFILING TO IDENTIFY DRUG TARGETS) - sequence listing, part 12

SEQ ID NO: 15496 - DNA, 4285 bp, Homo sapiens
  ENST00000480008
cggcggcagcggcggcggcggccgggacaaggcggaggcgacggcggcggcggcggcgcggggcgctcgggctgatggcggcggcggccgggcccggggctgcgctgtccccgcggccgtgcgacagcgacccagccacccccggagcgcagtccccgaaggatgataatgaagataattcaaatgatgggacccagccatccaaaaggaggcgaatgggctcaggagatagttctaggagttgtgaaacttcaagtcaagatcttggttttagttactatccagcagaaaacttgatagagtacaaatggccacctgatgaaacaggagaatactatatgcttcaagaacaagtcagtgaatatttgggtgtgacctcctttaaaaggaaatatccagatttagagcgacgagatttgtctcacaaggagaaactctacctgagagagctaaatgtcattactgaaactcagtgcactctaggcttaacagcattgcgcagtgatgaagtgattgatttaatgataaaagaatatccagccaaacatgctgagtattctgttattctacaagaaaaagaacgtcaacgaattacagaccattataaagagtattcccaaatgcaacaacagaatactcagaaagttgaagccagtaaagtgcctgagtatattaagaaagctgccaaaaaagcagcagaatttaatagcaacttaaaccgggaacgcatggaagaaagaagagcttattttgacttgcagacacatgtactcaccagatgagctgcggtatctgccattaaacacagccctgtatgagccccctctggatcctgagctccctgctctagacagtgatggtgattcagatgatggcgaagatggtcgaggtgatgagaaacggaaaaataaaggcacttcggacagctcctctggcaatgtatctgaaggggaaagccctcctgacagccaggaggactctttccagggaagacagaaatcaaaagacaaagctgccactccaagaaaagatggtcccaaacgttctgtactgtccaagtcagttcctgggtacaaggtagaagaaaaaagcccctgactcagcttctttactgaccagcctctccctgaaatattttaacttgactttcacgattgtggagcttctgcctgctgtacctcactagctgttcttctatggtgtgccctttgtccgctgctttcttttttgctttatttccttggtggcttttctgtcacttttggctatggtttaccttctgttttctgtatatgtacaatttataagtctttttttttctttgaaagaataaccaggcaagtatgggtttttaaaacattatttcataggcagaagtttatattttctttccttggagtaaagatcataattatttggcattttaaatgccccagcatttagtgtagctaaagctgctgagctataaagtatgagtggatatactgttagactaagttgcattttttttagtgcctttcattaagaaagatctgggtttaatctaaggattatttgatccatatgctaaatttagctaactctgggatagaaaataataaaacctgttacttacattgtagtgatttttagcataaccttggtaaagagcctatatgattctatggcaagaattaaaacatacttgttaacttgttgatctgattatcctcagagtaaaggagtaggttgtcagcaactattattatattttgaacttttcctccctctgtctgcccctcccttttcttctgaagaaaaggtgaggtgagagatgagtagccttatttgcatatagggatttaagaatatcataaaaggaagaattagctgtacagtttcatatttgggatggtggtagtaaaatagactaccttttgattcttttggtctgaaatgtattagaacatgcttttattgcacttatgaaggtgtattgaaggaaaattttagagtaagctgatgagaaagttttgccaagtgaaattgttaaacaccttgtatgtcagaactgtgattgtggtaaataattcacaagaacaggctgaagtaagtcacctttccctcaaactaactagaacacgttctaacatgttcatttacctttcttcaagtaaaaaaagcgacattaagttagtgtatttcatattttattaggaaatgcttttatgtaattaacttaaaaattcttttttttttttgtagcctatagcaagcaaattttaagcttaattcagcaagggttggcttccaagggtggctgcaataggctgcagctatgtgatttttgtacttgtttttacatatatagcttatgtaatttctttatataaattaatgcttaataactgaaagcaagtgagctccaaagatgaaatttcagaagcagtatacatgaatgagtgtgttctactggtctgctaagagctttaaatggaagtggccgctcaaagcacagtgtcctgttaactcttgagtgctaagtagatctttgcaacagtaagcttgattgatcatgggttaaaaagagagaatattgaaatagatgttttaatacaggctggaaatcagctattcaacactatcattgatttagtatacaagaaatcatatggattaactgaacttaatagtactcaagtaggatatgcaaaatttatattttacataatctgtgaacatttttagtacctaaaaatgtttcaggtatttcaaagatgggaacaaccagtatctagtcatcatacattaatgtgaacatgcttattaaaagttaacctctttataaaaagtattaataaaccaagatgtgcctaaatattagggtacttcaagctaaaggtcatagtttatatataaaaagtacgagattcaaggaagtaatgtatctgatgctttgcttaataagattcactagtgcttgcccttaattcatagaacagtattgtttaggttacattaacctgaaatttaaagcataattattaggattccggcctataaatacaataattaaaatctatactatattattgctaccatgaaagtcttatctttggctgtttttcaagtagaaaagtaagtgtactgtgagccttttatttgagatgctgagagctattaggatgagtatttcagttttcttgtcaatagtgatactctgatgatgttgcagttatttgaagtagaactgattgtctaaaccagacacacataggagtgtgctccattggtcttgtggagagtgctgcacattaacccctccctcaactgtgcaatccacttgagactggcttctctaagccacagttgttatctgctgtgtaaagtcctggatgccagcactgtggcttcttagagagggcagatgctttgtatatcgagctgcagcattcatcgtagaaaatgctacaaagctgtctctcttccccttctctcatgtttccctcttttcatcaagatgaaggctgttgggtaagaaaaactaagtgatttaacaaatcattatgatttaaacttagaaataaacctagaattttttggtgtcccttttatcataggtgtttaatgtatattttaatgattgtagaacttgaattgctctagaatgtgaatgactacccttgtgttttactccttttggcttttgttttgtaaagaatctcctgtgaggagttctgtttttagaatttaatattgtttggttacttccctgactttagtgaaagatattagagtatttactatgccagtatctaacttaaactattagtattaaataagtatatcttttacatttagtacaggtaccataaccaagagatttcttagttttgatggattaagagagagcattctgctgtatattatggcaggtacagatatgatcataactgaaccagaatttggattatagaagtgcacttcctagctgttttttatttaggtataggaacacacaatgagaaccttatgtttagaatgtagcagtaacaacagagggtaactacactgcaagacttaaatggtttgagcatgtgacactatccttttgttggggggagcagggtataaaaatatacatacaggagattagtttaatagtaaagttttatatgtatgtttaacttccatgatatttattattttgtagagacatttgtgattgtttagagttcttgtttttattctatttatgtataaggttgactttttttaaataaataagccaaaaattctttttgaa

SEQ ID NO: 15497 - DNA, 676 bp, Homo sapiens
  ENST00000464779
tgattattctttgggtggatgaaatactggctatgcattttaagcccaagagaaagaagtcagagctgataccatcatcaccttgctttgccctcataggtcctttaaactaaaaatgccttcgttcttagcaattgtgattctacgttcttcccagtgtataaaagatgttattttcacatacctttttgacttggtagaccagataattatttctattccttgtacctgttttgtaattttctttgatacacaggaagtcaagtcataggaggcaaataatttaaatacttaaaatagttttcaaaatatcctcaataaaagtgattaaaaattaatgaaagctacatttaatgcataatatgtatttctgtacttagttttagttactatccagcagaaaacttgatagagtacaaatggccacctgatgaaacaggagaatactatatgcttcaagaacaagtcagtgaatatttgggtgtgacctcctttaaaaggaaatatccagatttagagcgacgagatttgtctcacaaggagaaactctacctgagagagctaaatgtcattactgaaactcagtgcactctaggtaagaatagctttttaatgtgaatttttcaagctgaacatttatgagataatactagataagtatcttatttcctaaaat

SEQ ID NO: 15498 - DNA, 4395 bp, Homo sapiens
  ENST00000612128
cggcggcagcggcggcggcggccgggacaaggcggaggcgacggcggcggcggcggcgcggggcgctcgggctgatggcggcggcggccgggcccggggctgcgctgtccccgcggccgtgcgacagcgacccagccacccccggagcgcagtccccgaaggatgataatgaagataattcaaatgatgggacccagccatccaaaaggaggcgaatgggctcaggagatagttctaggagttgtgaaacttcaagtcaagatcttggttttagttactatccagcagaaaacttgatagagtacaaatggccacctgatgaaacaggagaatactatatgcttcaagaacaagtcagtgaatatttgggtgtgacctcctttaaaaggaaatatccagatttagagcgacgagatttgtctcacaaggagaaactctacctgagagagctaaatgtcattactgaaactcagtgcactctaggcttaacagcattgcgcagtgatgaagtgattgatttaatgataaaagaatatccagccaaacatgctgagtattctgttattctacaagaaaaagaacgtcaacgaattacagaccattataaagagtattcccaaatgcaacaacagaatactcagaaagttgaagccagtaaagtgcctgagtatattaagaaagctgccaaaaaagcagcagaatttaatagcaacttaaaccgggaacgcatggaagaaagaagagcttattttgacttgcagacacatgttatccaggtacctcaagggaagtacaaagttttgccaacagagcgaacaaaggtcagttcttacccagtggctctcatccccggacagttccaggaatattataagaggtactcaccagatgagctgcggtatctgccattaaacacagccctgtatgagccccctctggatcctgagctccctgctctagacagtgatggtgattcagatgatggcgaagatggtcgaggtgatgagaaacggaaaaataaaggcacttcggacagctcctctggcaatgtatctgaaggggaaagccctcctgacagccaggaggactctttccagggaagacagaaatcaaaagacaaagctgccactccaagaaaagatggtcccaaacgttctgtactgtccaagtcagttcctgggtacaaggtagaagaaaaaagcccctgactcagcttctttactgaccagcctctccctgaaatattttaacttgactttcacgattgtggagcttctgcctgctgtacctcactagctgttcttctatggtgtgccctttgtccgctgctttcttttttgctttatttccttggtggcttttctgtcacttttggctatggtttaccttctgttttctgtatatgtacaatttataagtctttttttttctttgaaagaataaccaggcaagtatgggtttttaaaacattatttcataggcagaagtttatattttctttccttggagtaaagatcataattatttggcattttaaatgccccagcatttagtgtagctaaagctgctgagctataaagtatgagtggatatactgttagactaagttgcattttttttagtgcctttcattaagaaagatctgggtttaatctaaggattatttgatccatatgctaaatttagctaactctgggatagaaaataataaaacctgttacttacattgtagtgatttttagcataaccttggtaaagagcctatatgattctatggcaagaattaaaacatacttgttaacttgttgatctgattatcctcagagtaaaggagtaggttgtcagcaactattattatattttgaacttttcctccctctgtctgcccctcccttttcttctgaagaaaaggtgaggtgagagatgagtagccttatttgcatatagggatttaagaatatcataaaaggaagaattagctgtacagtttcatatttgggatggtggtagtaaaatagactaccttttgattcttttggtctgaaatgtattagaacatgcttttattgcacttatgaaggtgtattgaaggaaaattttagagtaagctgatgagaaagttttgccaagtgaaattgttaaacaccttgtatgtcagaactgtgattgtggtaaataattcacaagaacaggctgaagtaagtcacctttccctcaaactaactagaacacgttctaacatgttcatttacctttcttcaagtaaaaaaagcgacattaagttagtgtatttcatattttattaggaaatgcttttatgtaattaacttaaaaattcttttttttttttgtagcctatagcaagcaaattttaagcttaattcagcaagggttggcttccaagggtggctgcaataggctgcagctatgtgatttttgtacttgtttttacatatatagcttatgtaatttctttatataaattaatgcttaataactgaaagcaagtgagctccaaagatgaaatttcagaagcagtatacatgaatgagtgtgttctactggtctgctaagagctttaaatggaagtggccgctcaaagcacagtgtcctgttaactcttgagtgctaagtagatctttgcaacagtaagcttgattgatcatgggttaaaaagagagaatattgaaatagatgttttaatacaggctggaaatcagctattcaacactatcattgatttagtatacaagaaatcatatggattaactgaacttaatagtactcaagtaggatatgcaaaatttatattttacataatctgtgaacatttttagtacctaaaaatgtttcaggtatttcaaagatgggaacaaccagtatctagtcatcatacattaatgtgaacatgcttattaaaagttaacctctttataaaaagtattaataaaccaagatgtgcctaaatattagggtacttcaagctaaaggtcatagtttatatataaaaagtacgagattcaaggaagtaatgtatctgatgctttgcttaataagattcactagtgcttgcccttaattcatagaacagtattgtttaggttacattaacctgaaatttaaagcataattattaggattccggcctataaatacaataattaaaatctatactatattattgctaccatgaaagtcttatctttggctgtttttcaagtagaaaagtaagtgtactgtgagccttttatttgagatgctgagagctattaggatgagtatttcagttttcttgtcaatagtgatactctgatgatgttgcagttatttgaagtagaactgattgtctaaaccagacacacataggagtgtgctccattggtcttgtggagagtgctgcacattaacccctccctcaactgtgcaatccacttgagactggcttctctaagccacagttgttatctgctgtgtaaagtcctggatgccagcactgtggcttcttagagagggcagatgctttgtatatcgagctgcagcattcatcgtagaaaatgctacaaagctgtctctcttccccttctctcatgtttccctcttttcatcaagatgaaggctgttgggtaagaaaaactaagtgatttaacaaatcattatgatttaaacttagaaataaacctagaattttttggtgtcccttttatcataggtgtttaatgtatattttaatgattgtagaacttgaattgctctagaatgtgaatgactacccttgtgttttactccttttggcttttgttttgtaaagaatctcctgtgaggagttctgtttttagaatttaatattgtttggttacttccctgactttagtgaaagatattagagtatttactatgccagtatctaacttaaactattagtattaaataagtatatcttttacatttagtacaggtaccataaccaagagatttcttagttttgatggattaagagagagcattctgctgtatattatggcaggtacagatatgatcataactgaaccagaatttggattatagaagtgcacttcctagctgttttttatttaggtataggaacacacaatgagaaccttatgtttagaatgtagcagtaacaacagagggtaactacactgcaagacttaaatggtttgagcatgtgacactatccttttgttggggggagcagggtataaaaatatacatacaggagattagtttaatagtaaagttttatatgtatgtttaacttccatgatatttattattttgtagagacatttgtgattgtttagagttcttgtttttattctatttatgtataaggttgactttttttaaataaataagccaaaaattctttttgaa

SEQ ID NO: 15499 - DNA, 1651 bp, Homo sapiens
  ENST00000621772
cagacaagaagtgcggcggaagcttacacctgcacgtggtgggacagaggcaagaacggatggtctggctgaggctgagagaaccaagctggattaggatcggcttgagggcccggcgtcgtcagtggtgacctctctgacctgaggatgataatgaagataattcaaatgatgggacccagccatccaaaaggaggcgaatgggctcaggagatagttctaggagttgtgaaacttcaagtcaagatcttggttttagttactatccagcagaaaacttgatagagtacaaatggccacctgatgaaacaggagaatactatatgcttcaagaacaagtcagtgaatatttgggtgtgacctcctttaaaaggaaatatccagatttagagcgacgagatttgtctcacaaggagaaactctacctgagagagctaaatgtcattactgaaactcagtgcactctaggcttaacagcattgcgcagtgatgaagtgattgatttaatgataaaagaatatccagccaaacatgctgagtattctgttattctacaagaaaaagaacgtcaacgaattacagaccattataaagagtattcccaaatgcaacaacagaatactcagaaagttgaagccagtaaagtgcctgagtatattaagaaagctgccaaaaaagcagcagaatttaatagcaacttaaaccgggaacgcatggaagaaagaagagcttattttgacttgcagacacatgttatccaggtacctcaagggaagtacaaagttttgccaacagagcgaacaaaggtcagttcttacccagtggctctcatccccggacagttccaggaatattataagaggtactcaccagatgagctgcggtatctgccattaaacacagccctgtatgagccccctctggatcctgagctccctgctctagacagtgatggtgattcagatgatggcgaagatggtcgaggtgatgagaaacggaaaaataaaggcacttcggacagctcctctggcaatgtatctgaaggggaaagccctcctgacagccaggaggactctttccagggaagacagaaatcaaaagacaaagctgccactccaagaaaagatggtcccaaacgttctgtactgtccaagtcagttcctgggtacaagccaaaggtcattccaaatgctatatgtggaatttgtctgaagggtaaggagtccaacaagaaaggaaaggctgaatcacttatacactgctcccaatgtgagaatagtggccatccttcttgcctggatatgacaatggagcttgtttctatgattaagacctacccatggcagtgtatggaatgtaaaacatgcattatatgtggacaaccccaccatgaagaagaaatgatgttctgtgatatgtgtgacagaggttatcatactttttgtgtgggccttggtgctattccatcaggtcgctggatttgtgactgttgtcagcgggcccccccaacacccaggaaagtgggcagaagggggaaaaacagcaaagagggataaaatagtttttgactctaatactgtatatgcatttaagtggaatatttggtgccatttacaacattattttcatgccaataaaagattttttttgc

SEQ ID NO: 15500 - DNA, 3586 bp, Homo sapiens
  ENST00000403565
atttatgagctttgctcgacacggactcgccgtgtttacttggctctttgttcctcccccctcccccggcacacactcacactcacactcactcgcacacgcaccccggcctgcaaacttgcacggctcggggcgcgccgccgggtggcctcggcccccgccccgccccgcgagctgccccgatgaggcggcagccacagaacggcgacctcaagaagcagctccacgaaaggcagccgcggatcgccgcgctcagcgacaaacaaatcgcgggcagaacctctcatctgtgcacaagggacccagcacggggctttgggaacgatcactgcagtgcctgtcacgggtcctcaggtcagctccttgcagaggttggccgggcaaggagcggcagtgctacctcaggttaggccaaagactctgattccagacagcctccccgttgccccgggccgggaccggccacccaagcagcccccaacattccagaaggccaccgtggtcagcgtcaagaaccccagcccagccctccccaccgccaacaacactgtcagccatgtgccagcgcccggcagccagccccaggccctcgccgagcccgccgccctcgcctctccgctgagcagtgcgggggtggcctacgccatcatctccacctcccccagcaatgccgccgccatggcccccagcaccgccgtgtctgtggtcagtgacagcatcaaagtccagcccctcctcatcagtgctgacaacaaggtcatcatcattcagcctcaagtgcagacgcagcccgagagcacggcagagtcgcggccgcccacagaggagccatctcagggagctcaggccaccaaaaagaagaaggaagaccggcccccgacccaggagaaccccgagaaaatcgccttcatggtagcgctaggcctggttaccacggaacatttggaagaaatccagagcaagcgacaggagcggaagagaagaagcacagccaaccctgcctacagcggcctcctggagaccgagaggaaacggctggcctccaactatctcaacaaccccctgttcctcacagcgagagccaatgaggacccctgctggaagaacgagatcacccacgatgagcactgtgccgcctgcaagcgaggggccaacctgcagccctgcggcacctgcccgggggcctaccacctcagctgcctggagccgcccctcaagacggcgcccaagggcgtgtgggtgtgccccaggtgccagcagaaggccttaaagaaagacgagggtgtgccctggactgggatgctggccatcgtgcactcttatgtcacccacaagacagtcaaagaagaggagaagcagaagctgctgcaacgaggcagtgagctgcagaacgagcaccagcagctggaggagcgggaccggcggctggcgtcagcagtgcagaaatgcctggagttgaagacaagcctgctggcccgccagaggggcacccagtcatccctggaccgcctgcgggccctcctgagactgatacagggcgagcagctgctccaggtcaccatgacgaccactagccctgccccactgctggccgggccctggaccaagccctcagtggcagccacacaccccaccgtccagcacccccagggccacaactgaccccgagggaccagtcttcatacccacggaaagttattgggaccctgcttacacagcctgggggttctgtcggccttaattcataaacactatgaatttcagacaaaaattaaccagacagaggagaggagggaggaagagctgggcgagaggcctagagccaggaccaggtgggggtgcggccctgtgccctccaaattcacagggggtacctaggagccaggtggggtacgacaggctggggcacacagtctccccccggccacctcggggctgcctgggcctctggcttccaggccctgctctccacggcctccctctggcccgttggaggggcaggctgaggctgtggaggggacaagcacgccccccagaacgcagtctccactgagggcaccgcctattggtgtcctgtgggagggcgagctgagaacacatggactagctgagtggtagcggtagttgggacgagaagcggggtagtggatctaggtagttcctcaatgccccacgctcctaggaggtccccctggggtgggcgggcgggcctggggcactccgtcgcctttgcagaaccacctgggcccctttctgtcagtattattagggttacgaattgcagctgtttaacttgaaagacactgtcggaggtgagcatctgggcgccgggacgctgcagtgatccccgccagagcctgtgcccttcctgctccgtctttggggtcctcaaggctgcctccttccttttgccaatctcttggactcagtttgccgttgatgcgtttttctcatggagtttctgggcagagtggagctgcaaccctgttgtggggggcagcatttggcaggttttctccttggggttgaatcattcaacttaacgactgaagccctttcttgtctcctttggaagagccgataagtattccactcctcccttcttgccagtgcagacactatgccaaaaaataacttcacacttttgtatggcgtttttattgtgagatatttaatgtgaatggttggggggactctggctgacttcctttctgcttctagtagtctctgcttcaaggtacaaatgggaacacctcccctcgggaagcctggccaagctggaagatccggcaggttttttacgagccgggtggagggttggggaggaaagaaagggcggtggctcgggaggttccggccttcggggaccagacttgctgccaagggcttctgcatccagggtgggcagtggcagcttgtcacccttgcccgattcccacatcccagtcctgagggactcagcacaacaggataagcgtccaggagccacgggctcccaccccgagcatatcacatggtgccgaattgcactgaacacgcgtgtgtgcatcgcacgcggccacgaccacagacacgcatgcacacacgcagaggtgcagagcgaggaggccggcaaatcccgcagctgccacggtccctcctgtcattctcacgactccgggagaaactgtgctgtatgatacagatctattttaatacacttaccactgggtgaacaagatttttatattcttttattgatgaacaaagtgaaccgtgtgaggcacacgtcttctatattggctactctgtgccaagtatgcattaccgcgtggcttgcgatgtccatgtcttcagcttccttttctgttggtttggttttcttcgcggatggattgagttacatgttttaacagtgtaatgggaggatctgaaaggttggacccgggaggggtagctgccgatgtgtcttgagattgttaggttttttttggaccaaggaggaccgtccagtgggtagtgaggatagagaaaaagtgtttgtcttaaatacgccaatgtagttttccttctttacaatgtattaaactcgatcgatgatttcaaa

SEQ ID NO: 15501 - DNA, 3671 bp, Homo sapiens
  ENST00000313237
tccctttcggccgtgggggagggggctcgtgtcccccccaacccagcccggaggccgcgtccgcccgcgcccgctctggcccccgcggagccgcgcaacttcccgggagcccgggccaaagtgagcgcaaagtgctgcccaagttgccgggatggagctgcagagccggcccgaggcgctcgccgtggaactcgcgcgccaccagaacggcgacctcaagaagcagctccacgaaaggcagccgcggatcgccgcgctcagcgacaaacaagctttgggaacgatcactgcagtgcctgtcacgggtcctcaggtcagctccttgcagaggttggccgggcaaggagcggcagtgctacctcaggttaggccaaagactctgattccagacagcctccccgttgccccgggccgggaccggccacccaagcagcccccaacattccagaaggccaccgtggtcagcgtcaagaaccccagcccagccctccccaccgccaacaacactgtcagccatgtgccagcgcccggcagccagccccaggccctcgccgagcccgccgccctcgcctctccgctgagcagtgcgggggtggcctacgccatcatctccacctcccccagcaatgccgccgccatggcccccagcaccgccgtgtctgtggtcagtgacagcatcaaagtccagcccctcctcatcagtgctgacaacaagcctcctccacgcctcctctcttcccctcaccccgcaacccatcactgtcccctccacccctcctctcttcccctcacccctccctccccatcactgtccccttcacccctccatggcatcttccaggtcatcatcattcagcctcaagtgcagacgcagcccgagagcacggcagagtcgcggccgcccacagaggagccatctcagggagctcaggccaccaaaaagaagaaggaagaccggcccccgacccaggagaaccccgagaaaatcgccttcatggtagcgctaggcctggttaccacggaacatttggaagaaatccagagcaagcgacaggagcggaagagaagaagcacagccaaccctgcctacagcggcctcctggagaccgagaggaaacggctggcctccaactatctcaacaaccccctgttcctcacagcgagagccaatgaggacccctgctggaagaacgagatcacccacgatgagcactgtgccgcctgcaagcgaggggccaacctgcagccctgcggcacctgcccgggggcctaccacctcagctgcctggagccgcccctcaagacggcgcccaagggcgtgtgggtgtgccccaggtgccagcagaaggccttaaagaaagacgagggtgtgccctggactgggatgctggccatcgtgcactcttatgtcacccacaagacagtcaaagaagaggagaagcagaagctgctgcaacgaggcagtgagctgcagaacgagcaccagcagctggaggagcgggaccggcggctggcgtcagcagtgcagaaatgcctggagttgaagacaagcctgctggcccgccagaggggcacccagtcatccctggaccgcctgcgggccctcctgagactgatacagggcgagcagctgctccaggtcaccatgacgaccactagccctgccccactgctggccgggccctggaccaagccctcagtggcagccacacaccccaccgtccagcacccccagggccacaactgaccccgagggaccagtcttcatacccacggaaagttattgggaccctgcttacacagcctgggggttctgtcggccttaattcataaacactatgaatttcagacaaaaattaaccagacagaggagaggagggaggaagagctgggcgagaggcctagagccaggaccaggtgggggtgcggccctgtgccctccaaattcacagggggtacctaggagccaggtggggtacgacaggctggggcacacagtctccccccggccacctcggggctgcctgggcctctggcttccaggccctgctctccacggcctccctctggcccgttggaggggcaggctgaggctgtggaggggacaagcacgccccccagaacgcagtctccactgagggcaccgcctattggtgtcctgtgggagggcgagctgagaacacatggactagctgagtggtagcggtagttgggacgagaagcggggtagtggatctaggtagttcctcaatgccccacgctcctaggaggtccccctggggtgggcgggcgggcctggggcactccgtcgcctttgcagaaccacctgggcccctttctgtcagtattattagggttacgaattgcagctgtttaacttgaaagacactgtcggaggtgagcatctgggcgccgggacgctgcagtgatccccgccagagcctgtgcccttcctgctccgtctttggggtcctcaaggctgcctccttccttttgccaatctcttggactcagtttgccgttgatgcgtttttctcatggagtttctgggcagagtggagctgcaaccctgttgtggggggcagcatttggcaggttttctccttggggttgaatcattcaacttaacgactgaagccctttcttgtctcctttggaagagccgataagtattccactcctcccttcttgccagtgcagacactatgccaaaaaataacttcacacttttgtatggcgtttttattgtgagatatttaatgtgaatggttggggggactctggctgacttcctttctgcttctagtagtctctgcttcaaggtacaaatgggaacacctcccctcgggaagcctggccaagctggaagatccggcaggttttttacgagccgggtggagggttggggaggaaagaaagggcggtggctcgggaggttccggccttcggggaccagacttgctgccaagggcttctgcatccagggtgggcagtggcagcttgtcacccttgcccgattcccacatcccagtcctgagggactcagcacaacaggataagcgtccaggagccacgggctcccaccccgagcatatcacatggtgccgaattgcactgaacacgcgtgtgtgcatcgcacgcggccacgaccacagacacgcatgcacacacgcagaggtgcagagcgaggaggccggcaaatcccgcagctgccacggtccctcctgtcattctcacgactccgggagaaactgtgctgtatgatacagatctattttaatacacttaccactgggtgaacaagatttttatattcttttattgatgaacaaagtgaaccgtgtgaggcacacgtcttctatattggctactctgtgccaagtatgcattaccgcgtggcttgcgatgtccatgtcttcagcttccttttctgttggtttggttttcttcgcggatggattgagttacatgttttaacagtgtaatgggaggatctgaaaggttggacccgggaggggtagctgccgatgtgtcttgagattgttaggttttttttggaccaaggaggaccgtccagtgggtagtgaggatagagaaaaagtgtttgtcttaaatacgccaatgtagttttccttctttacaatgtattaaactcgatcgatgatttcaaa

SEQ ID NO: 15502 - DNA, 3491 bp, Homo sapiens
  ENST00000629843
aggccgcgtccgcccgcgcccgctctggcccccgcggagccgcgcaacttcccgggagcccgggccaaagtgagcgcaaagtgctgcccaagttgccgggatggagctgcagagccggcccgaggcgctcgccgtggaactcgcgcgccaccagaacggcgacctcaagaagcagctccacgaaaggcagccgcggatcgccgcgctcagcgacaaacaagctttgggaacgatcactgcagtgcctgtcacgggtcctcaggtcagctccttgcagaggttggccgggcaaggagcggcagtgctacctcaggttaggccaaagactctgattccagacagcctccccgttgccccgggccgggaccggccacccaagcagcccccaacattccagaaggccaccgtggtcagcgtcaagaaccccagcccagccctccccaccgccaacaacactgtcagccatgtgccagcgcccggcagccagccccaggccctcgccgagcccgccgccctcgcctctccgctgagcagtgcgggggtggcctacgccatcatctccacctcccccagcaatgccgccgccatggcccccagcaccgccgtgtctgtggtcagtgacagcatcaaagtccagcccctcctcatcagtgctgacaacaaggtcatcatcattcagcctcaagtgcagacgcagcccgagagcacggcagagtcgcggccgcccacagaggagccatctcagggagctcaggccaccaaaaagaagaaggaagaccggcccccgacccaggagaaccccgagaaaatcgccttcatggtagcgctaggcctggttaccacggaacatttggaagaaatccagagcaagcgacaggagcggaagagaagaagcacagccaaccctgcctacagcggcctcctggagaccgagaggaaacggctggcctccaactatctcaacaaccccctgttcctcacagcgagagccaatgaggacccctgctggaagaacgagatcacccacgatgagcactgtgccgcctgcaagcgaggggccaacctgcagccctgcggcacctgcccgggggcctaccacctcagctgcctggagccgcccctcaagacggcgcccaagggcgtgtgggtgtgccccaggtgccagcagaaggccttaaagaaagacgagggtgtgccctggactgggatgctggccatcgtgcactcttatgtcacccacaagacagtcaaagaagaggagaagcagaagctgctgcaacgaggcagtgagctgcagaacgagcaccagcagctggaggagcgggaccggcggctggcgtcagcagtgcagaaatgcctggagttgaagacaagcctgctggcccgccagaggggcacccagtcatccctggaccgcctgcgggccctcctgagactgatacagggcgagcagctgctccaggtcaccatgacgaccactagccctgccccactgctggccgggccctggaccaagccctcagtggcagccacacaccccaccgtccagcacccccagggccacaactgaccccgagggaccagtcttcatacccacggaaagttattgggaccctgcttacacagcctgggggttctgtcggccttaattcataaacactatgaatttcagacaaaaattaaccagacagaggagaggagggaggaagagctgggcgagaggcctagagccaggaccaggtgggggtgcggccctgtgccctccaaattcacagggggtacctaggagccaggtggggtacgacaggctggggcacacagtctccccccggccacctcggggctgcctgggcctctggcttccaggccctgctctccacggcctccctctggcccgttggaggggcaggctgaggctgtggaggggacaagcacgccccccagaacgcagtctccactgagggcaccgcctattggtgtcctgtgggagggcgagctgagaacacatggactagctgagtggtagcggtagttgggacgagaagcggggtagtggatctaggtagttcctcaatgccccacgctcctaggaggtccccctggggtgggcgggcgggcctggggcactccgtcgcctttgcagaaccacctgggcccctttctgtcagtattattagggttacgaattgcagctgtttaacttgaaagacactgtcggaggtgagcatctgggcgccgggacgctgcagtgatccccgccagagcctgtgcccttcctgctccgtctttggggtcctcaaggctgcctccttccttttgccaatctcttggactcagtttgccgttgatgcgtttttctcatggagtttctgggcagagtggagctgcaaccctgttgtggggggcagcatttggcaggttttctccttggggttgaatcattcaacttaacgactgaagccctttcttgtctcctttggaagagccgataagtattccactcctcccttcttgccagtgcagacactatgccaaaaaataacttcacacttttgtatggcgtttttattgtgagatatttaatgtgaatggttggggggactctggctgacttcctttctgcttctagtagtctctgcttcaaggtacaaatgggaacacctcccctcgggaagcctggccaagctggaagatccggcaggttttttacgagccgggtggagggttggggaggaaagaaagggcggtggctcgggaggttccggccttcggggaccagacttgctgccaagggcttctgcatccagggtgggcagtggcagcttgtcacccttgcccgattcccacatcccagtcctgagggactcagcacaacaggataagcgtccaggagccacgggctcccaccccgagcatatcacatggtgccgaattgcactgaacacgcgtgtgtgcatcgcacgcggccacgaccacagacacgcatgcacacacgcagaggtgcagagcgaggaggccggcaaatcccgcagctgccacggtccctcctgtcattctcacgactccgggagaaactgtgctgtatgatacagatctattttaatacacttaccactgggtgaacaagatttttatattcttttattgatgaacaaagtgaaccgtgtgaggcacacgtcttctatattggctactctgtgccaagtatgcattaccgcgtggcttgcgatgtccatgtcttcagcttccttttctgttggtttggttttcttcgcggatggattgagttacatgttttaacagtgtaatgggaggatctgaaaggttggacccgggaggggtagctgccgatgtgtcttgagattgttaggttttttttggaccaaggaggaccgtccagtgggtagtgaggatagagaaaaagtgtttgtcttaaatacgccaatgtagttttccttctttacaatgtattaaactcgatcgatgatttc

SEQ ID NO: 15503 - DNA, 557 bp, Homo sapiens
  ENST00000414269
gaattagcatcgtgccgaggcacaactttgccgaggcccaacgagatccaggccctcgccgagcccgccgccctcgcctctccgctgagcagtgcgggggtggcctacgccatcatctccacctcccccagcaatgccgccgccatggcccccagcaccgccgtgtctgtggtcagtgacagcatcaaagtccagcccctcctcatcagtgctgacaacaaggtcatcatcattcagcctcaagtgcagacgcagcccgagagcacggcagagtcgcggccgcccacagaggagccatctcagggagctcaggccaccaaaaagaagaaggaagaccggcccccgacccaggagaaccccgagaaaatcgccttcatggtagcgctaggcctggttaccacggaacatttggaagaaatccagagcaagcgacaggagcggaagagaagaagcacagccaaccctgcctacagcggcctcctggagaccgagaggaaacggctggcctccaactatctcaacaaccccctgttcctcacagcgagagccaatgagga

SEQ ID NO: 15504 - DNA, 750 bp, Homo sapiens
  ENST00000420689
agctttgctcgacacggactcgccgtgtttacttggctctttgttcctcccccctcccccggcacacactcacactcacactcactcgcacacgcaccccggcctgcaaacttgcacggctcggggcgcgccgccgggtggcctcggcccccgccccgccccgcgagctgccccgatgaggcggcagccacagaacggcgacctcaagaagcagctccacgaaaggcagccgcggatcgccgcgctcagcgacaaacaagctttgggaacgatcactgcagtgcctgtcacgggtcctcaggtcagctccttgcagaggttggccgggcaaggagcggcagtgctacctcaggttaggccaaagactctgattccagacagcctccccgttgccccgggccgggaccggccacccaagcagcccccaacattccagaaggccaccgtggtcagcgtcaagaaccccagcccagccctccccaccgccaacaacactgtcagccatgtgccagcgcccggcagccagccccaggccctcgccgagcccgccgccctcgcctctccgctgagcagtgcgggggtggcctacgccatcatctccacctcccccagcaatgccgccgccatggcccccagcaccgccgtgtctgtggtcagtgacagcatcaaagtccagcccctcctcatcagtgctgacaacaaggtcatcatcattcagcctcaagtgcagacgcagcccgagagcacggc

SEQ ID NO: 15505 - DNA, 553 bp, Homo sapiens
  ENST00000490679
tccgcctgcccctggcgctgtcctgcacagtttgcgggatcgaggacgcgtgggacccgagcctggagtcttctcttaagcgataacggcgacctcaagaagcagctccacgaaaggcagccgcggatcgccgcgctcagcgacaaacaagctttgggaacgatcactgcagtgcctgtcacgggtcctcaggtcagctccttgcagaggttggccgggcaaggagcggcagtgctacctcaggttaggccaaagactctgattccagacagcctccccgttgccccgggccgggaccggccacccaagcagcccccaacattccagaaggccaccgtggtcagcgtcaagaaccccagcccagccctccccaccgccaacaacactgtcagccatgtgccagcgcccggcagccagccccaggccctcgccgagcccgccgccctcgcctctccgctgagcagtgcgggggtggcctacgccatcatctccacctcccccagcaatgccgccgccatggcccccagcaccgccgtgtctgtggtcagtgaca

SEQ ID NO: 15506 - DNA, 508 bp, Homo sapiens
  ENST00000460507
tgcagagactctggccacaggaagtgtcagtatcctttggtgcagctgtgaatggtgcccaggagctgagcgtcttgtagtgcctgaagggcgcattggtggccaccccccgtgagcgagaggacatccagcccccacctcaggggactcagtggttggagaaagttcctgattcagctccacgtggctctccatggagaagcagaaagagaatcgtgttttcttgcagaggcattgaggctttgggaacgatcactgcagtgcctgtcacgggtcctcaggtcagctccttgcagaggttggccgggcaaggagcggcagtgctacctcaggttaggccaaagactctgattccagacagcctccccgttgccccgggccgggaccggccacccaagcagcccccaacattccagaaggccaccgtggtcagcgtcaagaaccccagcccagccctccccaccgccaacaacactgtcagccatgtgccagcgcccggcagccagcc

SEQ ID NO: 15507 - DNA, 338 bp, Homo sapiens
  ENST00000474327
gcccgggccaaagtgagcgcaaagtgctgcccaagttgccgggatggagctgcagagccggcccgaggcgctcgccgtggaactcgcgcgccaccagaacggcgacctcaagaagcagctccacgaaaggcagccgcggatcgccgcgctcagcgacaaacaaatcgcgggcagaacctctcatctgtgcacaagggacccagcacggggctttgggaacgatcactgcagtgcctgtcacgggtcctcaggtcagctccttgcagaggttggccgggcaaggagcggcagtgctacctcaggttaggccaaagactctgattccagacagcctcccc

SEQ ID NO: 15508 - DNA, 749 bp, Homo sapiens
  ENST00000462631
cccttctcagtatctccccaactctgtgtgcggtacaggtggtctcggatgcactccttctgctgcctaccccgaatggccctgaggagggctgtttaccaggcaccaatgctttatcatctgaaaaacacatggcagaaagaattcaagggaggacggagaaaacccaaagataccttgtcaggtgagaggagggcttcagagtcactcacgccaaacaggcttcatagccacgccaggggcccatgatggtgatctacagggtccagccgtgagtgaggagccctgtggttgaaaaacacagggtgtgggtggattagaactccttccaaaacacagattattgagcctttcctcccagggttttagatttaatcactcttgggtgggcctgagaatttgcattttgaggcgagtcctcatgctctgctggtactgctggaatggccaccacaccttgagcaccgctgggttggaggaggagtgctgacggagtgctaagctgatctcatcctggccagaccttaggagggagctcctgcaaactgatgccagcagggccaggcgagcatggatcacgtggacacggaggccctttgtcctgcttcgtccgtccaaccctatgccagtgagctccacgaagcagtgacgcctgcagagactctggccacaggaagtgtcagtatcctttggtgcagctgtgaatggtgcccaggagctgagcgtcttgtagtgcctgaaggtaacaa

SEQ ID NO: 15509 - DNA, 528 bp, Homo sapiens
  ENST00000495348
ggagctgcagagccggcccgaggcgctcgccgtggaactcgcgcgccaccagaacggcgacctcaagaagcagctccacgaaaggcagccgcggatcgccgcgctcagcgacaaacaagatgattagtgagcaggggactgatttcctcgttcctcattcatgaacaacaactaacatttgtgtagcagcatcttgaggtattgggcattgccacttacattaacccgttggattcacgtttcatgggtttaaaaagcgaggtttgagggctggtgggccttttccagggcacccacaaataaaatccagcgttttctttggaggaggccaagctgagattggaggcagcttcctagagcccttctcatcactcgcacagcaccgccaccgccaacttgttccttgagtccggggtttgaggaacatccatgtgaagagttccctgaggtctcctgaccaggctgctttatctgtggcccttcagactatggtcctgtgatccgccagcctgccatgggctgcggaga

SEQ ID NO: 15510 - DNA, 575 bp, Homo sapiens
  ENST00000491522
agccgcgcaacttcccgggagcccgggccaaagtgagcgcaaagtgctgcccaagttgccgggatggagctgcagagccggcccgaggcgctcgccgtggaactcgcgcgccaccagaacggcgacctcaagaagcagctccacgaaaggcagccgcggatcgccgcgctcagcgacaaacaagtaagcgatgggatcgcggccccccctgggatggggcgggagggtggctgggcactttggcggcgccctaaaaagtgccagcctgggcgacgcacgctcagactcccagaggggtctgtctccagttctcaaagttccccacccctcccctttcctggaaagaaagagccgggttctcggaggcggcagggagagccgggccctgcgggggccgaagagaggagctcacttaaaaggcagcgcgcggcccggcgtccattttgaggtggtggacatgtttttggaacgtggcgatttctcccggctcggagtcccccgctttgcgctgaggcggccatgggggcggaggggggcggccgtgggggcctggacaccaaactcgttggaagcga

SEQ ID NO: 15511 - DNA, 3540 bp, Homo sapiens
  ENST00000396103
atttatgagctttgctcgacacggactcgccgtgtttacttggctctttgttcctcccccctcccccggcacacactcacactcacactcactcgcacacgcaccccggcctgcaaacttgcacggctcggggcgcgccgccgggtggcctcggcccccgccccgccccgcgagctgccccgatgaggcggcagccacagaacggcgacctcaagaagcagctccacgaaaggcagccgcggatcgccgcgctcagcgacaaacaagctttgggaacgatcactgcagtgcctgtcacgggtcctcaggtcagctccttgcagaggttggccgggcaaggagcggcagtgctacctcaggttaggccaaagactctgattccagacagcctccccgttgccccgggccgggaccggccacccaagcagcccccaacattccagaaggccaccgtggtcagcgtcaagaaccccagcccagccctccccaccgccaacaacactgtcagccatgtgccagcgcccggcagccagccccaggccctcgccgagcccgccgccctcgcctctccgctgagcagtgcgggggtggcctacgccatcatctccacctcccccagcaatgccgccgccatggcccccagcaccgccgtgtctgtggtcagtgacagcatcaaagtccagcccctcctcatcagtgctgacaacaaggtcatcatcattcagcctcaagtgcagacgcagcccgagagcacggcagagtcgcggccgcccacagaggagccatctcagggagctcaggccaccaaaaagaagaaggaagaccggcccccgacccaggagaaccccgagaaaatcgccttcatggtagcgctaggcctggttaccacggaacatttggaagaaatccagagcaagcgacaggagcggaagagaagaagcacagccaaccctgcctacagcggcctcctggagaccgagaggaaacggctggcctccaactatctcaacaaccccctgttcctcacagcgagagccaatgaggacccctgctggaagaacgagatcacccacgatgagcactgtgccgcctgcaagcgaggggccaacctgcagccctgcggcacctgcccgggggcctaccacctcagctgcctggagccgcccctcaagacggcgcccaagggcgtgtgggtgtgccccaggtgccagcagaaggccttaaagaaagacgagggtgtgccctggactgggatgctggccatcgtgcactcttatgtcacccacaagacagtcaaagaagaggagaagcagaagctgctgcaacgaggcagtgagctgcagaacgagcaccagcagctggaggagcgggaccggcggctggcgtcagcagtgcagaaatgcctggagttgaagacaagcctgctggcccgccagaggggcacccagtcatccctggaccgcctgcgggccctcctgagactgatacagggcgagcagctgctccaggtcaccatgacgaccactagccctgccccactgctggccgggccctggaccaagccctcagtggcagccacacaccccaccgtccagcacccccagggccacaactgaccccgagggaccagtcttcatacccacggaaagttattgggaccctgcttacacagcctgggggttctgtcggccttaattcataaacactatgaatttcagacaaaaattaaccagacagaggagaggagggaggaagagctgggcgagaggcctagagccaggaccaggtgggggtgcggccctgtgccctccaaattcacagggggtacctaggagccaggtggggtacgacaggctggggcacacagtctccccccggccacctcggggctgcctgggcctctggcttccaggccctgctctccacggcctccctctggcccgttggaggggcaggctgaggctgtggaggggacaagcacgccccccagaacgcagtctccactgagggcaccgcctattggtgtcctgtgggagggcgagctgagaacacatggactagctgagtggtagcggtagttgggacgagaagcggggtagtggatctaggtagttcctcaatgccccacgctcctaggaggtccccctggggtgggcgggcgggcctggggcactccgtcgcctttgcagaaccacctgggcccctttctgtcagtattattagggttacgaattgcagctgtttaacttgaaagacactgtcggaggtgagcatctgggcgccgggacgctgcagtgatccccgccagagcctgtgcccttcctgctccgtctttggggtcctcaaggctgcctccttccttttgccaatctcttggactcagtttgccgttgatgcgtttttctcatggagtttctgggcagagtggagctgcaaccctgttgtggggggcagcatttggcaggttttctccttggggttgaatcattcaacttaacgactgaagccctttcttgtctcctttggaagagccgataagtattccactcctcccttcttgccagtgcagacactatgccaaaaaataacttcacacttttgtatggcgtttttattgtgagatatttaatgtgaatggttggggggactctggctgacttcctttctgcttctagtagtctctgcttcaaggtacaaatgggaacacctcccctcgggaagcctggccaagctggaagatccggcaggttttttacgagccgggtggagggttggggaggaaagaaagggcggtggctcgggaggttccggccttcggggaccagacttgctgccaagggcttctgcatccagggtgggcagtggcagcttgtcacccttgcccgattcccacatcccagtcctgagggactcagcacaacaggataagcgtccaggagccacgggctcccaccccgagcatatcacatggtgccgaattgcactgaacacgcgtgtgtgcatcgcacgcggccacgaccacagacacgcatgcacacacgcagaggtgcagagcgaggaggccggcaaatcccgcagctgccacggtccctcctgtcattctcacgactccgggagaaactgtgctgtatgatacagatctattttaatacacttaccactgggtgaacaagatttttatattcttttattgatgaacaaagtgaaccgtgtgaggcacacgtcttctatattggctactctgtgccaagtatgcattaccgcgtggcttgcgatgtccatgtcttcagcttccttttctgttggtttggttttcttcgcggatggattgagttacatgttttaacagtgtaatgggaggatctgaaaggttggacccgggaggggtagctgccgatgtgtcttgagattgttaggttttttttggaccaaggaggaccgtccagtgggtagtgaggatagagaaaaagtgtttgtcttaaatacgccaatgtagttttccttctttacaatgtattaaactcgatcgatgatttcaaa

SEQ ID NO: 15512 - DNA, 313 bp, Homo sapiens
  ENST00000486477
cagaaaacagcgcatagggtaggctgggccagccgaggattatgtgaaggttcgttgggaccctccggaggccagtggggtactgcaaagagccatgggggtgttgatgtccaagcggcagacagtggagcaggtgcagaaggtgagtctggctgtgtctgctttcaaggatgggctgcgggacaggccttccatccgacgcacaggtgagctgccagggtcccgccgtggcactgtagagggctccgtccaggaggtacaggaggagaaggaagcagaagcaggaacctcggtggtccaggaagagagtagt

SEQ ID NO: 15513 - DNA, 1681 bp, Homo sapiens
  ENST00000476115
ctcgggctgccgtgggctgcgcggggcccgcggtgtgtagagtccgccgccccggagccgcgtcccgcacccggacggtcccgagccatgggggtgttgatgtccaagcggcagacagtggagcaggtgcagaagggtctgcaccagggttttccatgatggctgcctgcgccgcatgggctacatccaaggagacagtgcagcggaggtgacggagatggcccacacagaaacaggctggagctgccactactgtgacaacatcaacttgctgcttactgaggaggaaatgtatagcctcacggagacctttcagcggtgtaaagtcatccctgattgctccctgacactggaggactttctgcgttaccgccaccaagcagccaagcggggggaccgtgacagggccctgagtgaggagcaagaagagcaggcggcccgccagtttgctgccctggaccctgaacatcgaggccacatagagtggcctgacttcttgtcccatgagtccctcctgcttctgcagcagttgcgtccccagaactctctgttgaggcttctgacagtgaaggagcgggagcgagcccgagccgccttcctggctcggggcagtgggagcaccgtcagtgaggcagagtgccgccgggcccagcactcttggttttgcaaacggttcccagaggctccttcctgcagtgtcagcatcagccatgtgggtcccatcgcagatagcagcccagccagcagcagcagcaagagtcaggacaagaccctgctgcccacagagcaggagtccagatttgtggactggcctaccttcctgcaagagaatgtcctctacatcctggctgctcgccccaacagcgcagccattcacctgaagcccccaggatagcatggagcagagaagctcggtttgaggacagtgacatcctctccctcctttcctttctcccttcccccaccaacctctggcacagagactcatggggttgggacactgccagcgtcttaacttgtcactaagctttaaggcactgaaatcaccattcccctcacaatagaggcagtgaatgcattgccacaaggagaagccctgggagctgtggcagcatcctctcctggaccgcccctgccccacatcatagacgggacctgccaccacacttatatacatgtgcacatgctgcccagctgtccatgccttcagaagcctggttctttttggttgagaaaggaccaaagtccctttgtgaagcccctggtatagaggagggggtctctactcaccccttctataggcaggccagttctaatttccaatagataagtctctggccaagtgattcttaggaagggggcatgtcagactcgcatgcctgcctagagctcctggagatcctaatgggccccgctttctccaccaaaaatcccttctgcagtcagctgctgttactagtaggtgtgcattatgtacctcggctgtactgagttgggaaaagagttaaacatcaccactgaaattcagccctttatttatttaaattccaattcctggtgacagaaaaggcaactagcctggagaatcctgactggaagagggggaggcagcccttcccagggactcgggattctaggaacctctcagtcaggtcacctgagtccaaaagtctttagcagg

SEQ ID NO: 15514 - DNA, 5718 bp, Homo sapiens
  ENST00000242315
gctgccgtgggctgcgcggggcccgcggtgtgtagagtccgccgccccggagccgcgtcccgcacccggacggtcccgagccatgggggtgttgatgtccaagcggcagacagtggagcaggtgcagaaggtgagtctggctgtgtctgctttcaaggatgggctgcgggacaggccttccatccgacgcacaggtgagctgccagggtcccgccgtggcactgtagagggctccgtccaggaggtacaggaggagaaggaagcagaagcaggaacctcggtggtccaggaagagagtagtgccggccgcgcagcctgggagcggctccgagatgggcgcggcgtggagcctgaggagtttgacaggacaagtcgattcacaccccctgcgttcatccgccccacccggaagctggatgatgacaaacctccagaaatctgcctggagcccagagagcctgttgtcaacgatgagatgtgtgatgtttgtgaggtctggacagctgagagcctcttcccgtgcagggtctgcaccagggttttccatgatggctgcctgcgccgcatgggctacatccaaggagacagtgcagcggaggtgacggagatggcccacacagaaacaggctggagctgccactactgtgacaacatcaacttgctgcttactgaggaggaaatgtatagcctcacggagacctttcagcggtgtaaagtcatccctgattgctccctgacactggaggactttctgcgttaccgccaccaagcagccaagcggggggaccgtgacagggccctgagtgaggagcaagaagagcaggcggcccgccagtttgctgccctggaccctgaacatcgaggccacatagagtggcctgacttcttgtcccatgagtccctcctgcttctgcagcagttgcgtccccagaactctctgttgaggcttctgacagtgaaggagcgggagcgagcccgagccgccttcctggctcggggcagtgggagcaccgtcagtgaggcagagtgccgccgggcccagcactcttggttttgcaaacggttcccagaggctccttcctgcagtgtcagcatcagccatgtgggtcccatcgcagatagcagcccagccagcagcagcagcaagagtcaggacaagaccctgctgcccacagagcaggagtccagatttgtggactggcctaccttcctgcaagagaatgtcctctacatcctggctgctcgccccaacagcgcagccattcacctgaagcccccaggatagcatggagcagagaagctcggtttgaggacagtgacatcctctccctcctttcctttctcccttcccccaccaacctctggcacagagactcatggggttgggacactgccagcgtcttaacttgtcactaagctttaaggcactgaaatcaccattcccctcacaatagaggcagtgaatgcattgccacaaggagaagccctgggagctgtggcagcatcctctcctggaccgcccctgccccacatcatagacgggacctgccaccacacttatatacatgtgcacatgctgcccagctgtccatgccttcagaagcctggttctttttggttgagaaaggaccaaagtccctttgtgaagcccctggtatagaggagggggtctctactcaccccttctataggcaggccagttctaatttccaatagataagtctctggccaagtgattcttaggaagggggcatgtcagactcgcatgcctgcctagagctcctggagatcctaatgggccccgctttctccaccaaaaatcccttctgcagtcagctgctgttactagtaggtgtgcattatgtacctcggctgtactgagttgggaaaagagttaaacatcaccactgaaattcagccctttatttatttaaattccaattcctggtgacagaaaaggcaactagcctggagaatcctgactggaagagggggaggcagcccttcccagggactcgggattctaggaacctctcagtcaggtcacctgagtccaaaagtctttagcagggtagtcaaaaatcaaggtgagccttcttggccccatttttcagatggtagctcatggcctagggccaagggggcctgaatggagcaaacacactggcaggagccacagccctctgtgttagatgcttcacccaagtcaccgaccacagagactgacgagagcacactctggaggaagaggagagaacggggctctgcttcctcatcattccagctcaactcaactgtagacaccttccacagcccaagaaagatctgcagagccctgagcagggactctttcagccatcctgacaaacaggataagaggctggggcttaagaagaggctctgcagagaaggtcctgggaaagccttacagaagaagttttccgcttctccctatcactgagactcggcttgagtggctgcttctcctcactgctcatcacatgtccttccccagcaggctagggcttgggcctggcatggaaggccttttggggcaatcagaggctgccacaagagcaccaagcctggcctccaagccccagccctccttcctaagtactcatcaaattcaaattcttcagtccgtgtgttatggctcatcttggccggccgtggggtccatgttctaggcttctgtttccaacttaatgacttaggcatagcgagatctgactaccaagagttattcaaaagggagtggagtgcagtcatgcagaagcaaacacgtcttcattgctcgaggcccttgtgctaaatcgggtgcgtacagaagaacacacaccgctcggtgctgaatgtttcgaggaaagcaaggagctgcggccaggggcttcttgagagccctgtgtagtctcctcctgtaggaaccaccttagctggaagcagggtggtgagctgctggggttggattatttgggactgaaatgaagcagacaggagacaaatctgggctcaggtgtatggcccacagcttttagaaatgctcttcagccgtcccccaggattgatccataggaggggccattattcagtctagtcaaaacaagaaagcgcaggactcctgggcctaagaactgcatctgaagcagccaggcctggggttttgcactgagatgaaagcacattaagcacaggggctcttacctactctcctggcaaatcatctcctgtgccactggccttgggctgctcgatctcacagacggggcattttgagtagagacaagctctgggctttgagagctgaatagcatttttctcctgcctcatcagtcacagggactggaagtccatcttgttccctgatccttcacagatcaaggtgatgcctacctctttggagctgctgcctctagctctccacgggtgagtgaggagagttggtgggccaggtcaggcctgccgtattccagggcctggcaaagcagccccagagttcttccacaacaggaacaggcccatttggatcacgcttctccctattccagaacagcaaacttcctgggtgagggcctgctacagagatcccaggggacacttccctcagcaaagagtagagttcccatcccacaagagtcctaggaagcaggaaagcacgaaggagcagccagcctcttctccacaggcagtcatctagctttttaccaaaggggaagtgccgttgctccccaagtccagagttgcagacgccctgccccaacccccgtccagaatctccctttgcagtgttctaatccccagagcccctctgcggtatgtatagagttgttaaaaacgttcagaaacccagtgaagcccatttcgttttcaagccctcccatcactgtgactctgaaattctgccaagtacaaatattagcgtttggctctaataagggtatgagaaaatgtttcagtcttttctttgtggctacccaaaattgagatcagtgtttctaaccaaggaaggcctgggttatagacaggctcctctgaagcccacttgccctaagcatttttcacctagcattcctcttcctcatgttcagatgtgaatgaaggggcagctggaggatgtggtggagctgcagggaccgagggtcagctgagcagtggccctggccacaaaaccactccaagtctgctccttggcttcctctcctgagcccagccttccccaacagaacacttgagcaagggcccctagagtatcccagggatggagcagtcccctcactctaggtactgatctaaccttcaagtgctcctcttcatttgaggacacctacagtagaaaccatgaggacattgcctctttctgccctcagcccaagtacctggggctagcagggcagataccagcctttctggtcctgctgctccctatgggatgtcaccctgaccttgcttaagtggccaagtcttagggtccccttattcctgtcaccattatgaaaaacacagcattaaactgcctgggaagaggacacctccttgggggagtgagccccaaggttatacccaggactcatagcccaaagcacaacctcggccattgcaggtttcacagcttcagtcagagtggtgccaggaagcccaaaagccaagagggaaggtcagcagaagctgcctggcaaggccccaggccagccaggcccaccccagagccaagagaaacttcaagcaggactgagaactggtagctggctctagtgatcctgaaagcatgttcccttcagaccagcagagtgaagacagacagatgtgtggccctaaaaggcagaacagttttgatgccagaacttcaggactgtcaccacagtccctttttacccctcctctatttacagtgaaataaaattcctattttcttttttttttttttttaattttccttatttcaagctcttatctgaaaaaatgctactttctcctaccacttagtttgaatttgcccaggatatctgtctgggcccctggctgcaacccagacaatggcgagatctcctggagtgggggatattcacgcatcgtgcctgttcctgacagctcagccctggtgtagggtgggactgggcattttctctgctgttacttttctgctaccactatttttggcaaccttggaaagaaaataaacaggttacagaatttcggctagcactaagggaaagctttttcctctgggccacatgccccagtgacccagagcatggaaagggggtcagctctggtctgggccagtgactaagaagcccaatcacattccagtttctatagcactgggtaggcacaacccacagttaagaacatcaagttataagtagccaggccttttcatagccatggtgacacaaaggccctcaagattagcctcctgccatcatgggttggcctgtgatctgtcccccagccaaacccaagtttgtgagagggactctgagaacacttgagcaacacttgggaatccaatgcgctctggtccctcatgcccttcccatgtgcttttctgcagaaggtaacttgacagcaagctgaggggaacgtccccaagccctgtctccctgtctctacagctgcatgctcctctgcgtggcccagccttcacagcgctccagaagaagctgatgccctgaggctgggcacagtggaaatcataataaagcgattgcgatgctc

SEQ ID NO: 15515 - DNA, 668 bp, Homo sapiens
  ENST00000440503
cgaggaaagcaaggagctgcggccaggggcttcttgagagccctgtgtagtctcctcctgtaggaaccaccttagctggaagcagggtggtgagctgctggggttggattatttgggactgaaatgaagcagacaggagacaaatctgggctcaggtgtatggcccacagcttttagaaatgctcttcagccgtcccccaggattgatccataggaggggccattattcagtctagtcaaaacaagaaagcgcaggactcctgggcctaagaactgcatctgaagcagccaggcctggggttttgcactgagatgaaagcacattaagcacaggggctcttacctactctcctggcaaatcatctcctgtgccactggccttgggctgctcgatctcacagacggggcattttgagtagagacaagctctgggctttgagagctgaatagcatttttctcctgcctcatcagtcacagggactggaagtccatcttgttccctgatccttcacagatcaaggtgatgcctacctctttggagctgctgcctctagctctccacggctgcatgctcctctgcgtggcccagccttcacagcgctccagaagaagctgatgccctgaggctgggcacagtggaaatcataataaagcgattgcgatgctc

SEQ ID NO: 15516 - DNA, 6020 bp, Homo sapiens
  ENST00000373542
tccgcggcgccaggcctgagcggtgggagggctctgcggggcctggtgttcaggcgtcccaccacgagggtggagcagcgttggatacttgttccttagggaccgaaggctccggtggcacccgggctatttctcagaggacaattagtaacgtgtcgccatgaggagccggagtaactccggggtccggctggacggctacgctcgactggtgcaacagaccatcctgtgccatcagaatccagtgactggcttgcttccagccagctatgatcagaaagatgcttgggtccgagataatgtgtacagcatcttggctgtgtggggtttgggcctggcctatcggaagaatgcagaccgggatgaggataaggcaaaggcctatgaattggagcagagtgtagtgaagctgatgagaggactactgcactgcatgatcagacaggtggataaagtagaatccttcaaatatagtcagagtactaaggatagcctccatgcaaagtacaacaccaaaacctgtgccactgtagtgggtgatgatcaatggggacacctgcagttggatgctacctctgtgtacctgctcttcttagcccaaatgactgcctcaggactccatatcatccacagcctagatgaagtcaatttcatacagaaccttgtgttttacattgaagctgcatataaaactgctgacttcgggatatgggaacgtggagacaagaccaaccaagggatctcagagttgaatgccagttcagttggaatggcaaaggcagccctggaagcattagatgaactggatctgtttggtgtgaaaggtgggcctcaatcagttatccatgtcctggctgatgaagtacagcactgccagtctatcctaaattcactactgccccgtgcttcaacatcaaaagaggttgatgctagtctactctcagtggtttccttccctgcctttgcagtagaggatagccagttggtggagctcacaaaacaggaaatcatcaccaagcttcagggtcgttatggttgctgtcgctttctacgagatggatataaaactcctaaagaggatcccaatcgtctgtactatgaaccagctgagctgaagctatttgaaaacattgagtgtgaatggccattgttctggacatactttattcttgatggggtcttcagtggcaatgcagaacaggttcaagaatataaagaggctcttgaagcagtcctcatcaagggcaaaaatggagtcccacttctgccagagctgtacagtgttcctcctgacagggtcgatgaagaatatcagaatcctcacactgtggaccgagtccccatggggaaattgcctcacatgtggggtcagtctctatacattttaggaagcttgatggcagagggatttttagcccctggagaaattgatcccctgaatcgcaggttttctactgtaccgaagcccgatgttgtggttcaagtctccattctagctgaaacagaagaaatcaagaccattttgaaggacaagggaatttacgtggagaccattgctgaggtataccccatcagagtacaaccagctcgtattctcagccacatttattccagcctaggatgcaacaatagaatgaaactcagtggacgaccctacagacacatgggagtgcttggaacttcaaaactctatgacattcggaaaactatctttactttcactccacagtttatagaccagcaacagttctacctggctctggacaacaagatgatagtggaaatgcttagaacagacctctcctacctctgtagccgctggcggatgacaggccagcccaccatcaccttccccatctcacacagcatgcttgatgaagatggaacaagcttgaattcaagtatcctggcagcactccgaaaaatgcaagatgggtattttggtggggcaagggttcaaacaggtaaattgtcagagtttttgacaacatcttgttgcacacacttgagcttcatggaccctggacctgagggtaagctgtacagtgaagattatgatgacaactatgattacctggaatctggcaactggatgaatgattatgattcaaccagtcatgctcgctgtggtgatgaagttgctcgttatttagatcaccttttggcgcacactgctccccatcctaaactagcccctacctcacagaagggagggctagatcggttccaagctgctgtgcaaacaacctgcgacttaatgtccttggtgaccaaggccaaggaactgcatgtacagaatgttcacatgtatcttcctacgaagttatttcaggcttcccggccttcattcaacttacttgattcacctcatccccgacaggagaaccaggttccctctgttcgtgtagaaatacatcttcctagagaccagtctggggaggtggactttaaagcactggttttacagttgaaggagacctcaagcttacaggaacaagctgatatcctctatatgctgtatactatgaaaggacctgactggaacactgaattgtataatgaacggagtgctacagtgagagagcttcttaccgagctgtatggcaaagtgggagaaattcgtcactggggcctgatccgatacatttctgggatcttaaggaagaaagtggaagcacttgatgaggcctgcacagaccttctctcccaccagaaacatttgacagtaggacttcctccagaacctcgagaaaagactatctctgcacctctgccctatgaggcgctcactcagctgatagatgaagccagtgaaggggatatgagcatttcaatccttacacaggaaataatggtatatctagccatgtatatgcgaacccagcctggcctctttgctgaaatgtttcgacttcgaattggtctgatcatacaagttatggcaacagaactggcccactcccttcgatgctcagctgaggaagccacagagggcctgatgaatctcagtccttcggccatgaagaatctcctgcatcacattctcagcggcaaggagtttggagtggaacgaagcgttcgtcccactgattcaaatgtcagtcctgctatttctatccacgagattggtgctgttggagcaaccaaaacagaacgaactgggatcatgcagttaaaaagtgagataaagcaggtggaatttcgtagactgtcaatctcagctgagagtcagtcacctggaacctctatgactccaagtagtgggtcctttcctagtgcatatgatcagcagtcatctaaagatagtcgtcaaggtcaatggcaacgccgaagaaggctggatggggcactgaatagagttccagttggattttatcagaaagtatggaaagttttgcagaagtgtcacggactttctgttgaagggtttgtccttccttcctctaccactagagagatgactccaggtgagattaaattctctgttcatgtggagtctgtcctgaatcgtgtacctcagccagagtaccgtcagctgctggttgaagccatccttgtcctcaccatgctggcagatattgaaattcatagcatcggaagcatcattgctgtggaaaaaatagtgcatattgccaatgacttgttccttcaagaacagaaaacccttggcgcagatgataccatgttggcaaaggatcccgcatctggcatctgtactcttctgtatgacagtgcacccagtggcaggtttggcaccatgacctacctctccaaggcagccgccacctacgtgcaggagttcctgccccacagcatctgtgccatgcaatgagggctttggttcctggcttctgggagccttttgacagctggtccctgcctcggttgattgtgcatggaactaaaatgttattgcctaatcactccaaccctgcccctttctgtcccatccttcccaagaagagagaactttttcgataaactaactactgtagaagaagtgaacacttacctggaggctcaccttgcagaaccagtgacaatcttatgagtataatgaacactcagccaggcctgtcatgattggctttatttctttcatcattcataaaagtttgcatgtgtttttattctctagatctgttaccaatatagttttctaactcctgtttggggagcaagtgttaataataacttattcctaaagcttggtttttcttttttgtgattttattgtgtatatgagtggtgggtactttgggacattatttcaaatgagtaaactctaaattgttaaatatttatgctgctataaattagaattacctattctacgtgccttttcttaggaaaagagagtactggatcatggttttcttccttacttacaggttgcttcacactgagtgataatttaaaattgtttctatgtagaatcattgtctctactgttgccctctctgtgtctgcacacataatgcctctctcactttggtgaaatatcaaaaaaatgcaagtacagcatgcatatttaagaatttctgaactaacacttgaaatcacattttataaagattgttggtactcagagttgtatttgcagcagaaaatgcagaataacccagaaatggagcccggagcccaattccagagaggaagggaaagaagagacgatgcctggacaatgtcttatacatagggaacagagagggaatcagaggtggcttagttccctgaagacagccttatgcgcttaatccctgcctttgaaaaatgggccaatacacaacacagacaataatttgaagcgtctgtattcagcaaagataaatacagcagtccagtctataggtgctctacttagcattcttttcatgtgctcctggtctctgtctcactcacctactttctactacatccaactcaactccctgacaccctatccccccatctattcttaaactctttcatatatattttcacttcctaattctagtgtacatatccctgtatatcatggtatctgtgggcatatgtctgtttcttataaagacacatatttgtgtgtgtatgtgtgtgtgtgtgtgtgtgtgtgtataagcatacatgggaatttttctgaatgtaagcagttttgatgtgtctgtatatcaatctgtatctacatttgatggactgagtaagaatgttgcatgtgagagaagggatgtgactgtggactcagattgacacacacagattggtggaagaatagcttcagtcctcttccttcatcccatatgtaggtagccttgcttgacaaatgtttcttctaactctccttcttctgaattgtgcagagactctgttaacttccctttttgcacttagataacttcctacttcaaccccctcctttatcttggatttctaaagtttttccccaatattgggaatggtgagggtggggatgagagactctctgaacaattcttgcagaaccagtgacaatcttatgaatataatgaataagtaagcatatagtagggtgatagaatacagatagtagaaacaaagagaggacagcaaaccttttcagcacttctctcagagcaaatggaaacacacagtaagtagctttctgactacattattttctggtcacttttaaagaaagtttacaacctgttctgaaactatttgtcttttcactggttgtaagtgtaccccaatctcagggagtatatctgtagtgccacaggcaaaagatccactccttcccacactcatttgcctgaacttactcgaagggctgcatttctctgagtttacgaaattgtgtcattatggtccccatacagtggtatttaacttttaaagcaacttttaagaaaactcgacttgttttttgttcattttaagtgtgtggtactaaaaagacatgttagactttttttaaaaaagcacttatgttttgaaaatagaataaataataagaatttccaattaaatcatgtctggtgccaatgtgcaaaacttca

SEQ ID NO: 15517 - DNA, 6173 bp, Homo sapiens
  ENST00000373545
tcgcgcccgccccgcctcccgctcgcgtctcccgcaaggtggaggcggcgcagcggtcgttgacctgttggcggcggccgggcgggaggctgtgggccgcggcggtctcccggggttgaggggaggatgcaggagtcacacgcggaggccggactggactaagggggcaggagcggcgcctggggcgctgcggcggggctctagaccgcgggaagccagtgctagcgctggcgcgtggtgggcccctgaggccgccggagtccggagaggtacgcggaatccgcggcgccaggcctgagcggtgggagggctctgcggggcctggtgttcaggcgtcccaccacgagggtggagcagcgttggatacttgttccttagggaccgaaggctccggtggcacccgggctatttctcagaggacaattagtaacgtgtcgccatgaggagccggagtaactccggggtccggctggacggctacgctcgactggtgcaacagaccatcctgtgccatcagaatccagtgactggcttgcttccagccagctatgatcagaaagatgcttgggtccgagataatgtgtacagcatcttggctgtgtggggtttgggcctggcctatcggaagaatgcagaccgggatgaggataaggcaaaggcctatgaattggagcagagtgtagtgaagctgatgagaggactactgcactgcatgatcagacaggtggataaagtagaatccttcaaatatagtcagagtactaaggatagcctccatgcaaagtacaacaccaaaacctgtgccactgtagtgggtgatgatcaatggggacacctgcagttggatgctacctctgtgtacctgctcttcttagcccaaatgactgcctcaggactccatatcatccacagcctagatgaagtcaatttcatacagaaccttgtgttttacattgaagctgcatataaaactgctgacttcgggatatgggaacgtggagacaagaccaaccaagggatctcagagttgaatgccagttcagttggaatggcaaaggcagccctggaagcattagatgaactggatctgtttggtgtgaaaggtgggcctcaatcagttatccatgtcctggctgatgaagtacagcactgccagtctatcctaaattcactactgccccgtgcttcaacatcaaaagaggttgatgctagtctactctcagtggtttccttccctgcctttgcagtagaggatagccagttggtggagctcacaaaacaggaaatcatcaccaagcttcagggtcgttatggttgctgtcgctttctacgagatggatataaaactcctaaagaggatcccaatcgtctgtactatgaaccagctgagctgaagctatttgaaaacattgagtgtgaatggccattgttctggacatactttattcttgatggggtcttcagtggcaatgcagaacaggttcaagaatataaagaggctcttgaagcagtcctcatcaagggcaaaaatggagtcccacttctgccagagctgtacagtgttcctcctgacagggtcgatgaagaatatcagaatcctcacactgtggaccgagtccccatggggaaattgcctcacatgtggggtcagtctctatacattttaggaagcttgatggcagagggatttttagcccctggagaaattgatcccctgaatcgcaggttttctactgtaccgaagcccgatgttgtggttcaagtctccattctagctgaaacagaagaaatcaagaccattttgaaggacaagggaatttacgtggagaccattgctgaggtataccccatcagagtacaaccagctcgtattctcagccacatttattccagcctaggatgcaacaatagaatgaaactcagtggacgaccctacagacacatgggagtgcttggaacttcaaaactctatgacattcggaaaactatctttactttcactccacagtttatagaccagcaacagttctacctggctctggacaacaagatgatagtggaaatgcttagaacagacctctcctacctctgtagccgctggcggatgacaggccagcccaccatcaccttccccatctcacacagcatgcttgatgaagatggaacaagcttgaattcaagtatcctggcagcactccgaaaaatgcaagatgggtattttggtggggcaagggttcaaacaggtaaattgtcagagtttttgacaacatcttgttgcacacacttgagcttcatggaccctggacctgagggtaagctgtacagtgaagattatgatgacaactatgattacctggaatctggcaactggatgaatgattatgattcaaccagtcatgatgttcacatgtatcttcctacgaagttatttcaggcttcccggccttcattcaacttacttgattcacctcatccccgacaggagaaccaggttccctctgttcgtgtagaaatacatcttcctagagaccagtctggggaggtggactttaaagcactggttttacagttgaaggagacctcaagcttacaggaacaagctgatatcctctatatgctgtatactatgaaaggacctgactggaacactgaattgtataatgaacggagtgctacagtgagagagcttcttaccgagctgtatggcaaagtgggagaaattcgtcactggggcctgatccgatacatttctgggatcttaaggaagaaagtggaagcacttgatgaggcctgcacagaccttctctcccaccagaaacatttgacagtaggacttcctccagaacctcgagaaaagactatctctgcacctctgccctatgaggcgctcactcagctgatagatgaagccagtgaaggggatatgagcatttcaatccttacacaggaaataatggtatatctagccatgtatatgcgaacccagcctggcctctttgctgaaatgtttcgacttcgaattggtctgatcatacaagttatggcaacagaactggcccactcccttcgatgctcagctgaggaagccacagagggcctgatgaatctcagtccttcggccatgaagaatctcctgcatcacattctcagcggcaaggagtttggagtggaacgaagcgttcgtcccactgattcaaatgtcagtcctgctatttctatccacgagattggtgctgttggagcaaccaaaacagaacgaactgggatcatgcagttaaaaagtgagataaagcaggtggaatttcgtagactgtcaatctcagctgagagtcagtccaatggtggtcatcccctgggtatagatttgatgtcaccgtcttttatgtcacctggaacctctatgactccaagtagtgggtcctttcctagtgcatatgatcagcagtcatctaaagatagtcgtcaaggtcaatggcaacgccgaagaaggctggatggggcactgaatagagttccagttggattttatcagaaagtatggaaagttttgcagaagtgtcacggactttctgttgaagggtttgtccttccttcctctaccactagagagatgactccaggtgagattaaattctctgttcatgtggagtctgtcctgaatcgtgtacctcagccagagtaccgtcagctgctggttgaagccatccttgtcctcaccatgctggcagatattgaaattcatagcatcggaagcatcattgctgtggaaaaaatagtgcatattgccaatgacttgttccttcaagaacagaaaacccttggcgcagatgataccatgttggcaaaggatcccgcatctggcatctgtactcttctgtatgacagtgcacccagtggcaggtttggcaccatgacctacctctccaaggcagccgccacctacgtgcaggagttcctgccccacagcatctgtgccatgcaatgagggctttggttcctggcttctgggagccttttgacagctggtccctgcctcggttgattgtgcatggaactaaaatgttattgcctaatcactccaaccctgcccctttctgtcccatccttcccaagaagagagaactttttcgataaactaactactgtagaagaagtgaacacttacctggaggctcaccttgcagaaccagtgacaatcttatgagtataatgaacactcagccaggcctgtcatgattggctttatttctttcatcattcataaaagtttgcatgtgtttttattctctagatctgttaccaatatagttttctaactcctgtttggggagcaagtgttaataataacttattcctaaagcttggtttttcttttttgtgattttattgtgtatatgagtggtgggtactttgggacattatttcaaatgagtaaactctaaattgttaaatatttatgctgctataaattagaattacctattctacgtgccttttcttaggaaaagagagtactggatcatggttttcttccttacttacaggttgcttcacactgagtgataatttaaaattgtttctatgtagaatcattgtctctactgttgccctctctgtgtctgcacacataatgcctctctcactttggtgaaatatcaaaaaaatgcaagtacagcatgcatatttaagaatttctgaactaacacttgaaatcacattttataaagattgttggtactcagagttgtatttgcagcagaaaatgcagaataacccagaaatggagcccggagcccaattccagagaggaagggaaagaagagacgatgcctggacaatgtcttatacatagggaacagagagggaatcagaggtggcttagttccctgaagacagccttatgcgcttaatccctgcctttgaaaaatgggccaatacacaacacagacaataatttgaagcgtctgtattcagcaaagataaatacagcagtccagtctataggtgctctacttagcattcttttcatgtgctcctggtctctgtctcactcacctactttctactacatccaactcaactccctgacaccctatccccccatctattcttaaactctttcatatatattttcacttcctaattctagtgtacatatccctgtatatcatggtatctgtgggcatatgtctgtttcttataaagacacatatttgtgtgtgtatgtgtgtgtgtgtgtgtgtgtgtgtataagcatacatgggaatttttctgaatgtaagcagttttgatgtgtctgtatatcaatctgtatctacatttgatggactgagtaagaatgttgcatgtgagagaagggatgtgactgtggactcagattgacacacacagattggtggaagaatagcttcagtcctcttccttcatcccatatgtaggtagccttgcttgacaaatgtttcttctaactctccttcttctgaattgtgcagagactctgttaacttccctttttgcacttagataacttcctacttcaaccccctcctttatcttggatttctaaagtttttccccaatattgggaatggtgagggtggggatgagagactctctgaacaattcttgcagaaccagtgacaatcttatgaatataatgaataagtaagcatatagtagggtgatagaatacagatagtagaaacaaagagaggacagcaaaccttttcagcacttctctcagagcaaatggaaacacacagtaagtagctttctgactacattattttctggtcacttttaaagaaagtttacaacctgttctgaaactatttgtcttttcactggttgtaagtgtaccccaatctcagggagtatatctgtagtgccacaggcaaaagatccactccttcccacactcatttgcctgaacttactcgaagggctgcatttctctgagtttacgaaattgtgtcattatggtccccatacagtggtatttaacttttaaagcaacttttaagaaaactcgacttgttttttgttcattttaagtgtgtggtactaaaaagacatgttagactttttttaaaaaagcacttatgttttgaaaatagaataaataataagaatttccaattaaatcatgtctggtgccaatgtgcaaaacttca

SEQ ID NO: 15518 - DNA, 4476 bp, Homo sapiens
  ENST00000373539
gacctgttggcggcggccgggcgggaggctgtgggccgcggcggtctcccggggttgaggggaggatgcaggagtcacacgcggaggccggactggactaagggggcaggagcggcgcctggggcgctgcggcggggctctagaccgcgggaagccagtgctagcgctggcgcgtggtgggcccctgaggccgccggagtccggagaggtacgcggaatccgcggcgccaggcctgagcggtgggagggctctgcggggcctggtgttcaggcgtcccaccacgagggtggagcagcgttggatacttgttccttagggaccgaaggctccggtggcacccgggctatttctcagaggacaattagtaacgtgtcgccatgaggagccggagtaactccggggtccggctggacggctacgctcgactggtgcaacagaccatcctgtgccatcagaatccagtgactggcttgcttccagccagctatgatcagaaagatgcttgggtccgagataatgtgtacagcatcttggctgtgtggggtttgggcctggcctatcggaagaatgcagaccgggatgaggataaggcaaaggcctatgaattggagcagagtgtagtgaagctgatgagaggactactgcactgcatgatcagacaggtggataaagtagaatccttcaaatatagtcagagtactaaggatagcctccatgcaaagtacaacaccaaaacctgtgccactgtagtgggtgatgatcaatggggacacctgcagttggatgctacctctgtgtacctgctcttcttagcccaaatgactgcctcaggactccatatcatccacagcctagatgaagtcaatttcatacagaaccttgtgttttacattgaagctgcatataaaactgctgacttcgggatatgggaacgtggagacaagaccaaccaagggatctcagagttgaatgccagttcagttggaatggcaaaggcagccctggaagcattagatgaactggatctgtttggtgtgaaaggtgggcctcaatcagttatccatgtcctggctgatgaagtacagcactgccagtctatcctaaattcactactgccccgtgcttcaacatcaaaagaggttgatgctagtctactctcagtggtttccttccctgcctttgcagtagaggatagccagttggtggagctcacaaaacaggaaatcatcaccaagcttcagggtcgttatggttgctgtcgctttctacgagatggatataaaactcctaaagaggatcccaatcgtctgtactatgaaccagctgagctgaagctatttgaaaacattgagtgtgaatggccattgttctggacatactttattcttgatggggtcttcagtggcaatgcagaacaggttcaagaatataaagaggctcttgaagcagtcctcatcaagggcaaaaatggagtcccacttctgccagagctgtacagtgttcctcctgacagggtcgatgaagaatatcagaatcctcacactgtggaccgagtccccatggggaaattgcctcacatgtggggtcagtctctatacattttaggaagcttgatggcagagggatttttagcccctggagaaattgatcccctgaatcgcaggttttctactgtaccgaagcccgatgttgtggttcaagtctccattctagctgaaacagaagaaatcaagaccattttgaaggacaagggaatttacgtggagaccattgctgaggtataccccatcagagtacaaccagctcgtattctcagccacatttattccagcctaggatgcaacaatagaatgaaactcagtggacgaccctacagacacatgggagtgcttggaacttcaaaactctatgacattcggaaaactatctttactttcactccacagtttatagaccagcaacagttctacctggctctggacaacaagatgatagtggaaatgcttagaacagacctctcctacctctgtagccgctggcggatgacaggccagcccaccatcaccttccccatctcacacagcatgcttgatgaagatggaacaagcttgaattcaagtatcctggcagcactccgaaaaatgcaagatgggtattttggtggggcaagggttcaaacaggtaaattgtcagagtttttgacaacatcttgttgcacacacttgagcttcatggaccctggacctgagggtaagctgtacagtgaagattatgatgacaactatgattacctggaatctggcaactggatgaatgattatgattcaaccagtcatgctcgctgtggtgatgaagttgctcgttatttagatcaccttttggcgcacactgctccccatcctaaactagcccctacctcacagaagggagggctagatcggttccaagctgctgtgcaaacaacctgcgacttaatgtccttggtgaccaaggccaaggaactgcatgtacagaatgttcacatgtatcttcctacgaagttatttcaggcttcccggccttcattcaacttacttgattcacctcatccccgacaggagaaccaggttccctctgttcgtgtagaaatacatcttcctagagaccagtctggggaggtggactttaaagcactggttttacagttgaaggagacctcaagcttacaggaacaagctgatatcctctatatgctgtatactatgaaaggacctgactggaacactgaattgtataatgaacggagtgctacagtgagagagcttcttaccgagctgtatggcaaagtgggagaaattcgtcactggggcctgatccgatacatttctgggatcttaaggaagaaagtggaagcacttgatgaggcctgcacagaccttctctcccaccagaaacatttgacagtaggacttcctccagaacctcgagaaaagactatctctgcacctctgccctatgaggcgctcactcagctgatagatgaagccagtgaaggggatatgagcatttcaatccttacacaggaaataatggtatatctagccatgtatatgcgaacccagcctggcctctttgctgaaatgtttcgacttcgaattggtctgatcatacaagttatggcaacagaactggcccactcccttcgatgctcagctgaggaagccacagagggcctgatgaatctcagtccttcggccatgaagaatctcctgcatcacattctcagcggcaaggagtttggagtggaacgaagcgttcgtcccactgattcaaatgtcagtcctgctatttctatccacgagattggtgctgttggagcaaccaaaacagaacgaactgggatcatgcagttaaaaagtgagataaagcaggtggaatttcgtagactgtcaatctcagctgagagtcagtccaatggtggtcatcccctgggtatagatttgatgtcaccgtcttttatgtcacctggaacctctatgactccaagtagtgggtcctttcctagtgcatatgatcagcagtcatctaaagatagtcgtcaaggtcaatggcaacgccgaagaaggctggatggggcactgaatagagttccagttggattttatcagaaagtatggaaagttttgcagaagtgtcacggactttctgttgaagggtttgtccttccttcctctaccactagagagatgactccaggtgagattaaattctctgttcatgtggagtctgtcctgaatcgtgtacctcagccagagtaccgtcagctgctggttgaagccatccttgtcctcaccatgctggcagatattgaaattcatagcatcggaagcatcattgctgtggaaaaaatagtgcatattgccaatgacttgttccttcaagaacagaaaacccttggcgcagatgataccatgttggcaaaggatcccgcatctggcatctgtactcttctgtatgacagtgcacccagtggcaggtttggcaccatgacctacctctccaaggcagccgccacctacgtgcaggagttcctgccccacagcatctgtgccatgcaatgagggctttggttcctggcttctgggagccttttgacagctggtccctgcctcggttgattgtgcatggaactaaaatgttattgcctaatcactccaaccctgcccctttctgtcccatccttcccaagaagagagaactttttcgataaactaactactgtagaagaagtgaacacttacctggaggctcaccttgcagaaccagtgacaatcttatgagtataatgaacactcagccaggcctgtcatgattggctttatttctttcatcattcataaaagtttgcatgtgtttttattctctagatctgttaccaatatagttttctaactcctgtttggggagcaagtgttaataataacttattcctaaag

SEQ ID NO: 15519 - DNA, 6121 bp, Homo sapiens
  ENST00000339490
cacgcggaggccggactggactaagggggcaggagcggcgcctggggcgctgcggcggggctctagaccgcgggaagccagtgctagcgctggcgcgtggtgggcccctgaggccgccggagtccggagaggtacgcggaatccgcggcgccaggcctgagcggtgggagggctctgcggggcctggtgttcaggcgtcccaccacgagggtggagcagcgttggatacttgttccttagggaccgaaggctccggtggcacccgggctatttctcagaggacaattagtaacgtgtcgccatgaggagccggagtaactccggggtccggctggacggctacgctcgactggtgcaacagaccatcctgtgccatcagaatccagtgactggcttgcttccagccagctatgatcagaaagatgcttgggtccgagataatgtgtacagcatcttggctgtgtggggtttgggcctggcctatcggaagaatgcagaccgggatgaggataaggcaaaggcctatgaattggagcagagtgtagtgaagctgatgagaggactactgcactgcatgatcagacaggtggataaagtagaatccttcaaatatagtcagagtactaaggatagcctccatgcaaagtacaacaccaaaacctgtgccactgtagtgggtgatgatcaatggggacacctgcagttggatgctacctctgtgtacctgctcttcttagcccaaatgactgcctcaggactccatatcatccacagcctagatgaagtcaatttcatacagaaccttgtgttttacattgaagctgcatataaaactgctgacttcgggatatgggaacgtggagacaagaccaaccaagggatctcagagttgaatgccagttcagttggaatggcaaaggcagccctggaagcattagatgaactggatctgtttggtgtgaaaggtgggcctcaatcagttatccatgtcctggctgatgaagtacagcactgccagtctatcctaaattcactactgccccgtgcttcaacatcaaaagaggttgatgctagtctactctcagtggtttccttccctgcctttgcagtagaggatagccagttggtggagctcacaaaacaggaaatcatcaccaagcttcagggtcgttatggttgctgtcgctttctacgagatggatataaaactcctaaagaggatcccaatcgtctgtactatgaaccagctgagctgaagctatttgaaaacattgagtgtgaatggccattgttctggacatactttattcttgatggggtcttcagtggcaatgcagaacaggttcaagaatataaagaggctcttgaagcagtcctcatcaagggcaaaaatggagtcccacttctgccagagctgtacagtgttcctcctgacagggtcgatgaagaatatcagaatcctcacactgtggaccgagtccccatggggaaattgcctcacatgtggggtcagtctctatacattttaggaagcttgatggcagagggatttttagcccctggagaaattgatcccctgaatcgcaggttttctactgtaccgaagcccgatgttgtggttcaagtctccattctagctgaaacagaagaaatcaagaccattttgaaggacaagggaatttacgtggagaccattgctgaggtataccccatcagagtacaaccagctcgtattctcagccacatttattccagcctaggatgcaacaatagaatgaaactcagtggacgaccctacagacacatgggagtgcttggaacttcaaaactctatgacattcggaaaactatctttactttcactccacagtttatagaccagcaacagttctacctggctctggacaacaagatgatagtggaaatgcttagaacagacctctcctacctctgtagccgctggcggatgacaggccagcccaccatcaccttccccatctcacacagcatgcttgatgaagatggaacaagcttgaattcaagtatcctggcagcactccgaaaaatgcaagatgggtattttggtggggcaagggttcaaacaggtaaattgtcagagtttttgacaacatcttgttgcacacacttgagcttcatggaccctggacctgagggtaagctgtacagtgaagattatgatgacaactatgattacctggaatctggcaactggatgaatgattatgattcaaccagtcatgctcgctgtggtgatgaagttgctcgttatttagatcaccttttggcgcacactgctccccatcctaaactagcccctacctcacagaagggagggctagatcggttccaagctgctgtgcaaacaacctgcgacttaatgtccttggtgaccaaggccaaggaactgcatgtacagaatgttcacatgtatcttcctacgaagttatttcaggcttcccggccttcattcaacttacttgattcacctcatccccgacaggagaaccaggttccctctgttcgtgtagaaatacatcttcctagagaccagtctggggaggtggactttaaagcactggttttacagttgaaggagacctcaagcttacaggaacaagctgatatcctctatatgctgtatactatgaaaggacctgactggaacactgaattgtataatgaacggagtgctacagtgagagagcttcttaccgagctgtatggcaaagtgggagaaattcgtcactggggcctgatccgatacatttctgggatcttaaggaagaaagtggaagcacttgatgaggcctgcacagaccttctctcccaccagaaacatttgacagtaggacttcctccagaacctcgagaaaagactatctctgcacctctgccctatgaggcgctcactcagctgatagatgaagccagtgaaggggatatgagcatttcaatccttacacaggaaataatggtatatctagccatgtatatgcgaacccagcctggcctctttgctgaaatgtttcgacttcgaattggtctgatcatacaagttatggcaacagaactggcccactcccttcgatgctcagctgaggaagccacagagggcctgatgaatctcagtccttcggccatgaagaatctcctgcatcacattctcagcggcaaggagtttggagtggaacgaagcgttcgtcccactgattcaaatgtcagtcctgctatttctatccacgagattggtgctgttggagcaaccaaaacagaacgaactgggatcatgcagttaaaaagtgagataaagcagtcacctggaacctctatgactccaagtagtgggtcctttcctagtgcatatgatcagcagtcatctaaagatagtcgtcaaggtcaatggcaacgccgaagaaggctggatggggcactgaatagagttccagttggattttatcagaaagtatggaaagttttgcagaagtgtcacggactttctgttgaagggtttgtccttccttcctctaccactagagagatgactccaggtgagattaaattctctgttcatgtggagtctgtcctgaatcgtgtacctcagccagagtaccgtcagctgctggttgaagccatccttgtcctcaccatgctggcagatattgaaattcatagcatcggaagcatcattgctgtggaaaaaatagtgcatattgccaatgacttgttccttcaagaacagaaaacccttggcgcagatgataccatgttggcaaaggatcccgcatctggcatctgtactcttctgtatgacagtgcacccagtggcaggtttggcaccatgacctacctctccaaggcagccgccacctacgtgcaggagttcctgccccacagcatctgtgccatgcaatgagggctttggttcctggcttctgggagccttttgacagctggtccctgcctcggttgattgtgcatggaactaaaatgttattgcctaatcactccaaccctgcccctttctgtcccatccttcccaagaagagagaactttttcgataaactaactactgtagaagaagtgaacacttacctggaggctcaccttgcagaaccagtgacaatcttatgagtataatgaacactcagccaggcctgtcatgattggctttatttctttcatcattcataaaagtttgcatgtgtttttattctctagatctgttaccaatatagttttctaactcctgtttggggagcaagtgttaataataacttattcctaaagcttggtttttcttttttgtgattttattgtgtatatgagtggtgggtactttgggacattatttcaaatgagtaaactctaaattgttaaatatttatgctgctataaattagaattacctattctacgtgccttttcttaggaaaagagagtactggatcatggttttcttccttacttacaggttgcttcacactgagtgataatttaaaattgtttctatgtagaatcattgtctctactgttgccctctctgtgtctgcacacataatgcctctctcactttggtgaaatatcaaaaaaatgcaagtacagcatgcatatttaagaatttctgaactaacacttgaaatcacattttataaagattgttggtactcagagttgtatttgcagcagaaaatgcagaataacccagaaatggagcccggagcccaattccagagaggaagggaaagaagagacgatgcctggacaatgtcttatacatagggaacagagagggaatcagaggtggcttagttccctgaagacagccttatgcgcttaatccctgcctttgaaaaatgggccaatacacaacacagacaataatttgaagcgtctgtattcagcaaagataaatacagcagtccagtctataggtgctctacttagcattcttttcatgtgctcctggtctctgtctcactcacctactttctactacatccaactcaactccctgacaccctatccccccatctattcttaaactctttcatatatattttcacttcctaattctagtgtacatatccctgtatatcatggtatctgtgggcatatgtctgtttcttataaagacacatatttgtgtgtgtatgtgtgtgtgtgtgtgtgtgtgtgtataagcatacatgggaatttttctgaatgtaagcagttttgatgtgtctgtatatcaatctgtatctacatttgatggactgagtaagaatgttgcatgtgagagaagggatgtgactgtggactcagattgacacacacagattggtggaagaatagcttcagtcctcttccttcatcccatatgtaggtagccttgcttgacaaatgtttcttctaactctccttcttctgaattgtgcagagactctgttaacttccctttttgcacttagataacttcctacttcaaccccctcctttatcttggatttctaaagtttttccccaatattgggaatggtgagggtggggatgagagactctctgaacaattcttgcagaaccagtgacaatcttatgaatataatgaataagtaagcatatagtagggtgatagaatacagatagtagaaacaaagagaggacagcaaaccttttcagcacttctctcagagcaaatggaaacacacagtaagtagctttctgactacattattttctggtcacttttaaagaaagtttacaacctgttctgaaactatttgtcttttcactggttgtaagtgtaccccaatctcagggagtatatctgtagtgccacaggcaaaagatccactccttcccacactcatttgcctgaacttactcgaagggctgcatttctctgagtttacgaaattgtgtcattatggtccccatacagtggtatttaacttttaaagcaacttttaagaaaactcgacttgttttttgttcattttaagtgtgtggtactaaaaagacatgttagactttttttaaaaaagcacttatgttttgaaaatagaataaataataagaatttccaattaaatcatgtctggtgccaatgtgcaaaacttc

SEQ ID NO: 15520 - DNA, 5944 bp, Homo sapiens
  ENST00000541944
cacgcggaggccggactggactaagggggcaggagcggcgcctggggcgctgcggcggggctctagaccgcgggaagccagtgctagcgctggcgcgtggtgggcccctgaggccgccggagtccggagaggtacgcggaatccgcggcgccaggcctgagcggtgggagggctctgcggggcctggtgttcaggcgtcccaccacgagggtggagcagcgttggatacttgttccttagggaccgaaggctccggtggcacccgggctatttctcagaggacaattagtaacgtgtcgccatgaggagccggagtaactccggggtccggctggacggctacgctcgactggtgcaacagaccatcctgtgccatcagaatccagtgactggcttgcttccagccagctatgatcagaaagatgcttgggtccgagataatgtgtacagcatcttggctgtgtggggtttgggcctggcctatcggaagaatgcagaccgggatgaggataaggcaaaggcctatgaattggagcagagtgtagtgaagctgatgagaggactactgcactgcatgatcagacaggtggataaagtagaatccttcaaatatagtcagagtactaaggatagcctccatgcaaagtacaacaccaaaacctgtgccactgtagtgggtgatgatcaatggggacacctgcagttggatgctacctctgtgtacctgctcttcttagcccaaatgactgcctcaggactccatatcatccacagcctagatgaagtcaatttcatacagaaccttgtgttttacattgaagctgcatataaaactgctgacttcgggatatgggaacgtggagacaagaccaaccaagggatctcagagttgaatgccagttcagttggaatggcaaaggcagccctggaagcattagatgaactggatctgtttggtgtgaaaggtgggcctcaatcagttatccatgtcctggctgatgaagtacagcactgccagtctatcctaaattcactactgccccgtgcttcaacatcaaaagaggttgatgctagtctactctcagtggtttccttccctgcctttgcagtagaggatagccagttggtggagctcacaaaacaggaaatcatcaccaagcttcagggtcgttatggttgctgtcgctttctacgagatggatataaaactcctaaagaggatcccaatcgtctgtactatgaaccagctgagctgaagctatttgaaaacattgagtgtgaatggccattgttctggacatactttattcttgatggggtcttcagtggcaatgcagaacaggttcaagaatataaagaggctcttgaagcagtcctcatcaagggcaaaaatggagtcccacttctgccagagctgtacagtgttcctcctgacagggtcgatgaagaatatcagaatcctcacactgtggaccgagtccccatggggaaattgcctcacatgtggggtcagtctctatacattttaggaagcttgatggcagagggatttttagcccctggagaaattgatcccctgaatcgcaggttttctactgtaccgaagcccgatgttgtggttcaagtctccattctagctgaaacagaagaaatcaagaccattttgaaggacaagggaatttacgtggagaccattgctgaggtataccccatcagagtacaaccagctcgtattctcagccacatttattccagcctaggatgcaacaatagaatgaaactcagtggacgaccctacagacacatgggagtgcttggaacttcaaaactctatgacattcggaaaactatctttactttcactccacagtttatagaccagcaacagttctacctggctctggacaacaagatgatagtggaaatgcttagaacagacctctcctacctctgtagccgctggcggatgacaggccagcccaccatcaccttccccatctcacacagcatgcttgatgaagatggaacaagcttgaattcaagtatcctggcagcactccgaaaaatgcaagatgggtattttggtggggcaagggttcaaacaggtaaattgtcagagtttttgacaacatcttgttgcacacacttgagcttcatggaccctggacctgagggtaagctgtacagtgaagattatgatgacaactatgattacctggaatctggcaactggatgaatgattatgattcaaccagtcatgatgttcacatgtatcttcctacgaagttatttcaggcttcccggccttcattcaacttacttgattcacctcatccccgacaggagaaccaggttccctctgttcgtgtagaaatacatcttcctagagaccagtctggggaggtggactttaaagcactggttttacagttgaaggagacctcaagcttacaggaacaagctgatatcctctatatgctgtatactatgaaaggacctgactggaacactgaattgtataatgaacggagtgctacagtgagagagcttcttaccgagctgtatggcaaagtgggagaaattcgtcactggggcctgatccgatacatttctgggatcttaaggaagaaagtggaagcacttgatgaggcctgcacagaccttctctcccaccagaaacatttgacagtaggacttcctccagaacctcgagaaaagactatctctgcacctctgccctatgaggcgctcactcagctgatagatgaagccagtgaaggggatatgagcatttcaatccttacacaggaaataatggtatatctagccatgtatatgcgaacccagcctggcctctttgctgaaatgtttcgacttcgaattggtctgatcatacaagttatggcaacagaactggcccactcccttcgatgctcagctgaggaagccacagagggcctgatgaatctcagtccttcggccatgaagaatctcctgcatcacattctcagcggcaaggagtttggagtggaacgaagcgttcgtcccactgattcaaatgtcagtcctgctatttctatccacgagattggtgctgttggagcaaccaaaacagaacgaactgggatcatgcagttaaaaagtgagataaagcagtcacctggaacctctatgactccaagtagtgggtcctttcctagtgcatatgatcagcagtcatctaaagatagtcgtcaaggtcaatggcaacgccgaagaaggctggatggggcactgaatagagttccagttggattttatcagaaagtatggaaagttttgcagaagtgtcacggactttctgttgaagggtttgtccttccttcctctaccactagagagatgactccaggtgagattaaattctctgttcatgtggagtctgtcctgaatcgtgtacctcagccagagtaccgtcagctgctggttgaagccatccttgtcctcaccatgctggcagatattgaaattcatagcatcggaagcatcattgctgtggaaaaaatagtgcatattgccaatgacttgttccttcaagaacagaaaacccttggcgcagatgataccatgttggcaaaggatcccgcatctggcatctgtactcttctgtatgacagtgcacccagtggcaggtttggcaccatgacctacctctccaaggcagccgccacctacgtgcaggagttcctgccccacagcatctgtgccatgcaatgagggctttggttcctggcttctgggagccttttgacagctggtccctgcctcggttgattgtgcatggaactaaaatgttattgcctaatcactccaaccctgcccctttctgtcccatccttcccaagaagagagaactttttcgataaactaactactgtagaagaagtgaacacttacctggaggctcaccttgcagaaccagtgacaatcttatgagtataatgaacactcagccaggcctgtcatgattggctttatttctttcatcattcataaaagtttgcatgtgtttttattctctagatctgttaccaatatagttttctaactcctgtttggggagcaagtgttaataataacttattcctaaagcttggtttttcttttttgtgattttattgtgtatatgagtggtgggtactttgggacattatttcaaatgagtaaactctaaattgttaaatatttatgctgctataaattagaattacctattctacgtgccttttcttaggaaaagagagtactggatcatggttttcttccttacttacaggttgcttcacactgagtgataatttaaaattgtttctatgtagaatcattgtctctactgttgccctctctgtgtctgcacacataatgcctctctcactttggtgaaatatcaaaaaaatgcaagtacagcatgcatatttaagaatttctgaactaacacttgaaatcacattttataaagattgttggtactcagagttgtatttgcagcagaaaatgcagaataacccagaaatggagcccggagcccaattccagagaggaagggaaagaagagacgatgcctggacaatgtcttatacatagggaacagagagggaatcagaggtggcttagttccctgaagacagccttatgcgcttaatccctgcctttgaaaaatgggccaatacacaacacagacaataatttgaagcgtctgtattcagcaaagataaatacagcagtccagtctataggtgctctacttagcattcttttcatgtgctcctggtctctgtctcactcacctactttctactacatccaactcaactccctgacaccctatccccccatctattcttaaactctttcatatatattttcacttcctaattctagtgtacatatccctgtatatcatggtatctgtgggcatatgtctgtttcttataaagacacatatttgtgtgtgtatgtgtgtgtgtgtgtgtgtgtgtgtataagcatacatgggaatttttctgaatgtaagcagttttgatgtgtctgtatatcaatctgtatctacatttgatggactgagtaagaatgttgcatgtgagagaagggatgtgactgtggactcagattgacacacacagattggtggaagaatagcttcagtcctcttccttcatcccatatgtaggtagccttgcttgacaaatgtttcttctaactctccttcttctgaattgtgcagagactctgttaacttccctttttgcacttagataacttcctacttcaaccccctcctttatcttggatttctaaagtttttccccaatattgggaatggtgagggtggggatgagagactctctgaacaattcttgcagaaccagtgacaatcttatgaatataatgaataagtaagcatatagtagggtgatagaatacagatagtagaaacaaagagaggacagcaaaccttttcagcacttctctcagagcaaatggaaacacacagtaagtagctttctgactacattattttctggtcacttttaaagaaagtttacaacctgttctgaaactatttgtcttttcactggttgtaagtgtaccccaatctcagggagtatatctgtagtgccacaggcaaaagatccactccttcccacactcatttgcctgaacttactcgaagggctgcatttctctgagtttacgaaattgtgtcattatggtccccatacagtggtatttaacttttaaagcaacttttaagaaaactcgacttgttttttgttcattttaagtgtgtggtactaaaaagacatgttagactttttttaaaaaagcacttatgttttgaaaatagaataaataataagaatttccaattaaatcatgtctggtgccaatgtgcaaaacttc

SEQ ID NO: 15521 - DNA, 5559 bp, Homo sapiens
  ENST00000379942
cggagggcgggtccaaggcgcccaggtggccgcggcagaagggcctgtttctctggccttggctgtggttggcagccggccggggagagaagggactcagggaggcaacctggttcccgcccgttgctgatttcgcagcggctctcccgggccgcccccttttccttcctcctcaggccgcgacttggagggttccgctccgcggcgggggcagagccaggggcggggctgagcgcggcctgggcgatctccccggcggctggggtgggctggcgtcttcttcgcgcccgggggacctcctcgcgaccgccgggacgtaaaaggggcttggcaggggcgtcctcgccccactcccggaacctggtttcccgctgctcccgcgagcgtcgggagcccagcaggcctggccgaggcgggaccttcgtcgctccagcccccgtccccgcccccgcgcctccccgccgcgcggagctctggttggcttgctttccaaccggactttggggctagcgtttagaaaagtctcgacctcctccggcccggtcccatcccaagaaccgactaaggctgtgagtgtccgggaaccagacccgcttggaggccacagccccgacgtcccgcgcccacgcggcagatcgggcgctgcggcctgggagcctcggggagatgcggagcaggagcaattccggggtccgcttggacgggtacgcgcggctggtgcagcaaaccatcctgtgttaccagaatcccgtcacggggctgctgtcagccagccatgagcagaaggatgcctgggtgcgggataacatctacagtatcctggccgtgtggggcctgggcatggcctaccgtaagaatgcagaccgcgatgaggacaaggccaaggcctacgagctggagcagaacgtggtgaagctgatgcgaggtcttctccagtgcatgatgagacaggtggccaaagtggagaagttcaaacacactcagagcaccaaggacagcctgcacgccaagtacaacaccgccacctgtggcacggtggtgggcgacgaccagtggggccacctccaggtggatgccacctctctcttcctcctgttcctggcccagatgaccgcctcaggcttacgtatcattttcactctcgatgaggtggccttcatacagaatcttgtcttttacatagaagctgcatataaagtcgctgattatggaatgtgggagcgtggagataagactaatcagggcatcccggaattgaatgcaagctccgtaggaatggccaaggcagctcttgaggcaattgatgaactggacctttttggagcccatggaggacgcaagtcagtgattcatgttctgccagatgaggtcgagcactgccagtctattctgttctccatgctgccaagagcgtcgacatctaaagaaattgatgctggacttctttccattatttccttcccggcctttgcagtggaagatgtaaaccttgtaaatgtgaccaaaaatgaaattatttctaagctccaggggcgttatggatgctgtcgcttccttcgagatggttataaaactccaagagaggaccctaatcgactgcattatgaccctgctgaactcaagctcttcgaaaacattgaatgtgagtggcctgtgttttggacatattttataatagatggagtcttcagtggtgatgctgttcaggtccaagaataccgagaggccctggagggaatactcatcagaggcaagaatgggatccgcctggtgcctgaactctacgctgtcccgcctaacaaggtagatgaagagtacaagaatcctcacacagtagaccgagttcctatggggaaggtgcctcatctgtggggccaatccttgtacatcctcagctcgctgttggcagagggattccttgccgctggtgaaatcgatcccttaaatagaagattttccacttcagtcaaacctgatgttgtagtacaagttactgttttggcagaaaacaatcacattaaggacttattgaggaaacacggggtgaacgtccagagtatcgcggacattcatccaattcaagtccagccgggccggattcttagtcacatatatgccaagcttggacggaataagaatatgaatttgagtgggcgaccgtatcgacatattggtgtccttggaacctctaaactatatgtgattaggaaccaaatctttacttttacaccccagttcaccgaccagcatcacttctacctggccctcgacaatgagatgatcgtggagatgctaaggatcgagctggcctacctgtgcacctgctggaggatgacgggcagacccacactcaccttccccatcagtcgcaccatgctcacaaatgatggctcagacattcattctgctgtgctctccacaattagaaaactagaggatggatattttggaggagccagagtaaaattagggaacctttcggaatttctcaccacatcgttctacacatatctgacttttctggatccagactgtgatgagaagttgtttgacaatgccagcgaagggactttcagtcctgatagtgattcagatttggtaggatatctggaagacacctgtaatcaagaaagccaagacgaacttgaccattatatcaaccaccttctgcaaagcacatcgttgaggtcctatctgcctcctctttgtaagaacacagaagaccgccatgtcttcagtgctatccactccacgcgggacatactttctgtgatggcaaaagcaaagggtttggaagttccatttgttcccatgactttgccgactaaagttctaagtgcccaccgtaaatcactgaatcttgttgattctcctcagccactcctagaaaaggttcctgaaagtgactttcagtggcccagagatgaccatggtgacgtggactgtgagaagctggttgagcagctaaaagattgttcgaacctacaggaccaagcagacattctgtacattctttatgtcataaagggtcccagctgggacacaaatctctctggacagcacggggtcaccgttcaaaaccttcttggtgagctctatgggaaagccggcttgaaccaggagtggggtctgattcgctacatctcaggccttctcaggaagaaagtggaggtcctggctgaggcctgcacagacctgctttcgcaccagaagcagctcaccgtgggcctgccgcccgagccccgggagaagatcatctctgcgccccttcccccagaggagctcacaaaactcatctacgaggccagtgggcaggacatcagcattgccgtcctcacgcaggagattgtggtttacctggccatgtatgtcagggcgcagcccagcctctttgtggagatgctgagactccggattggactgatcattcaggtgatggccacggagctggcacggagcctgaactgctcaggagaagaggcttctgaaagtttgatgaacctcagccctttcgatatgaaaaatctcctgcaccatattctaagtgggaaagagtttggcgttgaaagaagtgtgcgccctatccactcctccacatccagccctaccatctccatccacgaggtgggccataccggagtcaccaaaactgagaggagtggcattaacagactgaggagtgaaatgaaacagatgactaggcggtttagtgctgatgaacagttcttttctgtgggccaggccgcgtccagcagtgcgcattcctccaagtctgcgaggtccagcaccccatcctcgcccactggcacgtcatcctcagactcgggaggacatcacatcggctggggtgagcggcagggccagtggctgcgcaggagaaggctggatggggccatcaacagggtccccgtgggattctaccagagggtgtggaagatcctccagaagtgccacggtctctccatcgatggttatgtcctcccatcctcgacgacccgagagatgaccccgcatgagatcaagtttgctgtccatgtcgaatcggtgctgaaccgcgtgccgcagcccgagtaccggcagctgctggtggaagccatcatggtgctgacgctgctctcggacacggagatgaccagcatcgggggcatcatccacgtggaccagatcgtgcagatggccagtcagctgttcttgcaggaccaggtgtcaattggtgccatggacaccctggagaaagaccaagccacaggaatctgccacttcttttatgacagcgctccgagtggggcttatgggacgatgacctacctaacaagagcagtggcttcttatttgcaggaattgttgcccaattcgggctgccagatgcaatagggtctcacctggaaacatgatcacactctcaatctgtcacgtgccccctagccttactgggaaccttctgtcccccaagatcccctgtgctatcaggaaagcatgtcccatcagaaacactctcggggggcaatggtagcactcaccctgaaactgatgtatgttaaagccacagagatagagctgaggagtcctgtgttcccccgcaaggagcaccccgggatcattttctaggttcatttctctggaacatttgctgtagcatctggtctcacggactctgaggaggaattggaaattggtctcttttgagtgcagagggaactgagacgccagcttaaattggctcttgcagagagttacagaaatagtttcgatgagctagtgacacatcctaaagatgcaaagatcctcctggcggcagtagccttgacaagggccacctcttcacaggatgcagtctgtctgtgcaccaaactcttcaccaaatagaacacttgtgtctctctgtggaatgggggttttcttgtgccttgcttgctttcatagccttccattttattggcatggctgccttgatgtaacataattctctgtccccaagatttagaaaattcctcttcgttcaccttggctcatggtcttccagggtttttatcctggctgtctatgaactagggttttctcctgccttaggaaaaatactgcatcttctggaatctagaaaaaaaaaaaaaaaaagacaaggctcctcttatagccaggcaagcagttgtttagggctagacctgttgtccccgctcgcgtggggtgaacgccccgcagtggatactgtcctcctgtgctctgggcgaggcgtcatagggtgagcacaagtcagcagtgccatggaagtgaacaggcatgtccccgcagaaacaatgcttccctctgaaaaatagagccaggctaggaacctgtaccctcttggtagaagcactttggtcttcactctcttgggtgggtgcagttggaggcaccgattggaggagagcaaggttgagtcaggtgtcagggtctggcaaatcttttgccaatgccctagcaatggagtttctctccgggcattgtcttaccttgggggaaggaaacaaaaccaatgggaaaacagtttctgtaaataataaaccttgaaagacaaatgct

SEQ ID NO: 15522 - DNA, 3115 bp, Homo sapiens
  ENST00000481718
caggagtagtgtccctgctgttcagcgatgtgactgagccccaccctcccagggtacctgccgtgttcagtcccaaggtgtacagaggtggagagcttccagtttagccccaggtcctgtgtgccctgaaggcacaatctccctcacaccctggggccccactcccctcagccagccggctgttgcgcttcccatctgcctggggccgttcacgtctccccagctgttgtccctgggaactgtggtgcctgtacctgagcacaggagcacctccctgagcgcctgttgtcaaggaggggggcagcattctctgtacccccccagtgtctcccttctgcatcagcccgagagagtttatgcagctccctgggctgcaccaggccctccctgtcttttcccttgaatggaaggacagtgtgcctcgcttaaaagctgtgcaaaccaagacatttttttccccccagaactattttttagttcatttcacagtgggagagaagagaaaaaataatcccagtgacagcatacaacagcccccttcccaaagccatggcaccacttgctcaaggttctttctgtaacaggggcccctgtgcttcatgggccccaaggtattcctcacggccaccgcagagggatgtgaggaggtcggagcaggccctgcccgagcagctggactcctgggacccaggcaggatcctgcaggggctcatggtgcttgctccacttcccgcctctcttaagggggtgggagtgtccactgctgttctgccctcagcccactggggacgctccaggccggggtgctgggatttagaaggtggccagttagactagaacaagctgttcctagaaaatttccccactcttcctggggcatcacatgcttccgctcggactcactggcgcaataccaagatatttctattatgaaaaagcattttgtgttgagctggcactcgatatttatatacatgggtgtgcatgtgcatgtctgtgcatgtgctggaggcttttgtgattggtgcttattatagaaatctcaaaaatagatgcctgcaaaggcacagaagcatcccttccccagcaggagccatgaaaatccccctttattatggcaccaaaggggcctcgcagccgcccgggcccagttgccaagtacaatgcggagcctcccgggaggactcggcagccccctagggcattgttcgggggagatctgaaagatgcctgctgggttccctagaattgttccatcgaaaacacagcctgtgggcagtgagaacaagctctctaaaaataactctgacagtctggcgtgtcccagccctcatatgggtttccagggcagagggtgctgtgtgtgcatgcacgcctgtgtgtgcatgcatgtgcttatcccattctggaatctgactgaaatgcgctctattctgcctccagtgccacggtctctccatcgatggttatgtcctcccatcctcgacgacccgagaggtacgatgagaaaaacgcagaggcgggcccctctgtgggttcacaataagggcttcattgcatggactctgacctcttgtgctccttttgggctcattctaattgacaggccatttgtagctctgagctgtctagccccttcaccctcatatttggcaaaaatgtctttccagcatttattggcatcagcctttttcttcacctgagactcagcatttctgggctagcaagctctttgcatttgccagacaccccttagaaccctggtgaaagaaaggagccaatctccatgccaccctggcctgccccatgggcagccttctcggcccttttctccaactaaaaacagtaatcgtccctaggtgatttgtcattctttttaacatggatttttttttagttttaccccacccaaagcaccatgcttcatgctggaaggaataatgaagaggaaagagaaaccagaaatggtccctgctccctggaagctgtagtcgatggggggaagggtagataaatcaggcgaggacaggctggctcctggaggcatactccagcctcctgctctgagggccactgccagcaggatccagggagtggccagaaaaggggcagcagtggcgctgagccccgagcccaggcactgctacggtcacccttggttactcggtgattgattgatagggctgcatctgtcctctcactggtggttgcctgcctgtccctttggtagatgaccccgcatgagatcaagtttgctgtccatgtcgaatcggtgctgaaccgcgtgccgcagcccgagtaccggcagctgctggtggaagccatcatggtgctgacgctgctctcggacacggagatgaccagcatcgggggcatcatccacgtggaccagatcgtgcagatggccagtcagctgttcttgcaggaccaggtgtcaattggtgccatggacaccctggagaaagaccaagccacaggaatctgccacttcttttatgacagcgctccgagtggggcttatgggacgatgacctacctaacaagagcagtggcttcttatttgcaggaattgttgcccaattcgggctgccagatgcaatagggtctcacctggaaacatgatcacactctcaatctgtcacgtgccccctagccttactgggaaccttctgtcccccaagatcccctgtgctatcaggaaagcatgtcccatcagaaacactctcggggggcaatggtagcactcaccctgaaactgatgtatgttaaagccacagagatagagctgaggagtcctgtgttcccccgcaaggagcaccccgggatcattttctaggttcatttctctggaacatttgctgtagcatctggtctcacggactctgaggaggaattggaaattggtctcttttgagtgcagagggaactgagacgccagcttaaattggctcttgcagagagttacagaaatagtttcgatgagctagtgacacatcctaaagatgcaaagatcctcctggcggcagtagccttgacaagggccacctcttcacaggatgcagtctgtctgtgcaccaaactcttcaccaaatagaacacttgtgtctctctgtgg

SEQ ID NO: 15523 - DNA, 1945 bp, Homo sapiens
  ENST00000469485
ttaagataaagcccagtgccaagaatagggaaagccggaaatgggattgcaaagggtgggtggatggaccctgatctgcgaggtcctcgccactaaacgcgggcttcactgtttgtcttcccccgtgtcatgtattgccttctctgtggttcctgtcctgtggaaacgtgtctgtcacttctctgtggcactgcagcaatgaagtgggcactatggagtttgtctccctgagccatggatgcctgctccgagggcccgttgtcaccctcaaagctctcccactgcagtggcacaggcgccacgtgcgggtgacagctgcccctcatgggcacttagcgcacactaggtatgcctcaggggcttctgtgtctccacgtggtgaaggcttccgggcagctctttataggatgcctgactgtgtccccactgtgcagatgagactgaggcccagaatcagtgttcatggcagggccagacggcctcgggtgtgtccttggcaccgctggcattgagtggggattagcactccggcagtctgacccccaagcccgtgctcgccctgttcggcctcctccttatgggttctagctttgggggtgggactgcctctcggggggcagggcagagtgcaacatggaatgaagtgatcaacccaaagtatgcgagtcatctcacatgaggaaacagacaaggtggactggaggaaccgtgttcctctctggcgagtggtgttctggcatttgtgcctaggtcgcagggccgcccttcgagatggcgcactttccctggggcacctgctgcgtggcttctgaggccccaagctgtctgtcttgcagaggtccagcaccccatcctcgcccactggcacgtcatcctcagactcgggaggacatcacatcggctggggtgagcggcagggccagtggctgcgcaggagaaggctggatggggccatcaacagggtccccgtgggattctaccagagggtgtggaagatcctccagaagtgccacggtctctccatcgatggttatgtcctcccatcctcgacgacccgagagatgaccccgcatgagatcaagtttgctgtccatgtcgaatcggtgctgaaccgcgtgccgcagcccgagtaccggcagctgctggtggaagccatcatggtgctgacgctgctctcggacacggagatgaccagcatcgggggcatcatccacgtggaccagatcgtgcagatggccagtcagctgttcttgcaggaccaggtgtcaattggtgccatggacaccctggagaaagaccaagccacaggaatctgccacttcttttatgacagcgctccgagtggggcttatgggacgatgacctacctaacaagagcagtggcttcttatttgcaggaattgttgcccaattcgggctgccagatgcaatagggtctcacctggaaacatgatcacactctcaatctgtcacgtgccccctagccttactgggaaccttctgtcccccaagatcccctgtgctatcaggaaagcatgtcccatcagaaacactctcggggggcaatggtagcactcaccctgaaactgatgtatgttaaagccacagagatagagctgaggagtcctgtgttcccccgcaaggagcaccccgggatcattttctaggttcatttctctggaacatttgctgtagcatctggtctcacggactctgaggaggaattggaaattggtctcttttgagtgcagagggaactgagacgccagcttaaattggctcttgcagagagttacagaaatagtttcgatgagctagtgacacatcctaaagatgcaaagatcctcctggcggcagtagccttgacaagggccacctcttcacaggatgcagtctgtctgtgcaccaaactcttcaccaaatagaacacttgtgtctctctgtg

SEQ ID NO: 15524 - DNA, 514 bp, Homo sapiens
  ENST00000473597
tgcttatcccattctggaatctgactgaaatgcgctctattctgcctccagtgccacggtctctccatcgatggttatgtcctcccatcctcgacgacccgagagatgaccccgcatgagatcaagtttgctgtccatgtcgaatcggtgctgaaccgcgtgccgcagcccgagtaccggcagctgctggtggaagccatcatggtgctgacgctgctctcggacacggagatgaccagcatcgggggcatcatccacgtggaccagatcgtgcagatggccagtcagctgttcttgcaggaccaggtgtcaattggtgccatggacaccctggagaaagaccaagccacaggaatctgccacttcttttatgacagcgctccgagtggggcttatgggacgatgacctacctaacaagagcagtggcttcttatttgcaggaattgttgcccaattcgggctgccagatgcaatagggtctcacctggaaacatgatcacactctcaatctgt

SEQ ID NO: 15525 - DNA, 751 bp, Homo sapiens
  ENST00000473739
tgcgccctatccactcctccacatccagccctaccatctccatccacgaggtgggccataccggagtcaccaaaactgagaggagtggcattaacagactgaggagtgaaatgaaacagatgactaggcggtttagtgctgatgaacagttcttttctgtgggccaggccgcgtccagcagtgcgcattcctccaagtctgcgaggtccagcaccccatcctcgcccactggcacgtcatcctcagactcgggaggacatcacatcggctggggtgagcggcagggccagtggctgcgcaggagaaggctggatggggccatcaacagggtccccgtgggattctaccagagggtgtggaagatcctccagaagtgccacggtctctccatcgatggttatgtcctcccatcctcgacgacccgagagatgaccccgcatgagatcaagtttgctgtccatgtcgaatcggtgctgaaccgcgtgccgcagcccgagtaccggcagctgctggtggaagccatcatggtgctgacgctgctctcggacacggagatgaccagcatcgggggcatcatccacgtggaccagatcgtgcagatggccagtcagctgttcttgcaggaccaggtgggggtgccagggagctgggttggctggcatttatctctgttgaggctggagattctgtgtccaataggaaagaatatactcgaaccaagaaaatgtcatcacagatgatggggaaaaaa

SEQ ID NO: 15526 - DNA, 728 bp, Homo sapiens
  ENST00000469645
agaggagctcacaaaactcatctacgaggccagtgggcaggacatcagcattgccgtcctcacgcaggagattgtggtttacctggccatgtatgtcagggcgcagcccagcctctttgtggagatgctgagactccggattggactgatcattcaggtgatggccacggagctggcacggagcctgaactgctcaggagaagaggcttctgaaagtttgatgaacctcagccctttcgatatgaaaaatctcctgcaccatattctaagtgggaaagagtttggcgttgaaagaagtgatacgaggtctcaccatgctgcccaggctggtcttgaactcctgggctcaagcagtcttcccacctcggcctcccaaagtgctgggattacagtgcgccctatccactcctccacatccagccctaccatctccatccacgaggtgggccataccggagtcaccaaaactgagaggagtggcattaacagactgaggagtgaaatgaaacagaggtccagcaccccatcctcgcccactggcacgtcatcctcagactcgggaggacatcacatcggctggggtgagcggcagggccagtggctgcgcaggagaaggctggatggggccatcaacagggtccccgtgggattctaccagagggtgtggaagatcctccagaagtgccacggtctctccatcgatggttatgtcctcccatcctcgacga

SEQ ID NO: 15527 - DNA, 317 bp, Homo sapiens
  ENST00000486231
atgaaaaatctcctgcaccatattctaagtgggaaagagtttggcgttgaaagaagtgatacgaggtctcaccatgctgcccaggctggtcttgaactcctgggctcaagcagtcttcccacctcggcctcccaaagtgctgggattacaggtgtgagccaccgtgcctggcctcggtgcgccctatccactcctccacatccagccctaccatctccatccacgaggtgggccataccggagtcaccaaaactgagaggagtggcattaacagactgaggagtgaaatgaaacagatgactaggcggtttagtgct

SEQ ID NO: 15528 - DNA, 500 bp, Homo sapiens
  ENST00000464455
attcttagtcacatatatgccaagcttggacggaataagaatatgaatttgagtgggcgaccgtatcgacatattggtgtccttggaacctctaaactatatgtgattaggaaccaaatctttacttttacaccccagttcaccgaccagcatcacttctacctggccctcgacaatgagatgatcgtggagatgctaaggatcgagctggcctacctgtgcacctgctggaggatgacgggcagacccacactcaccttccccatcagtcgcaccatgctcagtaactccagggatttcagcaggctccctcctgccccaggggtggtttgggctcttacaaatgtttaaaatggctcccatggccagaactaagcactgaaggggcttcttagcagtttggtttcttatctcgggaatcttctatgccagaaatattttaattagatggtgttgatgaaaatgtttcagtgcataacggaaaaaaagtctgcccagac

SEQ ID NO: 15529 - DNA, 1431 bp, Homo sapiens
  ENST00000297373
acgttagcctccggtcatcaaatagcaaaacccaaaacaacagcagatgatatcttccaagtgtctgctcgggacacggcttcagccctctgtggtcccctctccccggggggctttgggattcttgtcaagctccttcaagagcctgcaagcacttaaccagccacccagagttccctcactgaagatctgagcatgacccgggacgaggcactgccggactctcattctgcacaggacttctatgagaattatgagcccaaagagatcctgggcaggggcgttagcagtgtggtcaggcgatgcatccacaagcccacgagccaggagtacgccgtgaaggtcatcgacgtcaccggtggaggcagcttcagcccggaggaggtgcgggagctgcgagaagccacgctgaaggaggtggacatcctgcgcaaggtctcagggcaccccaacatcatacagctgaaggacacttatgagaccaacactttcttcttcttggtgtttgacctgatgaagagaggggagctctttgactacctcactgagaaggtcaccttgagtgagaaggaaaccagaaagatcatgcgagctctgctggaggtgatctgcaccttgcacaaactcaacatcgtgcaccgggacctgaagcccgagaacattctcttggatgacaacatgaacatcaagctcacagactttggcttttcctgccagctggagccgggagagaggctgcgagaggtctgcgggacccccagttacctggcccctgagattatcgagtgctccatgaatgaggaccacccgggctacgggaaagaggtggacatgtggagcactggcgtcatcatgtacacgctgctggccggctccccgcccttctggcaccggaagcagatgctgatgctgaggatgatcatgagcggcaactaccagtttggctcgcccgagtgggatgattactcggacaccgtgaaggacctggtctcccgattcctggtggtgcaaccccagaaccgctacacagcggaagaggccttggcacaccccttcttccagcagtacttggtggaggaagtgcggcacttcagcccccgggggaagttcaaggtgatcgctctgaccgtgctggcttcagtgcggatctactaccagtaccgccgggtgaagcctgtgacccgggagatcgtcatccgagacccctatgccctccggcctctgcgccggctcatcgacgcctacgctttccgaatctatggccactgggtgaagaaggggcagcagcagaaccgggcagcccttttcgagaacacacccaaggccgtgctcctctccctggccgaggaggactactgaggggctggccagtcagggagggctagggggcaggtggggaggggaagccatggaaatacaagtcaaaggggt

SEQ ID NO: 15530 - DNA, 483 bp, Homo sapiens
  ENST00000446428
ctgctcgggacacggcttcagccctctgtggtcccctctccccggggggctttgggattcttgtcaagctccttcaagagcctgcaagcacttaaccagccacccagagttccctcactgaagatctgagcatgacccgggacgaggcactgccggactctcattctgcacaggacttctatgagaattatgagcccaaagagatcctgggcaggatgaagagaggggagctctttgactacctcactgagaaggtcaccttgagtgagaaggaaaccagaaagatcatgcgagctctgctggaggtgatctgcaccttgcacaaactcaacatcgtgcaccgggacctgaagcccgagaacattctcttggatgacaacatgaacatcaagctcacagactttggcttttcctgccagctggagccgggagagaggctgcgaggtctcccgattcctggtggtgcaaccccagaaccgctac

SEQ ID NO: 15531 - DNA, 582 bp, Homo sapiens
  ENST00000432123
tatcttccaagtgtctgctcgggacacggcttcagccctctgtggtcccctctccccggggggctttgggattcttgtcaagctccttcaagagcctgcaagcacttaaccagccacccagagttccctcactgaagatctgagcatgacccgggacgaggcactgccggactctcattctgcacaggacttctatgagaattatgagcccaaagagatcctgggcaggatgaagagaggggagctctttgactacctcactgagaaggtcaccttgagtgagaaggaaaccagaaagatcatgcgagctctgctggaggtgatctgcaccttgcacaaactcaacatcgtgcaccgggacctgaagcccgagaacattctcttggatgacaacatgaacatcaagctcacagactttggcttttcctgccagctggagccgggagagaggctgcgagaggtctgcgggacccccagttacctggcccctgagattatcgagtgctccatgaatgaggaccacccgggctacgggaaagaggtggacatgtggagcactggcgtcatcatgtacacgctgct

SEQ ID NO: 15532 - DNA, 453 bp, Homo sapiens
  ENST00000471665
gaggcagcttcagcccggaggaggtgcgggagctgcgagaagccacgctgaaggaggtggacatcctgcgcaaggtctcagggcaccccaacatcagatgaagagaggggagctctttgactacctcactgagaaggtcaccttgagtgagaaggaaaccagaaagatcatgcgagctctgctggaggtgatctgcaccttgcacaaactcaacatcgtgcaccgggacctgaagcccgagaacattctcttggatgacaacatgaacatcaagctcacagactttggcttttcctgccagctggagccgggagagaggctgcgaggtctggtaacatggccttggcccacgtccaggcctcgggtgctcaatcaaccatctgcagaatagagatggtctgggtttctcccctaacttaattgttccctggaataaaaattccaccatttcaa

SEQ ID NO: 15533 - DNA, 580 bp, Homo sapiens
  ENST00000395428
agatgatatcttccaagtgtctgctcgggacacggcttcagccctctgtggtcccctctccccggggggctttgggattcttgtcaagctccttcaagagcctgcaagcacttaaccagccacccagagttccctcactgaagatctgagcatgacccgggacgaggcactgccggactctcattctgcacaggacttctatgagaattatgagcccaaagagatcctgggcaggggcgttagcagtgtggtcaggcgatgcatccacaagcccacgagccaggagtacgccgtgaaggtcatcgacgtcaccggtggaggcagcttcagcccggaggaggtgcgggagctgcgagaagccacgctgaaggaggtggacatcctgcgcaaggtctcagggcaccccaacatcagatgaagagaggggagctctttgactacctcactgagaaggtcaccttgagtgagaaggaaaccagaaagatcatgcgagctctgctggaggtgatctgcaccttgcacaaactcaacatcgtgcaccgggacctgaagcccgagaacattctcttggatgacaaca

SEQ ID NO: 15534 - DNA, 551 bp, Homo sapiens
  ENST00000489604
gatgatatcttccaagtgtctgctcgggacacggcttcagccctctgtggtcccctctccccggggggctttgggattcttgtcaagctccttcaagagcctgcaagcacttaaccagccacccagagttccctcactgaagatctgagcatgacccgggacgaggcactgccggactctcattctgcacaggacttctatgagaattatgagcccaaagagatcctgggcaggggcgttagcagtgtggtcaggcgatgcatccacaagcccacgagccaggagtacgccgtgaaggtcatcgacgtcaccggtggaggcagcttcagcccggaggaggtgcgggagctgcgagaagccacgctgaaggaggtggacatcctgcgcaaggtctcagggcaccccaacatcatacagctgaaggacacttatgagaccaacactttcttcttcttggtgtttgacctatgggaagacactgatacaatggagatggaacagaaatggtgcttgggctgggactctcccaagtccaccaacttcagggccca

SEQ ID NO: 15535 - DNA, 588 bp, Homo sapiens
  ENST00000467726
aaatagcaaaacccaaaacaacagcagatgatatcttccaagtgtctgctcgggacacggcttcagccctctgtggtcccctctccccggggggctttgggattcttgtcaagctccttcaagagcctgcaagcacttaaccagccacccagagttccctcactgaagatctgagcatgacccgggacgaggcactgccggactctcattctgcacaggacttctatgagaattatgagcccaaagagatcctgggcaggggcgttagcagtgtggtcaggcgatgcatccacaagcccacgagccaggagtacgccgtgaaggtcatcgacgtcaccggtggaggcagcttcagcccggaggaggtgcgggagctgcgagaagccacgctgaaggaggtggacatcctgcgcaaggtctcagggcaccccaacatcatacagctgaaggacacttatgagaccaacactttcttcttcttggtgtttgacctgtaagtacccagcactggagcaagccacacctgagagaacctccgactgctgtcccctccccaaccccagggctgcctggagaccacagccagct

SEQ ID NO: 15536 - DNA, 583 bp, Homo sapiens
  ENST00000492124
acgttagcctccggtcatcaaatagcaaaacccaaaacaacagcagatgatatcttccaagtgtctgctcgggacacggcttcagccctctgtggtcccctctccccggggggctttgggattcttgtcaagctccttcaagagcctgcaagcacttaaccagccacccagagttccctcactgaagatctgagcatgacccgggacgaggcactgccggactctcattctgcacaggacttctatgagaattatgagcccaaagagatcctgggcaggtaaagcccaagctttccccacgaagtgctgtcctaggctccagcagaccctgtgggctacagccagctctgctccaccccgagtactaacgccactttcatccccaaagtgctgttcacttggagaaaccctttgtttggggtcctgccctcctgaagccaggacagataagagaaacctctcccagcaaaaagttcccaggggcaggcgcaatggctcacacctgtaatcccagcactttgggaggctgaggtgggaggattgcttgaggccaagagttcaagatcagcctgggcaacatagc

SEQ ID NO: 15537 - DNA, 2226 bp, Homo sapiens
  ENST00000452681
acgttagcctccggtcatcaaatagcaaaacccaaaacaacagcagatgatatcttccaagtgtctgctcgggacacggcttcagccctctgtggtcccctctccccggggggctttgggattcttgtcaagctccttcaagagcctgcaagcacttaaccagccacccagagttccctcactgaagatctgagcatgacccgggacgaggcactgccggactctcattctgcacaggacttctatgagaattatgagcccaaagagatcctgggcaggggcgttagcagtgtggtcaggcgatgcatccacaagcccacgagccaggagtacgccgtgaaggtcatcgacgtcaccggtggaggcagcttcagcccggaggaggtgcgggagctgcgagaagccacgctgaaggaggtggacatcctgcgcaaggtctcagggcaccccaacatcatacagctgaaggacacttatgagaccaacactttcttcttcttggtgtttgacctatgggaagacactgatacaatggagatggaacagaaatggtgcttgggctgggactctcccaagtccaccaacttcagggcccagggcagggcaaggatgaagagaggggagctctttgactacctcactgagaaggtcaccttgagtgagaaggaaaccagaaagatcatgcgagctctgctggaggtgatctgcaccttgcacaaactcaacatcgtgcaccgggacctgaagcccgagaacattctcttggatgacaacatgaacatcaagctcacagactttggcttttcctgccagctggagccgggagagaggctgcgagaggtctgcgggacccccagttacctggcccctgagattatcgagtgctccatgaatgaggaccacccgggctacgggaaagaggtggacatgtggagcactggcgtcatcatgtacacgctgctggccggctccccgcccttctggcaccggaagcagatgctgatgctgaggatgatcatgagcggcaactaccagtttggctcgcccgagtgggatgattactcggacaccgtgaaggacctggtctcccgattcctggtggtgcaaccccagaaccgctacacagcggaagaggccttggcacaccccttcttccagcagtacttggtggaggaagtgcggcacttcagcccccgggggaagttcaaggtgatcgctctgaccgtgctggcttcagtgcggatctactaccagtaccgccgggtgaagcctgtgacccgggagatcgtcatccgagacccctatgccctccggcctctgcgccggctcatcgacgcctacgctttccgaatctatggccactgggtgaagaaggggcagcagcagaaccgggcagcccttttcgagaacacacccaaggccgtgctcctctccctggccgaggaggactactgaggggctggccagtcagggagggctagggggcaggtggggaggggaagccatggaaatacaagtcaaaggggtgagatgcgtgcaggcctctgcagaaggagcacttggccctggccaggaacccctggaactgaggccacgatcccctctcaaaggctgtgcacaagggaagtgggtgttcccaccacacagcaatacctgcaggctggggcaggccctgggtgggcagagatcacacgtggcctgagaaccaggaaccccctgctcctctacttcctagatgagccaccatctccatttctctttaggggaggcccagagttactgacactcaggctttcttcccttagggtcacagggtgaggatcaaagacacaaatgtctgagatacacaattgcaggagattttattggccccatgacatccagtgacagtgtgggagcaggctactctccagggacatgtttttggaggcatatggagaagggggcccaggcgaggtggctcacacctgtaatcccagcactttgggaggtcgaggtgggaggatcgcttgaggccaggagttcgagaccaccctgggcaacagagcgagatcccatcactacaaaaattcaaaaaattagccaggcatggtggtgcacacttgtagtcccagctactcaggaggctgaggtgggagaattgcttgggcccaggaattcaaggctagagtgagccgtgatcaccagtgcactctagcctgggcaacagagaaagaccctgtctca

SEQ ID NO: 15538 - DNA, 2139 bp, Homo sapiens
  ENST00000537360
acgttagcctccggtcatcaaatagcaaaacccaaaacaacagcagatgatatcttccaagtgtctgctcgggacacggcttcagccctctgtggtcccctctccccggggggctttgggattcttgtcaagctccttcaagagcctgcaagcacttaaccagccacccagagttccctcactgaagatctgagcatgacccgggacgaggcactgccggactctcattctgcacaggacttctatgagaattatgagcccaaagagatcctgggcaggggcgttagcagtgtggtcaggcgatgcatccacaagcccacgagccaggagtacgccgtgaaggtcatcgacgtcaccggtggaggcagcttcagcccggaggaggtgcgggagctgcgagaagccacgctgaaggaggtggacatcctgcgcaaggtctcagggcaccccaacatcatacagctgaaggacacttatgagaccaacactttcttcttcttggtgtttgaccttttccacaggatgaagagaggggagctctttgactacctcactgagaaggtcaccttgagtgagaaggaaaccagaaagatcatgcgagctctgctggaggtgatctgcaccttgcacaaactcaacatcgtgcaccgggacctgaagcccgagaacattctcttggatgacaacatgaacatcaagctcacagactttggcttttcctgccagctggagccgggagagaggctgcgagaggtctgcgggacccccagttacctggcccctgagattatcgagtgctccatgaatgaggaccacccgggctacgggaaagaggtggacatgtggagcactggcgtcatcatgtacacgctgctggccggctccccgcccttctggcaccggaagcagatgctgatgctgaggatgatcatgagcggcaactaccagtttggctcgcccgagtgggatgattactcggacaccgtgaaggacctggtctcccgattcctggtggtgcaaccccagaaccgctacacagcggaagaggccttggcacaccccttcttccagcagtacttggtggaggaagtgcggcacttcagcccccgggggaagttcaaggtgatcgctctgaccgtgctggcttcagtgcggatctactaccagtaccgccgggtgaagcctgtgacccgggagatcgtcatccgagacccctatgccctccggcctctgcgccggctcatcgacgcctacgctttccgaatctatggccactgggtgaagaaggggcagcagcagaaccgggcagcccttttcgagaacacacccaaggccgtgctcctctccctggccgaggaggactactgaggggctggccagtcagggagggctagggggcaggtggggaggggaagccatggaaatacaagtcaaaggggtgagatgcgtgcaggcctctgcagaaggagcacttggccctggccaggaacccctggaactgaggccacgatcccctctcaaaggctgtgcacaagggaagtgggtgttcccaccacacagcaatacctgcaggctggggcaggccctgggtgggcagagatcacacgtggcctgagaaccaggaaccccctgctcctctacttcctagatgagccaccatctccatttctctttaggggaggcccagagttactgacactcaggctttcttcccttagggtcacagggtgaggatcaaagacacaaatgtctgagatacacaattgcaggagattttattggccccatgacatccagtgacagtgtgggagcaggctactctccagggacatgtttttggaggcatatggagaagggggcccaggcgaggtggctcacacctgtaatcccagcactttgggaggtcgaggtgggaggatcgcttgaggccaggagttcgagaccaccctgggcaacagagcgagatcccatcactacaaaaattcaaaaaattagccaggcatggtggtgcacacttgtagtcccagctactcaggaggctgaggtgggagaattgcttgggcccaggaattcaaggctagagtgagccgtgatcaccagtgcactctagcctgggcaacagagaaagaccctgtctca

SEQ ID NO: 15539 - DNA, 928 bp, Homo sapiens
  ENST00000546310
ggagcgcgttttcgctgagacccactaccccgacatttacacgcgtgaggagctggcgctcaagatcgacctcactgaggctcgcggcgcactgtgggccggtgtggcgggcggtgggggcggcgggcctggcgcgggagcggccgaactacttaaggcttggcagccggcggagtccggccccgggcccttctccggggttctgtcctcctttcaccggaagcccggccccgccctgaagaccaatctcttctagctgccggcctctggaggctccgagcctgcccccagagacgtccctgcccctccaggacctgacagcccctcccatcctggccacccgcctggaagtccccatccgtctccactccctactgtctcacccctcggtgtgtcctccccaactttggagaccaagtcagggccactctcgtcctcacccaccctctaccagcagagcggagttctttataccgggacctcctccaggagaaccccggagctccttctagcttggccttctttggatgcggtatcacatgaggcctgtccctaacagtgccctcaaagtgaaggtcctcaaggaggatcggcacagcccccttccctggctctgcagcggctgggtcaccccttacgctggtgatcaggaaagcccgctgccccacccctcgggcccacccgtacagaggctggtggtcgccgggataattaatgaccaccgccaattcatccctcacgtgtctcctctcttccctagcccgtctggcacagagggtggacctgttagaggagtggaggggctgcctggggaatgggacagagggattctctttccctaatttttttggttgtcctttttctttgaaaaacttgtaatttattgaagttttactcaatccaaataaaacttaatttattgaagaca

SEQ ID NO: 15540 - DNA, 1699 bp, Homo sapiens
  ENST00000298231
acttgcgttgcacccgggctgagtgcggccgcgacggggcgggcggactctcgggcgctcagagctggcctcgggtcctcggagcctggcgctcgaacctcccttccgacctccacccggaccccgaccccgacccggcctggcccggcccccgcccccgccccccgggccgatggactactcctacctcaattcgtacgactcgtgcgtggcggccatggaggcgtccgcctacggcgactttggcgcctgcagccagcccggcggcttccaatacagccccctgcggcccgctttccccgcggcagggccgccctgccccgcgctcggctcctccaactgcgcacttggcgccctacgcgaccaccagcccgcgccctactcggcagtgccctacaagttcttcccagagccatccggcctgcacgagaagcgcaagcagcggcgcatccgcaccacgttcaccagcgcgcagctcaaggagctggagcgcgttttcgctgagacccactaccccgacatttacacgcgtgaggagctggcgctcaagatcgacctcactgaggctcgcgtgcaggtctggttccagaaccgccgggccaagttccgcaaacaggagcgcgcggccagcgccaagggcgcggcgggcgcggcgggcgccaaaaagggcgaggcgcgctgctcctccgaggacgacgattccaaggagtccacgtgcagccccacgcccgatagcaccgcctcgctgccgccgccgcctgcgcccggcctggccagcccgcgcctgagccccagcccgctgcccgtcgcactgggctccgggccgggacctgggccggggccacagccgctcaagggcgcactgtgggccggtgtggcgggcggtgggggcggcgggcctggcgcgggagcggccgaactacttaaggcttggcagccggcggagtccggccccgggcccttctccggggttctgtcctcctttcaccggaagcccggccccgccctgaagaccaatctcttctagctgccggcctctggaggctccgagcctgcccccagagacgtccctgcccctccaggacctgacagcccctcccatcctggccacccgcctggaagtccccatccgtctccactccctactgtctcacccctcggtgtgtcctccccaactttggagaccaagtcagggccactctcgtcctcacccaccctctaccagcagagcggagttctttataccgggacctcctccaggagaaccccggagctccttctagcttggccttctttggatgcggtatcacatgaggcctgtccctaacagtgccctcaaagtgaaggtcctcaaggaggatcggcacagcccccttccctggctctgcagcggctgggtcaccccttacgctggtgatcaggaaagcccgctgccccacccctcgggcccacccgtacagaggctggtggtcgccgggataattaatgaccaccgccaattcatccctcacgtgtctcctctcttccctagcccgtctggcacagagggtggacctgttagaggagtggaggggctgcctggggaatgggacagagggattctctttccctaatttttttggttgtcctttttctttgaaaaacttgtaatttattgaagttttactcaatccaaataaaacttaatttattgaagaca

SEQ ID NO: 15541 - DNA, 605 bp, Homo sapiens
  ENST00000544057
tcggtggaagaggctgggggttgagtggacgagctgcccaacccagctcaggagcgacggaaaagttatctgttcccttctcttgtgccctacaagttcttcccagagccatccggcctgcacgagaagcgcaagcagcggcgcatccgcaccacgttcaccagcgcgcagctcaaggagctggagcgcgttttcgctgagacccactaccccgacatttacacgcgtgaggagctggcgctcaagatcgacctcactgaggctcgcgtgcaggtctggttccagaaccgccgggccaagttccgcaaacaggagcgcgcggccagcgccaagggcgcggcgggcgcggcgggcgccaaaaagggcgaggcgcgctgctcctccgaggacgacgattccaaggagtccacgtgcagccccacgcccgatagcaccgcctcgctgccgccgccgcctgcgcccggcctggccagcccgcgcctgagccccagcccgctgcccgtcgcactgggctccgggccgggacctgggccggggccacagccgctcaagggcgcactgtgggccggtgtggcgggcggtgggggcggcgggcctggcgcggg

SEQ ID NO: 15542 - DNA, 3099 bp, Homo sapiens
  ENST00000321613
ttctttctcccttctctgcctctctctcctccacgctgctttgatttcgctcttgcctctcttcttgcgctgctcagctgggaacatcgtctcaccaggggcagcagcgacgcgctgcacagccagacaggagctggctgcggggcatggaagcagcctccttggcagccgggagaggagcaagcgcacgccactgcccgtgacccaggcgtccggctgctgtcccctgccggggagctcatccacgcagaggtctctccctgtcctccctgcgagcttttcctctgcagagcccagtggagccagccatgtaccgcggcaacgcttgctgaccccagtgaggagagaggcctgaatccgagggccctggcacctgtgagctcttggctgtcacctgccccaagcctcgcacctccgctccacagcagtccccacaggagacaaccctgacgggagcatggagctgctgtccacgccccacagcattgagatcaacaacatcacctgcgactccttccgcatctcctgggccatggaggacagtgacctggagagggtcacccattacttcattgaccttaacaagaaggagaataagaattccaacaagttcaagcaccgggacgtccccaccaagctcgtggccaaggcagtgccgctgcccatgacggtgagaggccactggttcctgagcccccgcacggagtacagtgtggccgtgcagacggcagtgaagcagagcgatggggagtacctggtgtccggctggagcgagacggtggagttctgcactggggattatgccaaggagcacctggctcagcttcaggagaaagctgagcagatcgcaggccgcatgctccgcttctccgtcttctaccgcaaccatcacaaggagtacttccagcatgccaggacccactgcgggaacatgctgcagccttacctgaaggacaacagtggcagccacggctcccccaccagcggtatgctccacggggtcttcttcagctgcaacacggagttcaacacgggccagcccccgcaggactccccctacggccgctggcgcttccagatcccagctcagcgcctcttcaatcccagcaccaacctctactttgcggacttctactgcatgtacacggcctaccactacgccatcctggtgctggcgcccaaaggctccctgggggaccgcttctgccgcgaccgcctgcccctcctggacattgcttgcaacaagttcctgacctgcagcgtggaggatggggagctggtcttccgccacgcccaggacctcatcctggagatcatctacactgagcccgtcgacctgtccctgggcaccctgggggagatcagtgggcaccagctcatgagtctgtctactgccgatgccaagaaggaccccagctgcaagacctgcaacatcagcgtgggccgctagggactcctggggagctggggggcgagggagagatgagcggaaggtggaggtgggtagcccaggttcagggagctggctttctctctcctgcccccctgctccctccactctgcccagctgccctcccctcgccccttggcattggaggcaacagacggtggtcctcttggtaagtgtggcccacacccagcctggtggacatggaaaggcttctcagcctctgtagttggcagctgggctggacttctggagaacttcccctttcctctggtttccttgtcctactgttctttgcctcgtccaggtctctatctcccaaagacctgcccacctcctgggctctcccagggaagcccctctgggccaaagcccatgggtagcttggctgcctccagaagagatgcagagagctgtggggcgatctttcttagtcccactcaccccactcagggccaaccacagaatgccccctccctgctgagctgggtctctggggcttcccactccaggcctggatcccttccttctataaatagtctcctgcaccaccgtgactccctggctgctccttgccccaaagaaccctcttcctgcatgggagagctgtccctccttctccacctgcccaccgggacactccccctgctctctagaaaggaactctctttcttctcttggcactgggggcgtcaggctgtcggatgttccttccttccataccccagcataccttctccttgcttagagtgcaggggtctgagacagcagccactggggttgaggagggggaggagacccctgagacccagaggtgccccttcctcagctgggagtgggccgcctcatgctctgctggggcctggcatggaacgtgagacctgtaagctgtcccgcgggccccggcaccccgcccagctgtgcactttgctcactcgctctgccatggtgccatgactgtactgtgcccatgcgtgacctggactgtggaccctctgctgctccgcctctcccctccccactggctctgtctgctctcctgccaccctgctggccgggagcccctccccggggagttcttggtgaagtccttcccgggcctccttgtgtttttgcctcattcctactgtcacacaggtcacgagggtggactccctacaatcaacaaagcaaacagagagcctgtgggaggggctgacagcagcagccggctgtttgggggatgatggaggtgacatcaggcagaggagagtgcagcctcacagtgactttctcagaggtgacagagatgatggatgagcagctggattttcgtgatgaaggacggaagcagcagcgggccggcaaggccatacctcggtgagggacaggtggacaacggtcacctatctgtagccaggggcagttgtgtggccagctgtctctctgggatgagtcaggaggcctggaggcttggggagaggtgtggagaaggagagaacatggcccaggccctttccttccccctgtgctgacagcattgctgtgggggtggcccactgccctcccctggccctcatgtccccccggggctggggtccgcctgcctgtgctgtgcttgcgacgtgcatcaataaaccaccatggcctgagggccctgctcgtctcagtcc

SEQ ID NO: 15543 - DNA, 3200 bp, Homo sapiens
  ENST00000454243
agagatttccaagtagggggtgtgttggagggacttctgagggcagcttgtcctggaagaatgggggaaaggcggcgtgtgttgctgtccctgaggacatctgtgtagctccctgggagaccctctgccctttccccctcccaccagcccggcgagcagggaccaagcctgcttattatcacctgacgctgcgcagccgctgatcccattggtggaggcagattcggtctggctctctcgttctttctcccttctctgcctctctctcctccacgctgctttgatttcgctcttgcctctcttcttgcgctgctcagctgggaacatcgtctcaccaggggcagcagcgacgcgctgcacagccagacaggagctggctgcggggcatggaagcagcctccttggcagccgggagaggagcaagcgcacgccactgcccgtgacccaggcgtccggctgctgtcccctgccggggagctcatccacgcagaggtctctccctgtcctccctgcgagcttttcctctgcagagcccagtggagccagtccccacaggagacaaccctgacgggagcatggagctgctgtccacgccccacagcattgagatcaacaacatcacctgcgactccttccgcatctcctgggccatggaggacagtgacctggagagggtcacccattacttcattgaccttaacaagaaggagaataagaattccaacaagttcaagcaccgggacgtccccaccaagctcgtggccaaggcagtgccgctgcccatgacggtgagaggccactggttcctgagcccccgcacggagtacagtgtggccgtgcagacggcagtgaagcagagcgatggggagtacctggtgtccggctggagcgagacggtggagttctgcactggggattatgccaaggagcacctggctcagcttcaggagaaagctgagcagatcgcaggccgcatgctccgcttctccgtcttctaccgcaaccatcacaaggagtacttccagcatgccaggacccactgcgggaacatgctgcagccttacctgaaggacaacagtggcagccacggctcccccaccagcggtatgctccacggggtcttcttcagctgcaacacggagttcaacacgggccagcccccgcaggactccccctacggccgctggcgcttccagatcccagctcagcgcctcttcaatcccagcaccaacctctactttgcggacttctactgcatgtacacggcctaccactacgccatcctggtgctggcgcccaaaggctccctgggggaccgcttctgccgcgaccgcctgcccctcctggacattgcttgcaacaagttcctgacctgcagcgtggaggatggggagctggtcttccgccacgcccaggacctcatcctggagatcatctacactgagcccgtcgacctgtccctgggcaccctgggggagatcagtgggcaccagctcatgagtctgtctactgccgatgccaagaaggaccccagctgcaagacctgcaacatcagcgtgggccgctagggactcctggggagctggggggcgagggagagatgagcggaaggtggaggtgggtagcccaggttcagggagctggctttctctctcctgcccccctgctccctccactctgcccagctgccctcccctcgccccttggcattggaggcaacagacggtggtcctcttggtaagtgtggcccacacccagcctggtggacatggaaaggcttctcagcctctgtagttggcagctgggctggacttctggagaacttcccctttcctctggtttccttgtcctactgttctttgcctcgtccaggtctctatctcccaaagacctgcccacctcctgggctctcccagggaagcccctctgggccaaagcccatgggtagcttggctgcctccagaagagatgcagagagctgtggggcgatctttcttagtcccactcaccccactcagggccaaccacagaatgccccctccctgctgagctgggtctctggggcttcccactccaggcctggatcccttccttctataaatagtctcctgcaccaccgtgactccctggctgctccttgccccaaagaaccctcttcctgcatgggagagctgtccctccttctccacctgcccaccgggacactccccctgctctctagaaaggaactctctttcttctcttggcactgggggcgtcaggctgtcggatgttccttccttccataccccagcataccttctccttgcttagagtgcaggggtctgagacagcagccactggggttgaggagggggaggagacccctgagacccagaggtgccccttcctcagctgggagtgggccgcctcatgctctgctggggcctggcatggaacgtgagacctgtaagctgtcccgcgggccccggcaccccgcccagctgtgcactttgctcactcgctctgccatggtgccatgactgtactgtgcccatgcgtgacctggactgtggaccctctgctgctccgcctctcccctccccactggctctgtctgctctcctgccaccctgctggccgggagcccctccccggggagttcttggtgaagtccttcccgggcctccttgtgtttttgcctcattcctactgtcacacaggtcacgagggtggactccctacaatcaacaaagcaaacagagagcctgtgggaggggctgacagcagcagccggctgtttgggggatgatggaggtgacatcaggcagaggagagtgcagcctcacagtgactttctcagaggtgacagagatgatggatgagcagctggattttcgtgatgaaggacggaagcagcagcgggccggcaaggccatacctcggtgagggacaggtggacaacggtcacctatctgtagccaggggcagttgtgtggccagctgtctctctgggatgagtcaggaggcctggaggcttggggagaggtgtggagaaggagagaacatggcccaggccctttccttccccctgtgctgacagcattgctgtgggggtggcccactgccctcccctggccctcatgtccccccggggctggggtccgcctgcctgtgctgtgcttgcgacgtgcatcaataaaccaccatggcctgagggc

SEQ ID NO: 15544 - DNA, 769 bp, Homo sapiens
  ENST00000523252
gccatttgcttgacttagaaaaggaatgggagagagtcctccgtgggacgtccccaccaagctcgtggccaaggcagtgccgctgcccatgacggtgagaggccactggttcctgagcccccgcacggagtacagtgtggccgtgcagacggcagtgaagcagagcgatggggagtacctggtgtccggctggagcgagacggtggagttctgcactggggattatgccaaggagcacctggctcagcttcaggagaaagctgagcagatcgcaggccgcatgctccgcttctccgtcttctaccgcaaccatcacaaggagtacttccagcatgccaggacccactgcgggaacatgctgcagccttacctgaaggacaacagtggcagccacggctcccccaccagcggtatgctccacggggtcttcttcagctgcaacacggagttcaacacgggccagcccccgcaggactccccctacggccgctggcgcttccagatcccagctcagcgcctcttcaatcccagcaccaacctctactttgcggacttctactgcatgtacacggcctaccactacgccatcctggtgctggcgcccaaaggctccctgggggaccgcttctgccgcgaccgcctgcccctcctggacattgcttgcaacaagttcctgacctgcagcgtggaggatggggagctggtcttccgccacgcccaggacctcatcctggagatcatctacactgagcccgtcgacctgtccctg

SEQ ID NO: 15545 - DNA, 847 bp, Homo sapiens
  ENST00000522869
ccattacttcattgaccttaacaagaaggagaataagaattccaacaagttcaagcaccgggacgtccccaccaagctcgtggccaaggcagtgccgctgcccatgacggtgagaggccactggttcctgagcccccgcacggagtacagtgtggccgtgcagacggcagtgaagcagagcgatggggagtacctggtgtccggctggagcgagacggtggagttctgcactggggattatgccaaggagcacctggctcagcttcaggagaaagctgagcagatcgcaggccgcatgctccgcttctccgtcttctaccgcaaccatcacaaggagtacttccagcatgccaggtatgggcgcgggctcccggctggacccgccgggcctctcctccctcccagcccttcctgctcctgtcctggctgtctgaggtcacccccaccctcgtggctgccagtccctcctctagggttgacatgtcctgacgtcaccaggctggctctgaagagactgctactttggggattgggctcagggaagatcaagggctctggggacagggccttctgcaagagtgttgtactaatgagcctgggagaatgaggtctgggtttgctcccactctgggacagttcctttcacaggggtctaccaccacaggtctctccgattcaggccctggggccaaagggaaggtggcagggagtgcacaaaatgagtgttctgatcacaaagggttcgaggaagcacccagctcgtcggttttcaaactgggtgctccctccagggagacatgtcagtgaaccccttagaatgctgccatggggttggggggaccagagg

SEQ ID NO: 15546 - DNA, 713 bp, Homo sapiens
  ENST00000518274
aaatctgtccccgcccggctttgcagcattcccactgcctctgccacctgtcaggtgccgtctgctctgcagacccctccgaggagagcaaagagccccccgggcaggcacccctttccaccctccatcatccttctccagcctcccctgtacagtctttcccatctggttcatgaggcatgtggattccaggggtccttgaggttccgcctcgaaagggatattgggaggaggacattccagaaagctcgccggggtcaagggatgtactgaccctttccctcctcctcagtccccacaggagacaaccctgacgggagcatggagctgctgtccacgccccacagcattgagatcaacaacatcacctgcgactccttccgcatctcctgggccatggaggacagtgacctggagagggtcacccattacttcattgaccttaacaagaaggagaataagaattccaacaagttcaagcaccgggacgtccccaccaagctcgtggccaaggcagtgccgctgcccatgacggtgagaggccactggttcctgagcccccgcacggagtacagtgtggccgtgcagacggcagtgaagcagagcgatggggagtacctggtgtccggctggagcgagacggtggagttctgcactggggattatgccaaggagcacctggctcagcttcaggagaaagctgagcagatcgc

SEQ ID NO: 15547 - DNA, 2190 bp, Homo sapiens
  ENST00000373674
cctgggtgcaaccagtcacagctctgcagaggttactgtgattttgcccctgaaggatctgtccacaacttaggaactcacacagcttttggcctgagcccccgttaccaagagaaaggaggtttttgccaaggactccaaggggagtgcacttgatgctggtcgggacccaaagcgcccagccctccctgagacattgtgtgagtcgggctgggcctcaaacacggcccccactgccccaccccagccagggtggtgcttgtgtgggaaggactttaaatccagctgccagacccctggacgggagaaggagagacggctggccaccatgcacggctcctgcagtttcctgatgcttctgctgccgctactgctactgctggtggccaccacaggccccgttggagccctcacagatgaggagaaacgtttgatggtggagctgcacaacctctaccgggcccaggtatccccgacggcctcagacatgctgcacatgagatgggacgaggagctggccgccttcgccaaggcctacgcacggcagtgcgtgtggggccacaacaaggagcgcgggcgccgcggcgagaatctgttcgccatcacagacgagggcatggacgtgccgctggccatggaggagtggcaccacgagcgtgagcactacaacctcagcgccgccacctgcagcccaggccagatgtgcggccactacacgcaggtggtatgggccaagacagagaggatcggctgtggttcccacttctgtgagaagctccagggtgttgaggagaccaacatcgaattactggtgtgcaactatgagcctccggggaacgtgaaggggaaacggccctaccaggaggggactccgtgctcccaatgtccctctggctaccactgcaagaactccctctgtgaacccatcggaagcccggaagatgctcaggatttgccttacctggtaactgaggccccatccttccgggcgactgaagcatcagactctaggaaaatgggtactccttcttccctagcaacggggattccggctttcttggtaacagaggtctcaggctccctggcaaccaaggctctgcctgctgtggaaacccaggccccaacttccttagcaacgaaagacccgccctccatggcaacagaggctccaccttgcgtaacaactgaggtcccttccattttggcagctcacagcctgccctccttggatgaggagccagttaccttccccaaatcgacccatgttcctatcccaaaatcagcagacaaagtgacagacaaaacaaaagtgccctctaggagcccagagaactctctggaccccaagatgtccctgacaggggcaagggaactcctaccccatgcccaggaggaggctgaggctgaggctgagttgcctccttccagtgaggtcttggcctcagtttttccagcccaggacaagccaggtgagctgcaggccacactggaccacacggggcacacctcctccaagtccctgcccaatttccccaatacctctgccaccgctaatgccacgggtgggcgtgccctggctctgcagtcgtccttgccaggtgcagagggccctgacaagcctagcgtcgtgtcagggctgaactcgggccctggtcatgtgtggggccctctcctgggactactgctcctgcctcctctggtgttggctggaatcttctgaaggggataccactcaaagggtgaagaggtcagctgtcctcctgtcatcttccccaccctgtccccagcccctaaacaagatacttcttggttaaggccctccggaagggaaaggctacggggcatgtgcctcatcacaccatccatcctggaggcacaaggcctggctggctgcgagctcaggaggccgcctgaggactgcacaccgggcccacacctctcctgcccctccctcctgagtcctgggggtgggaggatttgagggagctcactgcctacctggcctggggctgtctgcccacacagcatgtgcgctctccctgagtgcctgtgtagctggggatggggattcctaggggcagatgaaggacaagccccactggagtggggttctttgagtgggggaggcagggacgagggaaggaaagtaactcctgactctccaataaaaacctgtccaacctgtggcaa

SEQ ID NO: 15548 - DNA, 466 bp, Homo sapiens
  ENST00000491324
cccatccttccgggcgactgaagcatcagactctaggaaaatgggtgcagagggccctgacaagcctagcgtcgtgtcagggctgaactcgggccctggtcatgtgtggggccctctcctgggactactgctcctgcctcctctggtgttggctggaatcttctgaaggggataccactcaaagggtgaagaggtcagctgtcctcctgtcatcttccccaccctgtccccagcccctaaacaagatacttcttggttaaggccctccggaagggaaaggctacggggcatgtgcctcatcacaccatccatcctggaggcacaaggcctggctggctgcgagctcaggaggccgcctgaggactgcacaccgggcccacacctctcctgcccctccctcctgagtcctgggggtgggaggatttgagggagctcactgcctacctggcctggggctgtctgccca

SEQ ID NO: 15549 - DNA, 2083 bp, Homo sapiens
  ENST00000611814
gctattgaaggggcatgactggaggcagaggccacagagatgaccacaccagggcaacctgtagtgccagtgcctggttccacccggggggcatctgagaactgtgtccttccattcctgagtccagcacttcccaggccagccagggtggtgcttgtgtgggaaggactttaaatccagctgccagacccctggacgggagaaggagagacggctggccaccatgcacggctcctgcagtttcctgatgcttctgctgccgctactgctactgctggtggccaccacaggccccgttggagccctcacagatgaggagaaacgtttgatggtggagctgcacaacctctaccgggcccaggtatccccgacggcctcagacatgctgcacatgagatgggacgaggagctggccgccttcgccaaggcctacgcacggcagtgcgtgtggggccacaacaaggagcgcgggcgccgcggcgagaatctgttcgccatcacagacgagggcatggacgtgccgctggccatggaggagtggcaccacgagcgtgagcactacaacctcagcgccgccacctgcagcccaggccagatgtgcggccactacacgcaggtggtatgggccaagacagagaggatcggctgtggttcccacttctgtgagaagctccagggtgttgaggagaccaacatcgaattactggtgtgcaactatgagcctccggggaacgtgaaggggaaacggccctaccaggaggggactccgtgctcccaatgtccctctggctaccactgcaagaactccctctgtgaacccatcggaagcccggaagatgctcaggatttgccttacctggtaactgaggccccatccttccgggcgactgaagcatcagactctaggaaaatgggtactccttcttccctagcaacggggattccggctttcttggtaacagaggtctcaggctccctggcaaccaaggctctgcctgctgtggaaacccaggccccaacttccttagcaacgaaagacccgccctccatggcaacagaggctccaccttgcgtaacaactgaggtcccttccattttggcagctcacagcctgccctccttggatgaggagccagttaccttccccaaatcgacccatgttcctatcccaaaatcagcagacaaagtgacagacaaaacaaaagtgccctctaggagcccagagaactctctggaccccaagatgtccctgacaggggcaagggaactcctaccccatgcccaggaggaggctgaggctgaggctgagttgcctccttccagtgaggtcttggcctcagtttttccagcccaggacaagccaggtgagctgcaggccacactggaccacacggggcacacctcctccaagtccctgcccaatttccccaatacctctgccaccgctaatgccacgggtgggcgtgccctggctctgcagtcgtccttgccaggtgcagagggccctgacaagcctagcgtcgtgtcagggctgaactcgggccctggtcatgtgtggggccctctcctgggactactgctcctgcctcctctggtgttggctggaatcttctgaaggggataccactcaaagggtgaagaggtcagctgtcctcctgtcatcttccccaccctgtccccagcccctaaacaagatacttcttggttaaggccctccggaagggaaaggctacggggcatgtgcctcatcacaccatccatcctggaggcacaaggcctggctggctgcgagctcaggaggccgcctgaggactgcacaccgggcccacacctctcctgcccctccctcctgagtcctgggggtgggaggatttgagggagctcactgcctacctggcctggggctgtctgcccacacagcatgtgcgctctccctgagtgcctgtgtagctggggatggggattcctaggggcagatgaaggacaagccccactggagtggggttctttgagtgggggaggcagggacgagggaaggaaagtaactcctgactctccaataaaaacctgtccaacctgtggc

SEQ ID NO: 15550 - DNA, 479 bp, Homo sapiens
  ENST00000482518
tggagatgggctttgcaacacaacagacctgtgtgtgcgattttgatcttaggcaactgaaaagcaagtaacgctccctttctattacctgaagcttctgcttatggagttttgaagttctccaggatggtttttctatttctctgagcactgaagtggctaatgccatggcagatgtcatacctaatgctgcagaggcagagcataagcactttcagaccatgctgaagtctaaattgaatgtcttaacactgaaaaaggaacctctcccagcggtcatcttccatgagccggaggccattgagctgtgcacgaccacaccgctgatgaagacaaggactcacagtggctgcaaggtacatggtttcactgtgttgcccaggatggtctcaaactcatggcctcaagcaatactcagacttcagcctctgaaagtgctgggattataggcgtgaaccactgtgactggcctgtatttt

SEQ ID NO: 15551 - DNA, 2745 bp, Homo sapiens
  ENST00000392054
aggacagccggcgcgcggccgtgcccacaagttgccggcagctgagcgccgcgcctcctcctgctcgcagccccctacgcccacccggcggcggtggccagcgccaggacgcacatcccgcggacaccgaccccagatgtaaagcgggaccccagcccctcgccccccggcgcgatcgacagtctcgccagcgtctcctctgccaaaacccagggctggaagatgtggcagccggccacggagcgcctgcaggagagatttgcagacacagaagcggcacagagaaggccattgtgaagatcaaggcagaaaccggagttatggcatcataagccaaggaatgccaaggattgctggcaaccacctgatgttagaagagtcgaggacatgttcttctccagagcttttggatggtgtgtggccctgccaacctttacattttggacttccagcctccgaaatgcactttcagaccatgctgaagtctaaattgaatgtcttaacactgaaaaaggaacctctcccagcggtcatcttccatgagccggaggccattgagctgtgcacgaccacaccgctgatgaagacaaggactcacagtggctgcaaggttacctacctgggcaaagtctccaccactggcatgcagtttttgtcaggctgcacagaaaagccagtcattgagctctggaagaagcacacgctagcccgagaggatgtctttccggccaatgccctcctggaaatccggccattccaagtttggctccatcatctcgaccacaaaggggaggccacagtgcacatggataccttccaggtggcccgcatcgcctactgcaccgccgaccacaacgtgagccccaacatcttcgcctgggtctacagggagatcaatgatgacctgtcctaccagatggactgccacgccgtggagtgcgagagcaagctcgaggccaagaaactggcccacgccatgatggaggccttcaggaagactttccacagtatgaagagcgacgggcggatccacagcaacagctcctccgaagaggtttcccaggaattggaatccgatgatggctgaatgaacttgagacgcttcagcaaaggcagcattggtcacggagttcaagggaatagatgagtaagcaacgtttcaaatttgggatgaaaagactgccaaactattggctgaccaaggtttttaaattcagaagagcaattctaaatctaaagaaatgtatcattaaagtaattacgttacattgaaacctgctgctgctgtgactgtgaggagggtgggagtgtggatggggaggaaggttctaggctctcttatttttctcatttcccaatgcctctctgtgggagagctccatgccagttttcaccacgctcaggcaaatactctgcagctgttattggatgggccattccgatctgccttatgaaattccacaagaatgttaggggcacctatgggatctctagtggggtgggcagggtgctgatggggacgctggccgcagggaggaaggaacatctcgggagggccctctgttcctctcccacggcagatgccctcctctgtatgcaaatcagcacagcctttattgagctttacaactaacaacctgatagttggcagttaattcacagttacagataatgcttttatttacataaatataccaagtagtaccctcttattgtattcacttcatctattttcttagaatacttgcaattactaatgaccccttccctttccctcctgctgccctgtccaccctctttccccttctaacatccttagagggatgaaatctcagcatatgttgcaggacaccaaaaggaagaaaacaatcaagcaaataaaataaacagtcaaacaaaccaggagtttaaaacaacaaccccaacaacagaagccttggcaaagaggaataagtgatcagcaagtgaacacactctatgtcaactctccttttatccagctgagatttatggtaacttatttaattaatggtcctgtctgatgcatccttgatggcaagcttcaaatctgatttggtatcaccgaggaaaccttgcccccatcactcagcattgcacttagatacagaatgagttagataaacttggcttgtctagagacccatgtcatcttaacctaaagggaaatcttattgcgttatcataaaattgatgatatcttagggtcagaattgccctttttttttattttgaatgggaagttctcactaaaacaatcctgagatttcttaatttcatggttctttaaatattataaacacagagtcaacatagaatgaaattgtatttgttaaaatacacacattggaggacaagagcagatgactacttttcgaagtaatgctgctccttcctaaaagtctgttttcaatcctggtaatattaggggcactgcggcacctaagaagccttaaatgagagctaatccaatctagagagcgatggtgtcagcatttcggtctgcatatctgtgtgtccgtatctgcgtttgtgtgcgtgtacgtgtgcccctgtgtgtgggcccagttttcaggcatgtagaataagcatggagtcatattgaggaggactcacttcttgaagatatgcttgttgctttacaacatatgtaagctattctttagcataaatgcattcattctttaataaaaatatgtttgcattaataaagctgaggagtttcat

SEQ ID NO: 15552 - DNA, 2387 bp, Homo sapiens
  ENST00000409462
tctcgcagctgcgccaggacagccggcgcgcggccgtgcccacaagttgccggcagctgagcgccgcgcctcctcctgctcgcagccccctacgcccacccggcggcggtggccagcgccaggacgcacatcccgcggacaccgaccccagatgtaaagcgggaccccagcccctcgccccccggcgcgatcgacagtctcgccagcgtctcctctgccaaaacccagggctggaagatgtggcagccggccacggagcgcctgcaggttacctacctgggcaaagtctccaccactggcatgcagtttttgtcaggctgcacagaaaagccagtcattgagctctggaagaagcacacgctagcccgagaggatgtctttccggccaatgccctcctggaaatccggccattccaagtttggctccatcatctcgaccacaaaggggaggccacagtgcacatggataccttccaggtggcccgcatcgcctactgcaccgccgaccacaacgtgagccccaacatcttcgcctgggtctacagggagatcaatgatgacctgtcctaccagatggactgccacgccgtggagtgcgagagcaagctcgaggccaagaaactggcccacgccatgatggaggccttcaggaagactttccacagtatgaagagcgacgggcggatccacagcaacagctcctccgaagaggtttcccaggaattggaatccgatgatggctgaatgaacttgagacgcttcagcaaaggcagcattggtcacggagttcaagggaatagatgagtaagcaacgtttcaaatttgggatgaaaagactgccaaactattggctgaccaaggtttttaaattcagaagagcaattctaaatctaaagaaatgtatcattaaagtaattacgttacattgaaacctgctgctgctgtgactgtgaggagggtgggagtgtggatggggaggaaggttctaggctctcttatttttctcatttcccaatgcctctctgtgggagagctccatgccagttttcaccacgctcaggcaaatactctgcagctgttattggatgggccattccgatctgccttatgaaattccacaagaatgttaggggcacctatgggatctctagtggggtgggcagggtgctgatggggacgctggccgcagggaggaaggaacatctcgggagggccctctgttcctctcccacggcagatgccctcctctgtatgcaaatcagcacagcctttattgagctttacaactaacaacctgatagttggcagttaattcacagttacagataatgcttttatttacataaatataccaagtagtaccctcttattgtattcacttcatctattttcttagaatacttgcaattactaatgaccccttccctttccctcctgctgccctgtccaccctctttccccttctaacatccttagagggatgaaatctcagcatatgttgcaggacaccaaaaggaagaaaacaatcaagcaaataaaataaacagtcaaacaaaccaggagtttaaaacaacaaccccaacaacagaagccttggcaaagaggaataagtgatcagcaagtgaacacactctatgtcaactctccttttatccagctgagatttatggtaacttatttaattaatggtcctgtctgatgcatccttgatggcaagcttcaaatctgatttggtatcaccgaggaaaccttgcccccatcactcagcattgcacttagatacagaatgagttagataaacttggcttgtctagagacccatgtcatcttaacctaaagggaaatcttattgcgttatcataaaattgatgatatcttagggtcagaattgccctttttttttattttgaatgggaagttctcactaaaacaatcctgagatttcttaatttcatggttctttaaatattataaacacagagtcaacatagaatgaaattgtatttgttaaaatacacacattggaggacaagagcagatgactacttttcgaagtaatgctgctccttcctaaaagtctgttttcaatcctggtaatattaggggcactgcggcacctaagaagccttaaatgagagctaatccaatctagagagcgatggtgtcagcatttcggtctgcatatctgtgtgtccgtatctgcgtttgtgtgcgtgtacgtgtgcccctgtgtgtgggcccagttttcaggcatgtagaataagcatggagtcatattgaggaggactcacttcttgaagatatgcttgttgctttacaacatatgtaagctattctttagcataaatgcattcattctttaataaaaatatgtttgcattaataaa

SEQ ID NO: 15553 - DNA, 2533 bp, Homo sapiens
  ENST00000392055
agtcctctcgcagctgcgccaggacagccggcgcgcggccgtgcccacaagttgccggcagctgagcgccgcgcctcctcctgctcgcagccccctacgcccacccggcggcggtggccagcgccaggacgcacatcccgcggacaccgaccccagatgtaaagcgggaccccagcccctcgccccccggcgcgatcgacagtctcgccagcgtctcctctgccaaaacccagggctggaagatgtggcagccggccacggagcgcctgcagcactttcagaccatgctgaagtctaaattgaatgtcttaacactgaaaaaggaacctctcccagcggtcatcttccatgagccggaggccattgagctgtgcacgaccacaccgctgatgaagacaaggactcacagtggctgcaaggttacctacctgggcaaagtctccaccactggcatgcagtttttgtcaggctgcacagaaaagccagtcattgagctctggaagaagcacacgctagcccgagaggatgtctttccggccaatgccctcctggaaatccggccattccaagtttggctccatcatctcgaccacaaaggggaggccacagtgcacatggataccttccaggtggcccgcatcgcctactgcaccgccgaccacaacgtgagccccaacatcttcgcctgggtctacagggagatcaatgatgacctgtcctaccagatggactgccacgccgtggagtgcgagagcaagctcgaggccaagaaactggcccacgccatgatggaggccttcaggaagactttccacagtatgaagagcgacgggcggatccacagcaacagctcctccgaagaggtttcccaggaattggaatccgatgatggctgaatgaacttgagacgcttcagcaaaggcagcattggtcacggagttcaagggaatagatgagtaagcaacgtttcaaatttgggatgaaaagactgccaaactattggctgaccaaggtttttaaattcagaagagcaattctaaatctaaagaaatgtatcattaaagtaattacgttacattgaaacctgctgctgctgtgactgtgaggagggtgggagtgtggatggggaggaaggttctaggctctcttatttttctcatttcccaatgcctctctgtgggagagctccatgccagttttcaccacgctcaggcaaatactctgcagctgttattggatgggccattccgatctgccttatgaaattccacaagaatgttaggggcacctatgggatctctagtggggtgggcagggtgctgatggggacgctggccgcagggaggaaggaacatctcgggagggccctctgttcctctcccacggcagatgccctcctctgtatgcaaatcagcacagcctttattgagctttacaactaacaacctgatagttggcagttaattcacagttacagataatgcttttatttacataaatataccaagtagtaccctcttattgtattcacttcatctattttcttagaatacttgcaattactaatgaccccttccctttccctcctgctgccctgtccaccctctttccccttctaacatccttagagggatgaaatctcagcatatgttgcaggacaccaaaaggaagaaaacaatcaagcaaataaaataaacagtcaaacaaaccaggagtttaaaacaacaaccccaacaacagaagccttggcaaagaggaataagtgatcagcaagtgaacacactctatgtcaactctccttttatccagctgagatttatggtaacttatttaattaatggtcctgtctgatgcatccttgatggcaagcttcaaatctgatttggtatcaccgaggaaaccttgcccccatcactcagcattgcacttagatacagaatgagttagataaacttggcttgtctagagacccatgtcatcttaacctaaagggaaatcttattgcgttatcataaaattgatgatatcttagggtcagaattgccctttttttttattttgaatgggaagttctcactaaaacaatcctgagatttcttaatttcatggttctttaaatattataaacacagagtcaacatagaatgaaattgtatttgttaaaatacacacattggaggacaagagcagatgactacttttcgaagtaatgctgctccttcctaaaagtctgttttcaatcctggtaatattaggggcactgcggcacctaagaagccttaaatgagagctaatccaatctagagagcgatggtgtcagcatttcggtctgcatatctgtgtgtccgtatctgcgtttgtgtgcgtgtacgtgtgcccctgtgtgtgggcccagttttcaggcatgtagaataagcatggagtcatattgaggaggactcacttcttgaagatatgcttgttgctttacaacatatgtaagctattctttagcataaatgcattcattctttaataaaaatatgtttgcatt

SEQ ID NO: 15554 - DNA, 839 bp, Homo sapiens
  ENST00000354069
atgaaaagccttgtacaagaggcttcgtgccatgttcagcctgccccttagccttccactgtgtgaggacacagcattccttccttccaagtgctgcagctctcacaagacaatcaaacaagcccgcaccttgatcatgatcttcctagcctccggaacgcactttcagaccatgctgaagtctaaattgaatgtcttaacactgaaaaaggaacctctcccagcggtcatcttccatgagccggaggccattgagctgtgcacgaccacaccgctgatgaagacaaggactcacagtggctgcaaggttacctacctgggcaaagtctccaccactggcatgcagtttttgtcaggctgcacagaaaagccagtcattgagctctggaagaagcacacgctagcccgagaggatgtctttccggccaatgccctcctggaaatccggccattccaagtttggctccatcatctcgaccacaaaggggaggccacagtgcacatggataccttccaggtggcccgcatcgcctactgcaccgccgaccacaacgtgagccccaacatcttcgcctgggtctacagggagatcaatgatgacctgtcctaccagatggactgccacgccgtggagtgcgagagcaagctcgaggccaagaaactggcccacgccatgatggaggccttcaggaagactttccacagtatgaagagcgacgggcggatccacagcaacagctcctccgaagaggtttcccaggaattggaatccgatgatggctgaatgaacttgagacgcttcagcaaaggcagcattggtcacggagttcaagggaata

SEQ ID NO: 15555 - DNA, 553 bp, Homo sapiens
  ENST00000534952
acaagttgccggcagctgagcgccgcgcctcctcctgctcgcagccccctacgcccacccggcggcggtggccagcgccaggacgcacatcccgcggacaccgaccccagatgtaaagcgggaccccagcccctcgccccccggcgcgatcgacagtctcgccagcgtctcctctgccaaaacccagggctggaagatgtggcagccggccacggagcgcctgcaggatggctgctgcaactccagtcacaatacacttgtccctcagtatccctggggaatcgattcaggacctcttgtgaataccaaaatctacagatagtcaagaccgtgcactttcagaccatgctgaagtctaaattgaatgtcttaacactgaaaaaggaacctctcccagcggtcatcttccatgagccggaggccattgagctgtgcacgaccacaccgctgatgaagacaaggactcacagtggctgcaaggttacctacctgggcaaagtctccaccactggcatgcagtttttgtcaggctgcacagaaaagccagtcattg

SEQ ID NO: 15556 - DNA, 389 bp, Homo sapiens
  ENST00000582937
tggtggtcttcaatgacaaagtcagtcccccaagtctggggttcctggctggctatggcttttaggctgcatgtgagaccatgtccagatgttcatccagacccacagcatggcagaggccttgttgttcactggcagtctccatcagaccttccgtcccaggatgttctttggaggatcttcaaaggcaaccttcctgtggctgcttctccgtgtttgcagtttgaaaatggactagaaccactagcacaagacagcggttatcttgcatgtccatagcaaagatattagtatcttaaatgtttaaattattatcctttacaatgttgccttttctaagtttgtattatttatacttctaacaccattacagtttaaacctgcagtaa

SEQ ID NO: 15557 - DNA, 9356 bp, Homo sapiens
  ENST00000302079
atggcctcagaagtggtgtgcgggctcatcttcaggctgctgctgcccatctgcctggcagtagcatgtgcattccgatacaatgggctctcctttgtctaccttatctacctcttgctcattcctctgttctcagaaccaacaaaaacgacgatgcaaggacatacgggacggttattaaagtctctgtgcttcatcagtctttccttcctgttgctgcacatcattttccacatcacgttggtgagccttgaagctcaacatcgtattgcacctggctacaactgctcaacatgggaaaagacattccggcagatcggctttgaaagcttaaagggagctgatgctggcaatgggatcagagtgtttgtacctgacatcgggatgttcattgctagtctgaccatctggctcctctgtagaaacattgttcagaaacctgtgacagacgaagcagcacagagtaacccggagtttgaaaatgaagaattggctgaaggagaaaaaattgattcagaagaggcactgatctatgaagaggatttcaatggaggagatggtgttgaaggcgagttggaagaaagcacgaagttaaaaatgttccgcaggcttgcctctgtggcctctaagctcaaggagttcattggcaacatgatcaccactgctgggaaagtcgttgttaccatcttactgggctcctcgggcatgatgttgccgtctttgacatcatctgtgtatttttttgtatttttgggtctgtgcacctggtggtcctggtgccggacgttcgacccattgctgttcagctgtctctgtgttctgctggctattttcactgctggacatttgattggactttatttataccagttccaattctttcaagaggcagttccacccaatgactactatgcaaggttgtttggtatcaagtcagtaattcaaacggactgttcaagtacttggaagatcatagtgaacccggacctgtcgtggtaccaccacgccaaccctatcctcctgctggtgatgtactacactctggccactctgatccgcatctggctgcaagagccccttgtgcaggatgaggggaccaaagaagaggacaaagccctggcttgtagccccatccaaataacagcggggaggaggcggagcctgtggtacgcaacccattaccccactgatgagagaaaacttttatccatgacccaggatgactacaaaccatctgatggcctgctggtgactgtgaacggcaaccccgtggattaccacaccatccacccaagcctgcccatggagaacggccctggcaaagccgacctctactccacccctcagtaccggtgggagccctctgatgaatcctcagaaaagcgagaggaggaagaggaagagaaagaagaatttgaagaagaaaggagccgtgaggaaaaaagaagtatcaaagttcatgccatggtctccgtattccaatttattatgaaacaaagttacatctgtgccctcatagctatgatggcctggagcatcacctatcacagctggctgaccttcgtgctgctgatctggtcgtgcactctttggatgattcgcaacagaagaaaatatgccatgatcagctctcccttcatggtggtttatggaaacctattgttgatattacagtatatatggagttttgaacttcctgaaattaaaaaagttccaggatttttagaaaagaaagagccaggagaacttgcttccaaaatccttttcaccattactttttggctactgctgaggcagcacctcacagagcaaaaagctctgcaagaaaaggaagctcttttatcggaagtcaaaattggcagtcaggaaaatgaagaaaaagatgaggaacttcaagatatacaagtggaaggagagcccaaagaggaggaagaagaggaagcgaaggaagagaagcaagagagaaagaaggtagagcaagaggaagctgaagaagaagatgagcaggacatcatgaaagtcctgggcaatctggtggtggccatgttcatcaagtactggatctacgtctgcggaggcatgttcttcttcgtcagcttcgagggtaaaatcgtaatgtacaaaatcatctacatggtgctgttcctgttctgtgtggccctataccaggtgcactatgaatggtggaggaaaattctaaaatatttttggatgtcagtggttatttacactatgctggtgcttatctttatatacacatatcagtttgagaacttcccaggcctgtggcaaaatatgactggactgaaaaaagaaaagcttgaggatcttggcttaaagcagtttactgtggctgaactattcactcgcatattcatcccaacctcctttctgctggtgtgcattttacacctgcactacttccatgaccggttccttgaactcacagacctcaagtccattcccagcaaagaagacaacaccatctacagactggcccacccggaaggaagcctcccggacctcaccatgatgcatctgactgccagcctggagaagccggaggtgaggaagttggctgagcctggggaggagaagcttgagggctactctgaaaaagcccagaagggtgatcttgggaaagacagcgaggagtcagaggaggacggagaggaagaggaggaatccgaggaggaggaagaaacatcagacttaaggaacaaatggcacctggtgattgaccgcctcactgtgctcttcttaaaattcctggagtattttcacaagctgcaggtgttcatgtggtggattttggagttgcacatcatcaaaatcgtttcctcttacattatctgggtttctgtgaaagaggtgtctctgttcaactatgtatttttgatttcttgggcttttgctctgccgtacgccaagctgcgccgtctggcttcaagtgtctgcacagtctggacgtgtgtgatcatcgtctgcaaaatgttgtaccagctccaaaccattaagcctgagaacttctctgttaactgttccttgccaaatgaaaatcaaacaaacatcccctttaatgagttgaacaagtctctgctctacagcgctcctatcgatcctacagagtgggtcggcctgcggaagtcttcgcctctgctagtctacctgaggaataacctcctgatgctggctatcctggcctttgaagtcaccatttaccgccatcaggaatactatcgaggtcgaaataacctgacggcccctgtgtctagaactatctttcatgacattacaagactacatctagatgatggacttattaattgtgccaaatatttcattaattacttcttttacaagtttggtctggagacctgtttcctaatgtcagttaacgtcattggccagcgaatggatttctatgccatgatccacgcctgctggctgatcgctgtcttatatagacgcagaaggaaagccatcgcagagatctggcccaagtactgctgcttcctggcatgcatcatcaccttccagtatttcatctgcattggcatcccacctgctccttgccgagattacccgtggagattcaagggtgccagcttcaatgacaacatcataaagtggctgtacttcccagatttcattgtgcggcccaaccctgtgtttctcgtctatgacttcatgctgcttctgtgtgcctccttacaacggcagatttttgaggatgagaacaaggctgcagtgcgaatcatggcaggtgacaatgtcgagatctgcatgaaccttgatgcggcctccttcagccaacataaccctgtgccagattttattcactgcagatcttacttagacatgtccaaagtgatcatcttcagctacctcttctggtttgtgctcaccatcatcttcatcactgggaccaccaggatcagcatcttttgcatggggtacctggtggcctgtttctacttcctgctctttgggggcgatttgctgttgaaacccatcaagagcatcctgcgctactgggactggctgatcgcatacaacgtttttgtgattacgatgaaaaatatcctgtcaataggagcatgtggatacattggaacattggtgcacaatagttgttggttgatccaggctttcagcctggcctgcacagtcaaaggctatcaaatgcctgctgctaattcaccctgtacacttcccagtggggaagcaggaatcatttgggacagcatatgttttgccttcctcctgctgcaaagaagagttttcatgagttattattttctacatgttgtggctgatataaaagcttcccagattctggcatcaagaggagctgaacttttccaggccacaattgtaaaagctgtaaaggcaagaattgaggaagagaagaagtccatggaccagctgaagcgacagatggatcgcatcaaggccaggcaacagaaatataaaaagggtaaggagaggatgctgagcttgacccaggagccaggggaaggccaggacatgcaaaaactctctgaagaggatgatgaaagagaagcagacaaacagaaagccaagggcaaaaaaaagcagtggtggcggccttgggttgatcatgcttccatggtcaggagtggagattattatttgtttgaaacggatagtgaagaggaggaagaggaagaattaaagaaggaagatgaagaacctccacgaaggtcagcattccagtttgtttatcaagcctggattactgatcctaaaacagcactccgacaaagacacaaagagaaaaaaaggtctgcaagagaagaacggaaacgaaggcggaaaggatccaaggagggtcctgtggaatgggaagaccgggaggatgaaccaatcaaaaagaaatccgatggaccagataatatcatcaagaggatatttaatattttgaaatttacctgggtcctatttctggcaacagtggacagtttcactacttggcttaactccatttcaagggagcatattgatatatctacagttctgagaattgaacgatgcatgctgaccagagaaattaagaagggcaatgttccaactcgggagagcatccacatgtactatcagaaccacatcatgaacctttccagagagtcgggactggacaccattgacgagcatcccggagctgcttcaggtgcacagacagcccacaggatggatagtttagattcacatgacagtatctccagcgagcccacgcagtgtaccatgctgtactcacgccaggggaccactgagaccatcgaggaggtggaggctgagcaggaggaggaggcagggagcacggcgcctgagcccagggaggccaaggagtacgaggccactgggtacgatgtgggagccatgggtgccgaggaggccagcctcaccccagaggaagagctgacacagttctccaccttggacggggatgtggaggccccaccctcctacagcaaggctgtgagcttcgagcatctgtccttcggctcgcaggacgactctgcaggcaagaaccgtatggcagtcagcccggacgacagccgcaccgacaagctggggtccagcatcttacctcccctgacccatgagctgacggccagcgagctgctgctgaaaaagatgtttcacgacgatgagcttgaagagtcagagaaattctacgtggggcagccccgatttctgctgctcttctatgccatgtacaataccctggtggcccgctcggagatggtgtgctacttcgtgatcatcctcaaccacatggtctctgcctccatgatcacgctcctgcttcccatcctcatcttcctctgggccatgttgtccgtccccaggcccagccgccggttctggatgatggccatcgtctatactgaggtggcaattgtagtcaagtatttcttccaatttgggttctttccctggaataagaatgtggaggtgaacaaagataaaccgtatcaccccccaaacatcataggagtggaaaagaaggaaggttatgttctctatgacctcatccagctcctggctctgttctttcatcgatcaattttgaagtgccatggcttatgggatgaagatgacatgactgaaagtggcatggccagggaggaatcagatgatgagctctccctcggtcatggcaggagggactcctccgattctctcaagtccatcaacctggccgcgtctgtggagtcagtgcatgtgaccttcccggagcagcagacagctgtccggaggaagcgctccggcagcagctccgagccatcccagagatccagcttttcttcaaacagatcccaaagaggcagcacaagcacccgaaacagcagtcaaaaaggaagcagtgttttgagtattaagcaaaaaggcaaaagggaactttatatggaaaagcttcaagaacatttaatcaaagcaaaagcctttaccataaagaagacgctggagatctatgtgcccatcaaacagttcttttacaacctcatccacccggagtatagcgccgtgactgacgtgtatgtactcatgttcctggctgacactgtggacttcatcatcattgtcttcggcttttgggcctttgggaaacactcagcagctgcagacatcacctcttcactgtcagaggaccaggtcccggggccgtttttggtgatggtcctcattcagtttggaaccatggtggtggaccgagccctctacctcaggaagactgtactgggaaaggtcatcttccaggtcattcttgtgttcggaattcacttctggatgttcttcatcttacctggtgtgactgagaggaaattcagccagaacctggttgcccagctttggtactttgtgaaatgtgtttacttcgggttgtctgcttaccagatccgttgtggctacccaacgcgagtcctggggaacttcctcaccaagagctacaattacgtcaacctcttcttattccaagggtttcgcctcgtgccctttttgactgagctgagggcagtgatggactgggtgtggacggacacaactttgagcctgtccagctggatctgtgtggaggacatctatgctcacatattcatcctgaagtgttggcgggagtcggagaagcctattttcacaatgagtgcccaacaaagccagttgaaagttatggaccagcagagctttaacaaatttatacaagctttttctagggacaccggtgctatgcaatttctggaaaattatgaaaaagaagacataacagtagcagaactggaaggaaactcaaattctttgtggaccatcagcccacccagtaagcagaaaatgatacacgaactcctggaccccaatagtagcttctctgttgttttttcatggagtattcagagaaacttaagtctgggtgcaaaatcggaaatagcaacagataagctttcttttcctcttaaaaatattactcgaaagaatatcgctaaaatgatagcaggcaacagcacagaaagttcaaaaacaccagtgaccatagaaaagatttatccatattatgtgaaagcacctagtgattctaactcaaaacctataaagcaacttttatctgaaaataatttcatggatattaccatcattttgtccagagacaatacaactaaatataacagtgagtggtgggttctcaacctgactggaaacagaatatacaatccgaactctcaggccctggaactggtggtcttcaatgacaaagtcagtcccccaagtctggggttcctggctggctatggtattatgggattatatgcttcagttgtccttgtgattgggaaatttgtccgtgaattcttcagtgggatttctcactccatcatgtttgaagagcttccaaatgtggatcgaattttgaagttgtgcacagatatttttttagttcgagagacaggagaactggagctagaagaagatctctatgccaaattaatattcctatatcgctcaccagagacaatgatcaaatggactagagaaaaaacaaattgaaaccttagaacacagactgcaaataatgttaacatttgaattttttttaaaagcacaatattctcataagagctaagcatttctagttcgacggaaatggtttgtttctcttctgataggtagacaaaaggagctgatatccttctgcagtaaaagctaccttgcaagttaaggcactgttgaaaatgttatttgtaactccatttctctgaaatcagggctacttgctttatgttttagtcaacagtgtctcgcattctgattgatcatgtgaaggaatcatttatgggccccgtccctaagagaaacagaagaggagtcagaaagaaagatgcctgtgttttcctctgtggggcccgtgcacttcctggagagatgctacaatgcaatatacagcgctccatccccactggggaagctgctgtgatgagactagatgagccttcaacacactcagaaaatgcaacagcaatagggggcagacagctcctacctgtgtttctaggagcaaaagagagggaactaattgcccgtgaagacgccagtggaaggatcagcctcattctaagcaaaaacatagtattagtgatactcttactgccttatcttaaccaaggactaataggatacctttccattaaacaccagtgacttctcaggaaaaaaaaaaaaaaggagcaaaacaaatgatgtgtacacctgctttgttatggtccaccagtgaccagcttcaatgaggggaaccattctggagggctgcggtctcctgtgcaaacagacatgaggcagaagagtaaaaagaccaacccagtgggacctagaatactttgtaactctttaataactgaggtcaggaccgctcttctgccttccccttcccttaacgtgctttttcccatttccatgatttaaggcaatggtttttccagtatgtgacattttccttcctgtttttcaggtatatcaaagagtttacatattccaattcacatttttacatctgagacgggttttttaagttcataattatgaaagaaatatgtatattgagcttggggaaataaaaatggccttttcttaaattattattattggtaatacaacctcttcattaaataacaatgtagcatgaaaaatttatgattgaaatgtagttttcattccatattaagatacagtttctgagaagaatcattgaatggactagaatatgtcaaaaattgatcctgtgtagtttgggttcagggctgacttaaaataaagcacatcctgcaaagtcattttaa

SEQ ID NO: 15558 - DNA, 2671 bp, Homo sapiens
  ENST00000538948
atgttaacaattaatcagttcaagttggtcatcttcctagataacctggaccgtaatcttcctagataacctggacatcaggattggtgatggggctgaggggccagtgagtgtgccatggcttatgggatgaagatgacatgactgaaagtggcatggccagggaggaatcagatgatgagctctccctcggtcatggcaggagggactcctccgattctctcaagtccatcaacctggccgcgtctgtggagtcagtgcatgtgaccttcccggagcagcagacagctgtccggaggaagcgctccggcagcagctccgagccatcccagagatccagcttttcttcaaacagatcccaaagaggcagcacaagcacccgaaacagcagtcaaaaaggaagcagtgttttgagtattaagcaaaaaggcaaaagggaactttatatggaaaagcttcaagaacatttaatcaaagcaaaagcctttaccataaagaagacgctggagatctatgtgcccatcaaacagttcttttacaacctcatccacccggagtatagcgccgtgactgacgtgtatgtactcatgttcctggctgacactgtggacttcatcatcattgtcttcggcttttgggcctttgggaaacactcagcagctgcagacatcacctcttcactgtcagaggaccaggtcccggggccgtttttggtgatggtcctcattcagtttggaaccatggtggtggaccgagccctctacctcaggaagactgtactgggaaaggtcatcttccaggtcattcttgtgttcggaattcacttctggatgttcttcatcttacctggtgtgactgagaggaaattcagccagaacctggttgcccagctttggtactttgtgaaatgtgtttacttcgggttgtctgcttaccagatccgttgtggctacccaacgcgagtcctggggaacttcctcaccaagagctacaattacgtcaacctcttcttattccaagggtttcgcctcgtgccctttttgactgagctgagggcagtgatggactgggtgtggacggacacaactttgagcctgtccagctggatctgtgtggaggacatctatgctcacatattcatcctgaagtgttggcgggagtcggagaagagataccctcagccacggggccagaagaagaagaaagtggtgaagtatggcatgggaggaatgatcatcgtcctgctcatctgcattgtctggtttcctcttctcttcatgtctttgatcaaatctgtggctggggtcatcaaccagcccctggacgtctccgtcacaattaccctgggagggtatcagcctattttcacaatgagtgcccaacaaagccagttgaaagttatggaccagcagagctttaacaaatttatacaagctttttctagggacaccggtgctatgcaatttctggaaaattatgaaaaagaagacataacagtagcagaactggaaggaaactcaaattctttgtggaccatcagcccacccagtaagcagaaaatgatacacgaactcctggaccccaatagtagcttctctgttgttttttcatggagtattcagagaaacttaagtctgggtgcaaaatcggaaatagcaacagataagctttcttttcctcttaaaaatattactcgaaagaatatcgctaaaatgatagcaggcaacagcacagaaagttcaaaaacaccagtgaccatagaaaagatttatccatattatgtgaaagcacctagtgattctaactcaaaacctataaagcaacttttatctgaaaataatttcatggatattaccatcattttgtccagagacaatacaactaaatataacagtgagtggtgggttctcaacctgactggaaacagaatatacaatccgaactctcaggccctggaactggtggtcttcaatgacaaagtcagtcccccaagtctggggttcctggctggctatggtattatgggattatatgcttcagttgtccttgtgattgggaaatttgtccgtgaattcttcagtgggatttctcactccatcatgtttgaagagcttccaaatgtggatcgaattttgaagttgtgcacagatatttttttagttcgagagacaggagaactggagctagaagaagatctctatgccaaattaatattcctatatcgctcaccagagacaatgatcaaatggactagagaaaaaacaaattgaaaccttagaacacagactgcaaataatgttaacatttgaattttttttaaaagcacaatattctcataagagctaagcatttctagttcgacggaaatggtttgtttctcttctgataggtagacaaaaggagctgatatccttctgcagtaaaagctaccttgcaagttaaggcactgttgaaaatgttatttgtaactccatttctctgaaatcagggctacttgctttatgttttagtcaacagtgtctcgcattctgattgatcatgtgaaggaatcatttatgggccccgtccctaagagaaacagaagaggagtcagaaagaaagatgcctgtgttttcctctgtggggcccgtgcacttcctggagagatgctacaatgcaatatacagcgctc

SEQ ID NO: 15559 - DNA, 8334 bp, Homo sapiens
  ENST00000580640
atggcctcagaagtggtgtgcgggctcatcttcaggctgctgctgcccatctgcctggcagtagcatgtgcattccgatacaatgggctctcctttgtctaccttatctacctcttgctcattcctctgttctcagaaccaacaaaaacgacgatgcaaggacatacgggacggttattaaagtctctgtgcttcatcagtctttccttcctgttgctgcacatcattttccacatcacgttggtgagccttgaagctcaacatcgtattgcacctggctacaactgctcaacatgggaaaagacattccggcagatcggctttgaaagcttaaagggagctgatgctggcaatgggatcagagtgtttgtacctgacatcgggatgttcattgctagtctgaccatctggctcctctgtagaaacattgttcagaaacctgtgacagacgaagcagcacagagtaacccggagtttgaaaatgaagaattggctgaaggagaaaaaattgattcagaagaggcactgatctatgaagaggatttcaatggaggagatggtgttgaaggcgagttggaagaaagcacgaagttaaaaatgttccgcaggcttgcctctgtggcctctaagctcaaggagttcattggcaacatgatcaccactgctgggaaagtcgttgttaccatcttactgggctcctcgggcatgatgttgccgtctttgacatcatctgtgtatttttttgtatttttgggtctgtgcacctggtggtcctggtgccggacgttcgacccattgctgttcagctgtctctgtgttctgctggctattttcactgctggacatttgattggactttatttataccagttccaattctttcaagaggcagttccacccaatgactactatgcaaggttgtttggtatcaagtcagtaattcaaacggactgttcaagtacttggaagatcatagtgaacccggacctgtcgtggtaccaccacgccaaccctatcctcctgctggtgatgtactacactctggccactctgatccgcatctggctgcaagagccccttgtgcaggatgaggggaccaaagaagaggacaaagccctggcttgtagccccatccaaataacagcggggaggaggcggagcctgtggtacgcaacccattaccccactgatgagagaaaacttttatccatgacccaggatgactacaaaccatctgatggcctgctggtgactgtgaacggcaaccccgtggattaccacaccatccacccaagcctgcccatggagaacggccctggcaaagccgacctctactccacccctcagtaccggtgggagccctctgatgaatcctcagaaaagcgagaggaggaagaggaagagaaagaagaatttgaagaagaaaggagccgtgaggaaaaaagaagtatcaaagttcatgccatggtctccgtattccaatttattatgaaacaaagttacatctgtgccctcatagctatgatggcctggagcatcacctatcacagctggctgaccttcgtgctgctgatctggtcgtgcactctttggatgattcgcaacagaagaaaatatgccatgatcagctctcccttcatggtggtttatggaaacctattgttgatattacagtatatatggagttttgaacttcctgaaattaaaaaagttccaggatttttagaaaagaaagagccaggagaacttgcttccaaaatccttttcaccattactttttggctactgctgaggcagcacctcacagagcaaaaagctctgcaagaaaaggaagctcttttatcggaagtcaaaattggcagtcaggaaaatgaagaaaaagatgaggaacttcaagatatacaagtggaaggagagcccaaagaggaggaagaagaggaagcgaaggaagagaagcaagagagaaagaaggtagagcaagaggaagctgaagaagaagatgagcaggacatcatgaaagtcctgggcaatctggtggtggccatgttcatcaagtactggatctacgtctgcggaggcatgttcttcttcgtcagcttcgagggtaaaatcgtaatgtacaaaatcatctacatggtgctgttcctgttctgtgtggccctataccaggtgcactatgaatggtggaggaaaattctaaaatatttttggatgtcagtggttatttacactatgctggtgcttatctttatatacacatatcagtttgagaacttcccaggcctgtggcaaaatatgactggactgaaaaaagaaaagcttgaggatcttggcttaaagcagtttactgtggctgaactattcactcgcatattcatcccaacctcctttctgctggtgtgcattttacacctgcactacttccatgaccggttccttgaactcacagacctcaagtccattcccagcaaagaagacaacaccatctacagccatgccaaagtcaatggtcgcgtatatctaataataaatagcatcaagaaaaaattaccaatccaccaaaatgaactggcccacccggaaggaagcctcccggacctcaccatgatgcatctgactgccagcctggagaagccggaggtgaggaagttggctgagcctggggaggagaagcttgagggctactctgaaaaagcccagaagggtgatcttgggaaagacagcgaggagtcagaggaggacggagaggaagaggaggaatccgaggaggaggaagaaacatcagacttaaggaacaaatggcacctggtgattgaccgcctcactgtgctcttcttaaaattcctggagtattttcacaagctgcaggtgttcatgtggtggattttggagttgcacatcatcaaaatcgtttcctcttacattatctgggtttctgtgaaagaggtgtctctgttcaactatgtatttttgatttcttgggcttttgctctgccgtacgccaagctgcgccgtctggcttcaagtgtctgcacagtctggacgtgtgtgatcatcgtctgcaaaatgttgtaccagctccaaaccattaagcctgagaacttctctgttaactgttccttgccaaatgaaaatcaaacaaacatcccctttaatgagttgaacaagtctctgctctacagcgctcctatcgatcctacagagtgggtcggcctgcggaagtcttcgcctctgctagtctacctgaggaataacctcctgatgctggctatcctggcctttgaagtcaccatttaccgccatcaggaatactatcgaggtcgaaataacctgacggcccctgtgtctagaactatctttcatgacattacaagactacatctagatgatggacttattaattgtgccaaatatttcattaattacttcttttacaagtttggtctggagacctgtttcctaatgtcagttaacgtcattggccagcgaatggatttctatgccatgatccacgcctgctggctgatcgctgtcttatatagacgcagaaggaaagccatcgcagagatctggcccaagtactgctgcttcctggcatgcatcatcaccttccagtatttcatctgcattggcatcccacctgctccttgccgagattacccgtggagattcaagggtgccagcttcaatgacaacatcataaagtggctgtacttcccagatttcattgtgcggcccaaccctgtgtttctcgtctatgacttcatgctgcttctgtgtgcctccttacaacggcagatttttgaggatgagaacaaggctgcagtgcgaatcatggcaggtgacaatgtcgagatctgcatgaaccttgatgcggcctccttcagccaacataaccctgtgccagattttattcactgcagatcttacttagacatgtccaaagtgatcatcttcagctacctcttctggtttgtgctcaccatcatcttcatcactgggaccaccaggatcagcatcttttgcatggggtacctggtggcctgtttctacttcctgctctttgggggcgatttgctgttgaaacccatcaagagcatcctgcgctactgggactggctgatcgcatacaacgtttttgtgattacgatgaaaaatatcctgtcaataggagcatgtggatacattggaacattggtgcacaatagttgttggttgatccaggctttcagcctggcctgcacagtcaaaggctatcaaatgcctgctgctaattcaccctgtacacttcccagtggggaagcaggaatcatttgggacagcatatgttttgccttcctcctgctgcaaagaagagttttcatgagttattattttctacatgttgtggctgatataaaagcttcccagattctggcatcaagaggagctgaacttttccaggccacaattgtaaaagctgtaaaggcaagaattgaggaagagaagaagtccatggaccagctgaagcgacagatggatcgcatcaaggccaggcaacagaaatataaaaagggtaaggagaggatgctgagcttgacccaggagccaggggaaggccaggacatgcaaaaactctctgaagaggatgatgaaagagaagcagacaaacagaaagccaagggcaaaaaaaagcagtggtggcggccttgggttgatcatgcttccatggtcaggagtggagattattatttgtttgaaacggatagtgaagaggaggaagaggaagaattaaagaaggaagatgaagaacctccacgaaggtcagcattccagtttgtttatcaagcctggattactgatcctaaaacagcactccgacaaagacacaaagagaaaaaaaggtctgcaagagaagaacggaaacgaaggcggaaaggatccaaggagggtcctgtggaatgggaagaccgggaggatgaaccaatcaaaaagaaatccgatggaccagataatatcatcaagaggatatttaatattttgaaatttacctgggtcctatttctggcaacagtggacagtttcactacttggcttaactccatttcaagggagcatattgatatatctacagttctgagaattgaacgatgcatgctgaccagagaaattaagaagggcaatgttccaactcgggagagcatccacatgtactatcagaaccacatcatgaacctttccagagagtcgggactggacaccattgacgagcatcccggagctgcttcaggtgcacagacagcccacaggatggatagtttagattcacatgacagtatctccagcgagcccacgcagtgtaccatgctgtactcacgccaggggaccactgagaccatcgaggaggtggaggctgagcaggaggaggaggcagggagcacggcgcctgagcccagggaggccaaggagtacgaggccactgggtacgatgtgggagccatgggtgccgaggaggccagcctcaccccagaggaagagctgacacagttctccaccttggacggggatgtggaggccccaccctcctacagcaaggctgtgagcttcgagcatctgtccttcggctcgcaggacgactctgcaggcaagaaccgtatggcagtcagcccggacgacagccgcaccgacaagctggggtccagcatcttacctcccctgacccatgagctgacggccagcgagctgctgctgaaaaagatgtttcacgacgatgagcttgaagagtcagagaaattctacgtggggcagccccgatttctgctgctcttctatgccatgtacaataccctggtggcccgctcggagatggtgtgctacttcgtgatcatcctcaaccacatggtctctgcctccatgatcacgctcctgcttcccatcctcatcttcctctgggccatgttgtccgtccccaggcccagccgccggttctggatgatggccatcgtctatactgaggtggcaattgtagtcaagtatttcttccaatttgggttctttccctggaataagaatgtggaggtgaacaaagataaaccgtatcaccccccaaacatcataggagtggaaaagaaggaaggttatgttctctatgacctcatccagctcctggctctgttctttcatcgatcaattttgaagtgccatggcttatgggatgaagatgacatgactgaaagtggcatggccagggaggaatcagatgatgagctctccctcggtcatggcaggagggactcctccgattctctcaagtccatcaacctggccgcgtctgtggagtcagtgcatgtgaccttcccggagcagcagacagctgtccggaggaagcgctccggcagcagctccgagccatcccagagatccagcttttcttcaaacagatcccaaagaggcagcacaagcacccgaaacagcagtcaaaaaggaagcagtgttttgagtattaagcaaaaaggcaaaagggaactttatatggaaaagcttcaagaacatttaatcaaagcaaaagcctttaccataaagaagacgctggagatctatgtgcccatcaaacagttcttttacaacctcatccacccggagtatagcgccgtgactgacgtgtatgtactcatgttcctggctgacactgtggacttcatcatcattgtcttcggcttttgggcctttgggaaacactcagcagctgcagacatcacctcttcactgtcagaggaccaggtcccggggccgtttttggtgatggtcctcattcagtttggaaccatggtggtggaccgagccctctacctcaggaagactgtactgggaaaggtcatcttccaggtcattcttgtgttcggaattcacttctggatgttcttcatcttacctggtgtgactgagaggaaattcagccagaacctggttgcccagctttggtactttgtgaaatgtgtttacttcgggttgtctgcttaccagatccgttgtggctacccaacgcgagtcctggggaacttcctcaccaagagctacaattacgtcaacctcttcttattccaagggtttcgcctcgtgccctttttgactgagctgagggcagtgatggactgggtgtggacggacacaactttgagcctgtccagctggatctgtgtggaggacatctatgctcacatattcatcctgaagtgttggcgggagtcggagaagagataccctcagccacggggccagaagaagaagaaagtggtgaagtatggcatgggaggaatgatcatcgtcctgctcatctgcattgtctggtttcctcttctcttcatgtctttgatcaaatctgtggctggggtcatcaaccagcccctggacgtctccgtcacaattaccctgggagggtatcagcctattttcacaatgagtgcccaacaaagccagttgaaagttatggaccagcagagctttaacaaatttatacaagctttttctagggacaccggtgctatgcaatttctggaaaattatgaaaaagaagacataacagtagcagaactggaaggaaactcaaattctttgtggaccatcagcccacccagtaagcagaaaatgatacacgaactcctggaccccaatagtagcttctctgttgttttttcatggagtattcagagaaacttaagtctgggtgcaaaatcggaaatagcaacagataagctttcttttcctcttaaaaatattactcgaaagaatatcgctaaaatgatagcaggcaacagcacagaaagttcaaaaacaccagtgaccatagaaaagatttatccatattatgtgaaagcacctagtgattctaactcaaaacctataaagcaacttttatctgaaaataatttcatggatattaccatcattttgtccagagacaatacaactaaatataacagtgagtggtgggttctcaacctgactggaaacagaatatacaatccgaactctcaggccctggaactggtggtcttcaatgacaaagtcagtcccccaagtctggggttcctggctggctatggtattatgggattatatgcttcagttgtccttgtgattgggaaatttgtccgtgaattcttcagtgggatttctcactccatcatgtttgaagagcttccaaatgtggatcgaattttgaagttgtgcacagatatttttttagttcgagagacaggagaactggagctagaagaagatctctatgccaaattaatattcctatatcgctcaccagagacaatgatcaaatggactagagaaaaaacaaattga

SEQ ID NO: 15560 - DNA, 8259 bp, Homo sapiens
  ENST00000503781
atggcctcagaagtggtgtgcgggctcatcttcaggctgctgctgcccatctgcctggcagtagcatgtgcattccgatacaatgggctctcctttgtctaccttatctacctcttgctcattcctctgttctcagaaccaacaaaaacgacgatgcaaggacatacgggacggttattaaagtctctgtgcttcatcagtctttccttcctgttgctgcacatcattttccacatcacgttggtgagccttgaagctcaacatcgtattgcacctggctacaactgctcaacatgggaaaagacattccggcagatcggctttgaaagcttaaagggagctgatgctggcaatgggatcagagtgtttgtacctgacatcgggatgttcattgctagtctgaccatctggctcctctgtagaaacattgttcagaaacctgtgacagacgaagcagcacagagtaacccggagtttgaaaatgaagaattggctgaaggagaaaaaattgattcagaagaggcactgatctatgaagaggatttcaatggaggagatggtgttgaaggcgagttggaagaaagcacgaagttaaaaatgttccgcaggcttgcctctgtggcctctaagctcaaggagttcattggcaacatgatcaccactgctgggaaagtcgttgttaccatcttactgggctcctcgggcatgatgttgccgtctttgacatcatctgtgtatttttttgtatttttgggtctgtgcacctggtggtcctggtgccggacgttcgacccattgctgttcagctgtctctgtgttctgctggctattttcactgctggacatttgattggactttatttataccagttccaattctttcaagaggcagttccacccaatgactactatgcaaggttgtttggtatcaagtcagtaattcaaacggactgttcaagtacttggaagatcatagtgaacccggacctgtcgtggtaccaccacgccaaccctatcctcctgctggtgatgtactacactctggccactctgatccgcatctggctgcaagagccccttgtgcaggatgaggggaccaaagaagaggacaaagccctggcttgtagccccatccaaataacagcggggaggaggcggagcctgtggtacgcaacccattaccccactgatgagagaaaacttttatccatgacccaggatgactacaaaccatctgatggcctgctggtgactgtgaacggcaaccccgtggattaccacaccatccacccaagcctgcccatggagaacggccctggcaaagccgacctctactccacccctcagtaccggtgggagccctctgatgaatcctcagaaaagcgagaggaggaagaggaagagaaagaagaatttgaagaagaaaggagccgtgaggaaaaaagaagtatcaaagttcatgccatggtctccgtattccaatttattatgaaacaaagttacatctgtgccctcatagctatgatggcctggagcatcacctatcacagctggctgaccttcgtgctgctgatctggtcgtgcactctttggatgattcgcaacagaagaaaatatgccatgatcagctctcccttcatggtggtttatggaaacctattgttgatattacagtatatatggagttttgaacttcctgaaattaaaaaagttccaggatttttagaaaagaaagagccaggagaacttgcttccaaaatccttttcaccattactttttggctactgctgaggcagcacctcacagagcaaaaagctctgcaagaaaaggaagctcttttatcggaagtcaaaattggcagtcaggaaaatgaagaaaaagatgaggaacttcaagatatacaagtggaaggagagcccaaagaggaggaagaagaggaagcgaaggaagagaagcaagagagaaagaaggtagagcaagaggaagctgaagaagaagatgagcaggacatcatgaaagtcctgggcaatctggtggtggccatgttcatcaagtactggatctacgtctgcggaggcatgttcttcttcgtcagcttcgagggtaaaatcgtaatgtacaaaatcatctacatggtgctgttcctgttctgtgtggccctataccaggtgcactatgaatggtggaggaaaattctaaaatatttttggatgtcagtggttatttacactatgctggtgcttatctttatatacacatatcagtttgagaacttcccaggcctgtggcaaaatatgactggactgaaaaaagaaaagcttgaggatcttggcttaaagcagtttactgtggctgaactattcactcgcatattcatcccaacctcctttctgctggtgtgcattttacacctgcactacttccatgaccggttccttgaactcacagacctcaagtccattcccagcaaagaagacaacaccatctacagactggcccacccggaaggaagcctcccggacctcaccatgatgcatctgactgccagcctggagaagccggaggtgaggaagttggctgagcctggggaggagaagcttgagggctactctgaaaaagcccagaagggtgatcttgggaaagacagcgaggagtcagaggaggacggagaggaagaggaggaatccgaggaggaggaagaaacatcagacttaaggaacaaatggcacctggtgattgaccgcctcactgtgctcttcttaaaattcctggagtattttcacaagctgcaggtgttcatgtggtggattttggagttgcacatcatcaaaatcgtttcctcttacattatctgggtttctgtgaaagaggtgtctctgttcaactatgtatttttgatttcttgggcttttgctctgccgtacgccaagctgcgccgtctggcttcaagtgtctgcacagtctggacgtgtgtgatcatcgtctgcaaaatgttgtaccagctccaaaccattaagcctgagaacttctctgttaactgttccttgccaaatgaaaatcaaacaaacatcccctttaatgagttgaacaagtctctgctctacagcgctcctatcgatcctacagagtgggtcggcctgcggaagtcttcgcctctgctagtctacctgaggaataacctcctgatgctggctatcctggcctttgaagtcaccatttaccgccatcaggaatactatcgaggtcgaaataacctgacggcccctgtgtctagaactatctttcatgacattacaagactacatctagatgatggacttattaattgtgccaaatatttcattaattacttcttttacaagtttggtctggagacctgtttcctaatgtcagttaacgtcattggccagcgaatggatttctatgccatgatccacgcctgctggctgatcgctgtcttatatagacgcagaaggaaagccatcgcagagatctggcccaagtactgctgcttcctggcatgcatcatcaccttccagtatttcatctgcattggcatcccacctgctccttgccgagattacccgtggagattcaagggtgccagcttcaatgacaacatcataaagtggctgtacttcccagatttcattgtgcggcccaaccctgtgtttctcgtctatgacttcatgctgcttctgtgtgcctccttacaacggcagatttttgaggatgagaacaaggctgcagtgcgaatcatggcaggtgacaatgtcgagatctgcatgaaccttgatgcggcctccttcagccaacataaccctgtgccagattttattcactgcagatcttacttagacatgtccaaagtgatcatcttcagctacctcttctggtttgtgctcaccatcatcttcatcactgggaccaccaggatcagcatcttttgcatggggtacctggtggcctgtttctacttcctgctctttgggggcgatttgctgttgaaacccatcaagagcatcctgcgctactgggactggctgatcgcatacaacgtttttgtgattacgatgaaaaatatcctgtcaataggagcatgtggatacattggaacattggtgcacaatagttgttggttgatccaggctttcagcctggcctgcacagtcaaaggctatcaaatgcctgctgctaattcaccctgtacacttcccagtggggaagcaggaatcatttgggacagcatatgttttgccttcctcctgctgcaaagaagagttttcatgagttattattttctacatgttgtggctgatataaaagcttcccagattctggcatcaagaggagctgaacttttccaggccacaattgtaaaagctgtaaaggcaagaattgaggaagagaagaagtccatggaccagctgaagcgacagatggatcgcatcaaggccaggcaacagaaatataaaaagggtaaggagaggatgctgagcttgacccaggagccaggggaaggccaggacatgcaaaaactctctgaagaggatgatgaaagagaagcagacaaacagaaagccaagggcaaaaaaaagcagtggtggcggccttgggttgatcatgcttccatggtcaggagtggagattattatttgtttgaaacggatagtgaagaggaggaagaggaagaattaaagaaggaagatgaagaacctccacgaaggtcagcattccagtttgtttatcaagcctggattactgatcctaaaacagcactccgacaaagacacaaagagaaaaaaaggtctgcaagagaagaacggaaacgaaggcggaaaggatccaaggagggtcctgtggaatgggaagaccgggaggatgaaccaatcaaaaagaaatccgatggaccagataatatcatcaagaggatatttaatattttgaaatttacctgggtcctatttctggcaacagtggacagtttcactacttggcttaactccatttcaagggagcatattgatatatctacagttctgagaattgaacgatgcatgctgaccagagaaattaagaagggcaatgttccaactcgggagagcatccacatgtactatcagaaccacatcatgaacctttccagagagtcgggactggacaccattgacgagcatcccggagctgcttcaggtgcacagacagcccacaggatggatagtttagattcacatgacagtatctccagcgagcccacgcagtgtaccatgctgtactcacgccaggggaccactgagaccatcgaggaggtggaggctgagcaggaggaggaggcagggagcacggcgcctgagcccagggaggccaaggagtacgaggccactgggtacgatgtgggagccatgggtgccgaggaggccagcctcaccccagaggaagagctgacacagttctccaccttggacggggatgtggaggccccaccctcctacagcaaggctgtgagcttcgagcatctgtccttcggctcgcaggacgactctgcaggcaagaaccgtatggcagtcagcccggacgacagccgcaccgacaagctggggtccagcatcttacctcccctgacccatgagctgacggccagcgagctgctgctgaaaaagatgtttcacgacgatgagcttgaagagtcagagaaattctacgtggggcagccccgatttctgctgctcttctatgccatgtacaataccctggtggcccgctcggagatggtgtgctacttcgtgatcatcctcaaccacatggtctctgcctccatgatcacgctcctgcttcccatcctcatcttcctctgggccatgttgtccgtccccaggcccagccgccggttctggatgatggccatcgtctatactgaggtggcaattgtagtcaagtatttcttccaatttgggttctttccctggaataagaatgtggaggtgaacaaagataaaccgtatcaccccccaaacatcataggagtggaaaagaaggaaggttatgttctctatgacctcatccagctcctggctctgttctttcatcgatcaattttgaagtgccatggcttatgggatgaagatgacatgactgaaagtggcatggccagggaggaatcagatgatgagctctccctcggtcatggcaggagggactcctccgattctctcaagtccatcaacctggccgcgtctgtggagtcagtgcatgtgaccttcccggagcagcagacagctgtccggaggaagcgctccggcagcagctccgagccatcccagagatccagcttttcttcaaacagatcccaaagaggcagcacaagcacccgaaacagcagtcaaaaaggaagcagtgttttgagtattaagcaaaaaggcaaaagggaactttatatggaaaagcttcaagaacatttaatcaaagcaaaagcctttaccataaagaagacgctggagatctatgtgcccatcaaacagttcttttacaacctcatccacccggagtatagcgccgtgactgacgtgtatgtactcatgttcctggctgacactgtggacttcatcatcattgtcttcggcttttgggcctttgggaaacactcagcagctgcagacatcacctcttcactgtcagaggaccaggtcccggggccgtttttggtgatggtcctcattcagtttggaaccatggtggtggaccgagccctctacctcaggaagactgtactgggaaaggtcatcttccaggtcattcttgtgttcggaattcacttctggatgttcttcatcttacctggtgtgactgagaggaaattcagccagaacctggttgcccagctttggtactttgtgaaatgtgtttacttcgggttgtctgcttaccagatccgttgtggctacccaacgcgagtcctggggaacttcctcaccaagagctacaattacgtcaacctcttcttattccaagggtttcgcctcgtgccctttttgactgagctgagggcagtgatggactgggtgtggacggacacaactttgagcctgtccagctggatctgtgtggaggacatctatgctcacatattcatcctgaagtgttggcgggagtcggagaagagataccctcagccacggggccagaagaagaagaaagtggtgaagtatggcatgggaggaatgatcatcgtcctgctcatctgcattgtctggtttcctcttctcttcatgtctttgatcaaatctgtggctggggtcatcaaccagcccctggacgtctccgtcacaattaccctgggagggtatcagcctattttcacaatgagtgcccaacaaagccagttgaaagttatggaccagcagagctttaacaaatttatacaagctttttctagggacaccggtgctatgcaatttctggaaaattatgaaaaagaagacataacagtagcagaactggaaggaaactcaaattctttgtggaccatcagcccacccagtaagcagaaaatgatacacgaactcctggaccccaatagtagcttctctgttgttttttcatggagtattcagagaaacttaagtctgggtgcaaaatcggaaatagcaacagataagctttcttttcctcttaaaaatattactcgaaagaatatcgctaaaatgatagcaggcaacagcacagaaagttcaaaaacaccagtgaccatagaaaagatttatccatattatgtgaaagcacctagtgattctaactcaaaacctataaagcaacttttatctgaaaataatttcatggatattaccatcattttgtccagagacaatacaactaaatataacagtgagtggtgggttctcaacctgactggaaacagaatatacaatccgaactctcaggccctggaactggtggtcttcaatgacaaagtcagtcccccaagtctggggttcctggctggctatggtattatgggattatatgcttcagttgtccttgtgattgggaaatttgtccgtgaattcttcagtgggatttctcactccatcatgtttgaagagcttccaaatgtggatcgaattttgaagttgtgcacagatatttttttagttcgagagacaggagaactggagctagaagaagatctctatgccaaattaatattcctatatcgctcaccagagacaatgatcaaatggactagagaaaaaacaaattga

SEQ ID NO: 15561 - DNA, 8465 bp, Homo sapiens
  ENST00000582913
atggcctcagaagtggtgtgcgggctcatcttcaggctgctgctgcccatctgcctggcagtagcatgtgcattccgatacaatgggctctcctttgtctaccttatctacctcttgctcattcctctgttctcagaaccaacaaaaacgacgatgcaaggacatacgggacggttattaaagtctctgtgcttcatcagtctttccttcctgttgctgcacatcattttccacatcacgttggtgagccttgaagctcaacatcgtattgcacctggctacaactgctcaacatgggaaaagacattccggcagatcggctttgaaagcttaaagggagctgatgctggcaatgggatcagagtgtttgtacctgacatcgggatgttcattgctagtctgaccatctggctcctctgtagaaacattgttcagaaacctgtgacagacgaagcagcacagagtaacccggagtttgaaaatgaagaattggctgaaggagaaaaaattgattcagaagaggcactgatctatgaagaggatttcaatggaggagatggtgttgaaggcgagttggaagaaagcacgaagttaaaaatgttccgcaggcttgcctctgtggcctctaagctcaaggagttcattggcaacatgatcaccactgctgggaaagtcgttgttaccatcttactgggctcctcgggcatgatgttgccgtctttgacatcatctgtgtatttttttgtatttttgggtctgtgcacctggtggtcctggtgccggacgttcgacccattgctgttcagctgtctctgtgttctgctggctattttcactgctggacatttgattggactttatttataccagttccaattctttcaagaggcagttccacccaatgactactatgcaaggttgtttggtatcaagtcagtaattcaaacggactgttcaagtacttggaagatcatagtgaacccggacctgtcgtggtaccaccacgccaaccctatcctcctgctggtgatgtactacactctggccactctgatccgcatctggctgcaagagccccttgtgcaggatgaggggaccaaagaagaggacaaagccctggcttgtagccccatccaaataacagcggggaggaggcggagcctgtggtacgcaacccattaccccactgatgagagaaaacttttatccatgacccaggatgactacaaaccatctgatggcctgctggtgactgtgaacggcaaccccgtggattaccacaccatccacccaagcctgcccatggagaacggccctggcaaagccgacctctactccacccctcagtaccggtgggagccctctgatgaatcctcagaaaagcgagaggaggaagaggaagagaaagaagaatttgaagaagaaaggagccgtgaggaaaaaagaagtatcaaagttcatgccatggtctccgtattccaatttattatgaaacaaagttacatctgtgccctcatagctatgatggcctggagcatcacctatcacagctggctgaccttcgtgctgctgatctggtcgtgcactctttggatgattcgcaacagaagaaaatatgccatgatcagctctcccttcatggtggtttatggaaacctattgttgatattacagtatatatggagttttgaacttcctgaaattaaaaaagttccaggatttttagaaaagaaagagccaggagaacttgcttccaaaatccttttcaccattactttttggctactgctgaggcagcacctcacagagcaaaaagctctgcaagaaaaggaagctcttttatcggaagtcaaaattggcagtcaggaaaatgaagaaaaagatgaggaacttcaagatatacaagtggaaggagagcccaaagaggaggaagaagaggaagcgaaggaagagaagcaagagagaaagaaggtagagcaagaggaagctgaagaagaagatgagcaggacatcatgaaagtcctgggcaatctggtggtggccatgttcatcaagtactggatctacgtctgcggaggcatgttcttcttcgtcagcttcgagggtaaaatcgtaatgtacaaaatcatctacatggtgctgttcctgttctgtgtggccctataccaggtgcactatgaatggtggaggaaaattctaaaatatttttggatgtcagtggttatttacactatgctggtgcttatctttatatacacatatcagtttgagaacttcccaggcctgtggcaaaatatgactggactgaaaaaagaaaagcttgaggatcttggcttaaagcagtttactgtggctgaactattcactcgcatattcatcccaacctcctttctgctggtgtgcattttacacctgcactacttccatgaccggttccttgaactcacagacctcaagtccattcccagcaaagaagacaacaccatctacagccatgccaaagtcaatggtcgcgtatatctaataataaatagactggcccacccggaaggaagcctcccggacctcaccatgatgcatctgactgccagcctggagaagccggaggtgaggaagttggctgagcctggggaggagaagcttgagggctactctgaaaaagcccagaagggtgatcttgggaaagacagcgaggagtcagaggaggacggagaggaagaggaggaatccgaggaggaggaagaaacatcagacttaaggaacaaatggcacctggtgattgaccgcctcactgtgctcttcttaaaattcctggagtattttcacaagctgcaggtgttcatgtggtggattttggagttgcacatcatcaaaatcgtttcctcttacattatctgggtttctgtgaaagaggtgtctctgttcaactatgtatttttgatttcttgggcttttgctctgccgtacgccaagctgcgccgtctggcttcaagtgtctgcacagtctggacgtgtgtgatcatcgtctgcaaaatgttgtaccagctccaaaccattaagcctgagaacttctctgttaactgttccttgccaaatgaaaatcaaacaaacatcccctttaatgagttgaacaagtctctgctctacagcgctcctatcgatcctacagagtgggtcggcctgcggaagtcttcgcctctgctagtctacctgaggaataacctcctgatgctggctatcctggcctttgaagtcaccatttaccgccatcaggaatactatcgaggtcgaaataacctgacggcccctgtgtctagaactatctttcatgacattacaagactacatctagatgatggacttattaattgtgccaaatatttcattaattacttcttttacaagtttggtctggagacctgtttcctaatgtcagttaacgtcattggccagcgaatggatttctatgccatgatccacgcctgctggctgatcgctgtcttatatagacgcagaaggaaagccatcgcagagatctggcccaagtactgctgcttcctggcatgcatcatcaccttccagtatttcatctgcattggcatcccacctgctccttgccgagattacccgtggagattcaagggtgccagcttcaatgacaacatcataaagtggctgtacttcccagatttcattgtgcggcccaaccctgtgtttctcgtctatgacttcatgctgcttctgtgtgcctccttacaacggcagatttttgaggatgagaacaaggctgcagtgcgaatcatggcaggtgacaatgtcgagatctgcatgaaccttgatgcggcctccttcagccaacataaccctgtgccagattttattcactgcagatcttacttagacatgtccaaagtgatcatcttcagctacctcttctggtttgtgctcaccatcatcttcatcactgggaccaccaggatcagcatcttttgcatggggtacctggtggcctgtttctacttcctgctctttgggggcgatttgctgttgaaacccatcaagagcatcctgcgctactgggactggctgatcgcatacaacgtttttgtgattacgatgaaaaatatcctgtcaataggagcatgtggatacattggaacattggtgcacaatagttgttggttgatccaggctttcagcctggcctgcacagtcaaaggctatcaaatgcctgctgctaattcaccctgtacacttcccagtggggaagcaggaatcatttgggacagcatatgttttgccttcctcctgctgcaaagaagagttttcatgagttattattttctacatgttgtggctgatataaaagcttcccagattctggcatcaaggtggctgaacttttccaggccacaattgtaaaagctgtaaaggcaagaattgaggaagagaagaagtccatggaccagctgaagcgacagatggatcgcatcaaggccaggcaacagaaatataaaaagggtaaggagaggatgctgagcttgacccaggagccaggggaaggccaggacatgcaaaaactctctgaagaggatgatgaaagagaagcagacaaacagaaagccaagggcaaaaaaaagcagtggtggcggccttgggttgatcatgcttccatggtcaggagtggagattattatttgtttgaaacggatagtgaagaggaggaagaggaagaattaaagaaggaagatgaagaacctccacgaaggtcagcattccagtttgtttatcaagcctggattactgatcctaaaacagcactccgacaaagacacaaagagaaaaaaaggtctgcaagagaagaacggaaacgaaggcggaaaggatccaaggagggtcctgtggaatgggaagaccgggaggatgaaccaatcaaaaagaaatccgatggaccagataatatcatcaagaggatatttaatattttgaaatttacctgggtcctatttctggcaacagtggacagtttcactacttggcttaactccatttcaagggagcatattgatatatctacagttctgagaattgaacgatgcatgctgaccagagaaattaagaagggcaatgttccaactcgggagagcatccacatgtactatcagaaccacatcatgaacctttccagagagtcgggactggacaccattgacgagcatcccggagctgcttcaggtgcacagacagcccacaggatggatagtttagattcacatgacagtatctccagctgctacactgaagcaaccatgctgttctcaaggcagtccacccttgatgatttagatggacaagaaattcctaaaacaagcgagcgtgctcggcctaggctccgtaaaatgctcagcatggatatgtcctcctcatcagctgacagtggcagtttagcatcaagcgagcccacgcagtgtaccatgctgtactcacgccaggggaccactgagaccatcgaggaggtggaggctgagcaggaggaggaggcagggagcacggcgcctgagcccagggaggccaaggagtacgaggccactgggtacgatgtgggagccatgggtgccgaggaggccagcctcaccccagaggaagagctgacacagttctccaccttggacggggatgtggaggccccaccctcctacagcaaggctgtgagcttcgagcatctgtccttcggctcgcaggacgactctgcaggcaagaaccgtatggcagtcagcccggacgacagccgcaccgacaagctggggtccagcatcttacctcccctgacccatgagctgacggccagcgagctgctgctgaaaaagatgtttcacgacgatgagcttgaagagtcagagaaattctacgtggggcagccccgatttctgctgctcttctatgccatgtacaataccctggtggcccgctcggagatggtgtgctacttcgtgatcatcctcaaccacatggtctctgcctccatgatcacgctcctgcttcccatcctcatcttcctctgggccatgttgtccgtccccaggcccagccgccggttctggatgatggccatcgtctatactgaggtggcaattgtagtcaagtatttcttccaatttgggttctttccctggaataagaatgtggaggtgaacaaagataaaccgtatcaccccccaaacatcataggagtggaaaagaaggaaggttatgttctctatgacctcatccagctcctggctctgttctttcatcgatcaattttgaagtgccatggcttatgggatgaagatgacatgactgaaagtggcatggccagggaggaatcagatgatgagctctccctcggtcatggcaggagggactcctccgattctctcaagtccatcaacctggccgcgtctgtggagtcagtgcatgtgaccttcccggagcagcagacagctgtccggaggaagcgctccggcagcagctccgagccatcccagagatccagcttttcttcaaacagatcccaaagaggcagcacaagcacccgaaacagcagtcaaaaaggaagcagtgttttgagtattaagcaaaaaggcaaaagggaactttatatggaaaagcttcaagaacatttaatcaaagcaaaagcctttaccataaagaagacgctggagatctatgtgcccatcaaacagttcttttacaacctcatccacccggagtatagcgccgtgactgacgtgtatgtactcatgttcctggctgacactgtggacttcatcatcattgtcttcggcttttgggcctttgggaaacactcagcagctgcagacatcacctcttcactgtcagaggaccaggtcccggggccgtttttggtgatggtcctcattcagtttggaaccatggtggtggaccgagccctctacctcaggaagactgtactgggaaaggtcatcttccaggtcattcttgtgttcggaattcacttctggatgttcttcatcttacctggtgtgactgagaggaaattcagccagaacctggttgcccagctttggtactttgtgaaatgtgtttacttcgggttgtctgcttaccagatccgttgtggctacccaacgcgagtcctggggaacttcctcaccaagagctacaattacgtcaacctcttcttattccaagggtttcgcctcgtgccctttttgactgagctgagggcagtgatggactgggtgtggacggacacaactttgagcctgtccagctggatctgtgtggaggacatctatgctcacatattcatcctgaagtgttggcgggagtcggagaagagataccctcagccacggggccagaagaagaagaaagtggtgaagtatggcatgggaggaatgatcatcgtcctgctcatctgcattgtctggtttcctcttctcttcatgtctttgatcaaatctgtggctggggtcatcaaccagcccctggacgtctccgtcacaattaccctgggagggtatcagcctattttcacaatgagtgcccaacaaagccagttgaaagttatggaccagcagagctttaacaaatttatacaagctttttctagggacaccggtgctatgcaatttctggaaaattatgaaaaagaagacataacagtagcagaactggaaggaaactcaaattctttgtggaccatcagcccacccagtaagcagaaaatgatacacgaactcctggaccccaatagtagcttctctgttgttttttcatggagtattcagagaaacttaagtctgggtgcaaaatcggaaatagcaacagataagctttcttttcctcttaaaaatattactcgaaagaatatcgctaaaatgatagcaggcaacagcacagaaagttcaaaaacaccagtgaccatagaaaagatttatccatattatgtgaaagcacctagtgattctaactcaaaacctataaagcaacttttatctgaaaataatttcatggatattaccatcattttgtccagagacaatacaactaaatataacagtgagtggtgggttctcaacctgactggaaacagaatatacaatccgaactctcaggccctggaactggtggtcttcaatgacaaagtcagtcccccaagtctggggttcctggctggctatggtattatgggattatatgcttcagttgtccttgtgattgggaaatttgtccgtgaattcttcagtgggatttctcactccatcatgtttgaagagcttccaaatgtggatcgaattttgaagttgtgcacagatatttttttagttcgagagacaggagaactggagctagaagaagatctctatgccaaattaatattcctatatcgctcaccagagacaatgatcaaatggactagagaaaaaacaaattga

SEQ ID NO: 15562 - DNA, 563 bp, Homo sapiens
  ENST00000581680
gcaatttctggaaaattatgaaaaagaagacataacagtagcagaactggaaggaaactcaaattctttgtggaccatcagcccacccaaaacttaagtctgggtgcaaaatcggaaatagcaacagataagctttcttttcctcttaaaaatattactcgaaagaatatcgctaaaatgatagcaggcaacagcacagaaagttcaaaaacaccagtgaccatagaaaagatttatccatattatgtgaaagcacctagtgattctaactcaaaacctataaagcaacttttatctgaaaataatttcatggatattaccatcattttgtccagagacaatacaactaaatataacagtgagtggtgggttctcaacctgactggaaacagaatatacaatccgaactctcaggccctggaactggtggtcttcaatgacaaagtcagtcccccaagtctggggttcctggctggctatggtattatgggattatatgcttcagttgtccttgtgattgggaaatttgtccgtgaattcttcagtgggatttctcactccat

SEQ ID NO: 15563 - DNA, 600 bp, Homo sapiens
  ENST00000579151
aaagccagttgaaagttatggaccagcagagctttaacaaatttatacaagctttttctagggacaccggtgctatgcaatttctggaaaattatgaaaaagaagacataacagtagcagaactggaaggaaactcaaattctttgtggaccatcagcccacccagtaagcagaaaatgatacacgaactcctggaccccaatagtagcttctctgttgttttttcatggagtattcagagaaacttaagtctgggtgcaaaatcggaaatagcaacagataagctttcttttcctcttaaaaatattactcgaaagaatatcgctaaaatgatagcaggcaacagcacagaaagttcaaaaacaccagtgtaagtgtattttttcctactaatagagctttgttaggtatatgcagctggtacaaaatgtccatctacagattcatgtgtatgaggaatgcaacttcattctttggtaacacaaagttaatttctatttggaggccccattttgcaagattaaagaaacttaatctcagctatggagttttctgtccactgtccccagggttatgtctatgttccaaatgagggtttgg

SEQ ID NO: 15564 - DNA, 3682 bp, Homo sapiens
  ENST00000579949
tataaaagcttcccagattctggcatcaagaggagctgaacttttccaggccacaattgtaaaagctgtaaaggcaagaattgaggaagagaagaagtccatggaccagctgaagcgacagatggatcgcatcaaggccaggcaacagaaatataaaaagggtaaggagaggatgctgagcttgacccaggagccaggggaaggccaggacatgcaaaaactctctgaagaggatgatgaaagagaagcagacaaacagaaagccaagggcaaaaaaaagcagtggtggcggccttgggttgatcatgcttccagtaggttttctcgatccccttacaacctcatcgactctaacccttatatccttgaccagaattcaggcgttcccgtgacccatgtgttccatgcatggtttgatccttgtgacttgatagggggtcggagtgtaggaaaattttaatgtcagtgggtctttgagcccggggtccaattcttccagagacatcagcacagacgttctgacattcttgtgctggctgtagaaagccaaacacgtggcttatagactctagggcataatttatgggctcagaaagggaagaagaattgaatattatattgcccaattctgaggtcgagagccctattcacatacatattttatggctaaatacccttactaaaaatgagcttgggctccaccttggactctgatttaaggatgatcattctattcaaagggtcagtgaccctttctctgtaaggcactaggcatggatgccagtgagcctcccctcccctcattcccacagctttgattttatttgcatttaaggatttttggcaatttattaaatagaaagatgagggataacttaaaatgcactcactttcttactacgcctcctccccaatttcaaaaaggcactctaaattccaatgcccacatgtggcacagccttcaagccacctgatgctcagagacgaccaatgaacagcaaaaaccagaaaactatttttaaaagcagatcctgatagccacatagaatgcagtgtgtttccctcctgatcataaagatgaatgaggaattctggaactcagtggctatatttgctctgcttagcaaagaaaatatcactataggtcgatgggattatagtggaatgccccattccaatccagtcctctttaaatttcatagaatattgaataattattattttgcaagttacgtataatgtcgtcttcagtctttacatgatgtctccatacttgcagctaatctaactggacaaggaatatcactgagacaaataacatcacacaattgtaggagtgaatctactaggaggatatttagaatcactaggaaatcaaataaagtagaacttcttcccatacctaattattggtttcacatagatctgacgttggcctctctctcccaagacataattttctaaatcggcaagctagtttttaataaagcaatatttgaaatttgcttggtatatctggatgtaatcaaatttaatcccaaatattgaatttcaacattacaacaaaaaaagaaaaacacaagattagaaagagttttatttaattttctccccaagtccaaagacaaaagattccagtcggagtccagtgtgactcttctatttactgttcagggtatgacagtcacgctaacaatctggtaaatgcagtgcacaaatgcctatttctatcaagtcacaagtaaactgtgcttttctttatgtttttaaagggcctctgctaatttagagagacctatccatttcaaaattgtgtcatattgaatgttttttcacctcacctggggtaaattcccaccgcggtcattgtggttgcctttcctttcctcatgtaaaaatcgcatttgcaaaggaattggatatggtctgtgataactatcttacaagttgtaataatataaagaacttcctgtgaatgttgttgactttagattttctggttcatttcaccctcattatatcaagttattgaagattgatgttaaactacatgtgccttgttacaaaaccttatgatgcaataatgcagaaatgtgtgtaattcatagtttggaatcatattcagactgtggtgttaaattttttgctgcaaaatgtatttctttttacaagtgaatgaagaatgaaagggaaagaatgtgtgctgtattgttgtgtctatgatgagttccagaatttatctttagatctggaagtactttgttggaagcccttaatttgatcttttgagtaactgggctttcaaacagctatttcttagagaagccaagtgtaagaattagtgtagttggatacacatgtgtaaatctattgacaatacaaaaatgttgctatgttcttgatgttattagtaagcagtgaagattttagcatggtctgtatagggacagatttcctacttccatacctatgtacacacacaagattgcattattgctgttcaatgataccttccattccaataccttatgtttcaatattggttcagtactgcctaaattaataccaagcttcatcttattgataaatatctgaaacagaaggccaagttctgaggataaaagtagtggaatttaaaaagttaatttccaacttagtaatttagcagtaacatcaacatccatgatatgtatgtggacacaggctggagtcaggttcgccatctgagctaacaaacacgtgtgtaagagcttttctactcactaatttaacagatggcatgaatgaaaatgtgctctgtcattttcctagtttcatttcaataacattttataaggaaataagagacttttttacattttcttttttcttatgtgataattccactagctcacataaatattggtggtttctaatggtaaaatcaatgttaccactgcttgagatgaaaaccttttgaacttgtccatatgaataaaagttatcgaaggtatgattgaatacaatttaagctaatgttgattttggaacctataatgagggtaaaattctcgatcttataatagtctgtgttttcccaaacgaccacgtgatgtagagtccacatcactttcctgcaaatctctcggcttatgtgaaggcattactttaatggtcttcttcactatcaaatgtaatgctgtaactttggtttgttcttgcttattctcacttgtgttgtattgcatttatttcccaaggcctggacccagtactctgggcctggttctttcttcaaaatgaaaataacgaatgacagtgcttctgttcaaggatataaggcccaattcacccactgtgtatcttcatgaatggaggcttcagatttttctgaaatcgtgggcaaaattacttaacttttggccatgtgaagtgatattcaagcaattaattttaaacaagccaaggttttccattaccttacaatgtataggcccaaaagacaacttaagatcaaaatatgtcatccaaaagatgcctgagcatttgaaaacctgaatataatttgaaaatatgttttcctgcgatgatgggacattgcttgtagcatcagaaatgtatatgttgggcctcttttctctggtagactttaaataatgatcaaactgataaagatttaatttattaaatttccttaaatctc

SEQ ID NO: 15565 - DNA, 702 bp, Homo sapiens
  ENST00000578145
agccggaggtgaggaagttggctgagcctggggaggagaagcttgagggctactctgaaaaagcccagaagggtgatcttgggaaagacagcgaggagtcagaggaggacggagaggaagaggaggaatccgaggaggaggaagaaacatcagacttaaggaacaaatggcacctggtgattgaccgcctcactgtgctcttcttaaaattcctggagtattttcacaagctgcaggtgttcatgtggtggattttggagttgcacatcatcaaaatcgtttcctcttacattatctgggtttctgtgaaagaggcaagtgaacatttgtcctatcatcaggctgaacagaaccacagtaggtcatcattttccttttccagctgtccatgatttttttaatgtgatccgcattacatcggagtatcaagactccaagactaagtacttacacttacagaaatccgagggtcagcagcactgagaaaaaggaaagaggctcgtggctgagtttctcgttggcttggtcatattacaaaggctacttattttcatcgaatccttagggaagagtgtgagagcaggctgcccttctgcccctgcctatgggaatctatctccctaaattctccaaggaaaacagtagcattccagtttacattaccaaggagaaagctcaggttccaaaatctaataaaatctt

SEQ ID NO: 15566 - DNA, 1021 bp, Homo sapiens
  ENST00000583325
caaccacggaccagcacctcaaggaagaccacctgttgcagctgatttcctgcccaggtggaagttgttagaaaggttgggttcatcttcctcaggacttgcgtggtgcttctggcacccaacacaaacatgggagcatcctcggaaaagggacttaaaagcagtgaatctcagctgaagtcaagcagatccttttcaccattactttttggctactgctgaggcagcacctcacagagcaaaaagctctgcaagaaaaggaagctcttttatcggaagtcaaaattggcagtcaggaaaatgaagaaaaagatgaggaacttcaagatatacaagtggaaggagagcccaaagaggaggaagaagaggaagcgaaggaagagaagcaagagagaaagaaggtagagcaagaggaagctgaagaagaagatgagcaggacatcatgaaagtcctgggcaatctggtggtggccatgttcatcaagtactggatctacgtctgcggaggcatgttcttcttcgtcagcttcgagggtaaaatcgtaatgtacaaaatcatctacatggtgctgttcctgttctgtgtggccctataccaggtgcactatgaatggtggaggaaaattctaaaatatttttggatgtcagtggttatttacactatgctggtgcttatctttatatacacatatcagtttgagaacttcccaggcctgtggcaaaatatgactggactgaaaaaagaaaagcttgaggatcttggcttaaagcagtttactgtggctgaactattcactcgcatattcatcccaacctcctttctgctggtgtgcattttacacctgcactacttccatgaccggttccttgaactcacagacctcaagtccattcccagcaaagaagacaacaccatctacagactggcccacccggaaggaagcctcccggacctcaccatgatgcatctgactgccagcctggagaagccggaggtgaggaagttggctgagcctgggga

SEQ ID NO: 15567 - DNA, 532 bp, Homo sapiens
  ENST00000579112
cactgctggacatttgattggactttatttataccagttccaattctttcaagaggcagttccacccaatgactactatgcaaggttgtttggtatcaagtcagtaattcaaacggactgttcaagtacttggaagatcatagtgaacccggacctgtcgtggtaccaccacgccaaccctatcctcctgctggtgatgtactacactctggccactctgatccgcatctggctgcaagagccccttgtgcaggatgaggggaccaaagaagaggacaaagccctggcttgtagccccatccaaataacagcggggaggaggcggagcctgtggtacgcaacccattaccccactgatgagagaaaaggcctgctggtgactgtgaacggcaaccccgtggattaccacaccatccacccaagcctgcccatggagaacggccctggcaaagccgacctctactccacccctcagtaccggtgggagccctctgatgaatcctcagaaaagcgagaggaggaagaggaagag

SEQ ID NO: 15568 - DNA, 523 bp, Homo sapiens
  ENST00000579899
ctggtgggaggtaattgaatcattggggcagttacctccatgctgttctcgtgataacgagtgagttctcatgagatctgatggttttctaaggggattttcccccacttcacactgcacgtctcttgctgcctccatgtgaagaaggatgtgtttgcttcttcttctgccatgattttaagtttcctgaggcctccccagccatgctgaactcttaaagggagctgatgctggcaatgggatcagagtgtttgtacctgacatcgggatgttcattgctagtctgaccatctggctcctctgtagaaacattgttcagaaacctgtgacagacgaagcagcacagagtaacccggagtttgaaaatgaagaattggctgaaggagaaaaaattgattcagaagaggcactgatctatgaagaggatttcaatggaggagatggtgttgaaggcgagttggaagaaagcacgaagttaaaaatgttccgcaggcttgcctctgtggcctctaagctcaaggag

SEQ ID NO: 15569 - DNA, 9718 bp, Homo sapiens
  ENST00000383408
gccccgggagcgtgccctcggggcggagagcgtcgcggcccgcgccgaggcgatgctcgggtggctgcgagctgccggcggcgagaggccatagacgggcatgggccttgcgtcccaccacccctagggaccctcgagcctcgcccctctgctccgactcgccggaccgacgcgatggcctcagaagtggtgtgcgggctcatcttcaggctgctgctgcccatctgcctggcagtagcatgtgcattccgatacaatgggctctcctttgtctaccttatctacctcttgctcattcctctgttctcagaaccaacaaaaacgacgatgcaaggacatacgggacggttattaaagtctctgtgcttcatcagtctttccttcctgttgctgcacatcattttccacatcacgttggtgagccttgaagctcaacatcgtattgcacctggctacaactgctcaacatgggaaaagacattccggcagatcggctttgaaagcttaaagggagctgatgctggcaatgggatcagagtgtttgtacctgacatcgggatgttcattgctagtctgaccatctggctcctctgtagaaacattgttcagaaacctgtgacagacgaagcagcacagagtaacccggagtttgaaaatgaagaattggctgaaggagaaaaaattgattcagaagaggcactgatctatgaagaggatttcaatggaggagatggtgttgaaggcgagttggaagaaagcacgaagttaaaaatgttccgcaggcttgcctctgtggcctctaagctcaaggagttcattggcaacatgatcaccactgctgggaaagtcgttgttaccatcttactgggctcctcgggcatgatgttgccgtctttgacatcatctgtgtatttttttgtatttttgggtctgtgcacctggtggtcctggtgccggacgttcgacccattgctgttcagctgtctctgtgttctgctggctattttcactgctggacatttgattggactttatttataccagttccaattctttcaagaggcagttccacccaatgactactatgcaaggttgtttggtatcaagtcagtaattcaaacggactgttcaagtacttggaagatcatagtgaacccggacctgtcgtggtaccaccacgccaaccctatcctcctgctggtgatgtactacactctggccactctgatccgcatctggctgcaagagccccttgtgcaggatgaggggaccaaagaagaggacaaagccctggcttgtagccccatccaaataacagcggggaggaggcggagcctgtggtacgcaacccattaccccactgatgagagaaaacttttatccatgacccaggatgactacaaaccatctgatggcctgctggtgactgtgaacggcaaccccgtggattaccacaccatccacccaagcctgcccatggagaacggccctggcaaagccgacctctactccacccctcagtaccggtgggagccctctgatgaatcctcagaaaagcgagaggaggaagaggaagagaaagaagaatttgaagaagaaaggagccgtgaggaaaaaagaagtatcaaagttcatgccatggtctccgtattccaatttattatgaaacaaagttacatctgtgccctcatagctatgatggcctggagcatcacctatcacagctggctgaccttcgtgctgctgatctggtcgtgcactctttggatgattcgcaacagaagaaaatatgccatgatcagctctcccttcatggtggtttatggaaacctattgttgatattacagtatatatggagttttgaacttcctgaaattaaaaaagttccaggatttttagaaaagaaagagccaggagaacttgcttccaaaatccttttcaccattactttttggctactgctgaggcagcacctcacagagcaaaaagctctgcaagaaaaggaagctcttttatcggaagtcaaaattggcagtcaggaaaatgaagaaaaagatgaggaacttcaagatatacaagtggaaggagagcccaaagaggaggaagaagaggaagcgaaggaagagaagcaagagagaaagaaggtagagcaagaggaagctgaagaagaagatgagcaggacatcatgaaagtcctgggcaatctggtggtggccatgttcatcaagtactggatctacgtctgcggaggcatgttcttcttcgtcagcttcgagggtaaaatcgtaatgtacaaaatcatctacatggtgctgttcctgttctgtgtggccctataccaggtgcactatgaatggtggaggaaaattctaaaatatttttggatgtcagtggttatttacactatgctggtgcttatctttatatacacatatcagtttgagaacttcccaggcctgtggcaaaatatgactggactgaaaaaagaaaagcttgaggatcttggcttaaagcagtttactgtggctgaactattcactcgcatattcatcccaacctcctttctgctggtgtgcattttacacctgcactacttccatgaccggttccttgaactcacagacctcaagtccattcccagcaaagaagacaacaccatctacagactggcccacccggaaggaagcctcccggacctcaccatgatgcatctgactgccagcctggagaagccggaggtgaggaagttggctgagcctggggaggagaagcttgagggctactctgaaaaagcccagaagggtgatcttgggaaagacagcgaggagtcagaggaggacggagaggaagaggaggaatccgaggaggaggaagaaacatcagacttaaggaacaaatggcacctggtgattgaccgcctcactgtgctcttcttaaaattcctggagtattttcacaagctgcaggtgttcatgtggtggattttggagttgcacatcatcaaaatcgtttcctcttacattatctgggtttctgtgaaagaggcaagggtgtctctgttcaactatgtatttttgatttcttgggcttttgctctgccgtacgccaagctgcgccgtctggcttcaagtgtctgcacagtctggacgtgtgtgatcatcgtctgcaaaatgttgtaccagctccaaaccattaagcctgagaacttctctgttaactgttccttgccaaatgaaaatcaaacaaacatcccctttaatgagttgaacaagtctctgctctacagcgctcctatcgatcctacagagtgggtcggcctgcggaagtcttcgcctctgctagtctacctgaggaataacctcctgatgctggctatcctggcctttgaagtcaccatttaccgccatcaggaatactatcgaggtcgaaataacctgacggcccctgtgtctagaactatctttcatgacattacaagactacatctagatgatggacttattaattgtgccaaatatttcattaattacttcttttacaagtttggtctggagacctgtttcctaatgtcagttaacgtcattggccagcgaatggatttctatgccatgatccacgcctgctggctgatcgctgtcttatatagacgcagaaggaaagccatcgcagagatctggcccaagtactgctgcttcctggcatgcatcatcaccttccagtatttcatctgcattggcatcccacctgctccttgccgagattacccgtggagattcaagggtgccagcttcaatgacaacatcataaagtggctgtacttcccagatttcattgtgcggcccaaccctgtgtttctcgtctatgacttcatgctgcttctgtgtgcctccttacaacggcagatttttgaggatgagaacaaggctgcagtgcgaatcatggcaggtgacaatgtcgagatctgcatgaaccttgatgcggcctccttcagccaacataaccctgtgccagattttattcactgcagatcttacttagacatgtccaaagtgatcatcttcagctacctcttctggtttgtgctcaccatcatcttcatcactgggaccaccaggatcagcatcttttgcatggggtacctggtggcctgtttctacttcctgctctttgggggcgatttgctgttgaaacccatcaagagcatcctgcgctactgggactggctgatcgcatacaacgtttttgtgattacgatgaaaaatatcctgtcaataggagcatgtggatacattggaacattggtgcacaatagttgttggttgatccaggctttcagcctggcctgcacagtcaaaggctatcaaatgcctgctgctaattcaccctgtacacttcccagtggggaagcaggaatcatttgggacagcatatgttttgccttcctcctgctgcaaagaagagttttcatgagttattattttctacatgttgtggctgatataaaagcttcccagattctggcatcaagaggagctgaacttttccaggccacaattgtaaaagctgtaaaggcaagaattgaggaagagaagaagtccatggaccagctgaagcgacagatggatcgcatcaaggccaggcaacagaaatataaaaagggtaaggagaggatgctgagcttgacccaggagccaggggaaggccaggacatgcaaaaactctctgaagaggatgatgaaagagaagcagacaaacagaaagccaagggcaaaaaaaagcagtggtggcggccttgggttgatcatgcttccatggtcaggagtggagattattatttgtttgaaacggatagtgaagaggaggaagaggaagaattaaagaaggaagatgaagaacctccacgaaggtcagcattccagtttgtttatcaagcctggattactgatcctaaaacagcactccgacaaagacacaaagagaaaaaaaggtctgcaagagaagaacggaaacgaaggcggaaaggatccaaggagggtcctgtggaatgggaagaccgggaggatgaaccaatcaaaaagaaatccgatggaccagataatatcatcaagaggatatttaatattttgaaatttacctgggtcctatttctggcaacagtggacagtttcactacttggcttaactccatttcaagggagcatattgatatatctacagttctgagaattgaacgatgcatgctgaccagagaaattaagaagggcaatgttccaactcgggagagcatccacatgtactatcagaaccacatcatgaacctttccagagagtcgggactggacaccattgacgagcatcccggagctgcttcaggtgcacagacagcccacaggatggatagtttagattcacatgacagtatctccagcgagcccacgcagtgtaccatgctgtactcacgccaggggaccactgagaccatcgaggaggtggaggctgagcaggaggaggaggcagggagcacggcgcctgagcccagggaggccaaggagtacgaggccactgggtacgatgtgggagccatgggtgccgaggaggccagcctcaccccagaggaagagctgacacagttctccaccttggacggggatgtggaggccccaccctcctacagcaaggctgtgagcttcgagcatctgtccttcggctcgcaggacgactctgcaggcaagaaccgtatggcagtcagcccggacgacagccgcaccgacaagctggggtccagcatcttacctcccctgacccatgagctgacggccagcgagctgctgctgaaaaagatgtttcacgacgatgagcttgaagagtcagagaaattctacgtggggcagccccgatttctgctgctcttctatgccatgtacaataccctggtggcccgctcggagatggtgtgctacttcgtgatcatcctcaaccacatggtctctgcctccatgatcacgctcctgcttcccatcctcatcttcctctgggccatgttgtccgtccccaggcccagccgccggttctggatgatggccatcgtctatactgaggtggcaattgtagtcaagtatttcttccaatttgggttctttccctggaataagaatgtggaggtgaacaaagataaaccgtatcaccccccaaacatcataggagtggaaaagaaggaaggttatgttctctatgacctcatccagctcctggctctgttctttcatcgatcaattttgaagtgccatggcttatgggatgaagatgacatgactgaaagtggcatggccagggaggaatcagatgatgagctctccctcggtcatggcaggagggactcctccgattctctcaagtccatcaacctggccgcgtctgtggagtcagtgcatgtgaccttcccggagcagcagacagctgtccggaggaagcgctccggcagcagctccgagccatcccagagatccagcttttcttcaaacagatcccaaagaggcagcacaagcacccgaaacagcagtcaaaaaggaagcagtgttttgagtattaagcaaaaaggcaaaagggaactttatatggaaaagcttcaagaacatttaatcaaagcaaaagcctttaccataaagaagacgctggagatctatgtgcccatcaaacagttcttttacaacctcatccacccggagtatagcgccgtgactgacgtgtatgtactcatgttcctggctgacactgtggacttcatcatcattgtcttcggcttttgggcctttgggaaacactcagcagctgcagacatcacctcttcactgtcagaggaccaggtcccggggccgtttttggtgatggtcctcattcagtttggaaccatggtggtggaccgagccctctacctcaggaagactgtactgggaaaggtcatcttccaggtcattcttgtgttcggaattcacttctggatgttcttcatcttacctggtgtgactgagaggaaattcagccagaacctggttgcccagctttggtactttgtgaaatgtgtttacttcgggttgtctgcttaccagatccgttgtggctacccaacgcgagtcctggggaacttcctcaccaagagctacaattacgtcaacctcttcttattccaagggtttcgcctcgtgccctttttgactgagctgagggcagtgatggactgggtgtggacggacacaactttgagcctgtccagctggatctgtgtggaggacatctatgctcacatattcatcctgaagtgttggcgggagtcggagaagagataccctcagccacggggccagaagaagaagaaagtggtgaagtatggcatgggaggaatgatcatcgtcctgctcatctgcattgtctggtttcctcttctcttcatgtctttgatcaaatctgtggctggggtcatcaaccagcccctggacgtctccgtcacaattaccctgggagggtatcagcctattttcacaatgagtgcccaacaaagccagttgaaagttatggaccagcagagctttaacaaatttatacaagctttttctagggacaccggtgctatgcaatttctggaaaattatgaaaaagaagacataacagtagcagaactggaaggaaactcaaattctttgtggaccatcagcccacccagtaagcagaaaatgatacacgaactcctggaccccaatagtagcttctctgttgttttttcatggagtattcagagaaacttaagtctgggtgcaaaatcggaaatagcaacagataagctttcttttcctcttaaaaatattactcgaaagaatatcgctaaaatgatagcaggcaacagcacagaaagttcaaaaacaccagtgaccatagaaaagatttatccatattatgtgaaagcacctagtgattctaactcaaaacctataaagcaacttttatctgaaaataatttcatggatattaccatcattttgtccagagacaatacaactaaatataacagtgagtggtgggttctcaacctgactggaaacagaatatacaatccgaactctcaggccctggaactggtggtcttcaatgacaaagtcagtcccccaagtctggggttcctggctggctatggtattatgggattatatgcttcagttgtccttgtgattgggaaatttgtccgtgaattcttcagtgggatttctcactccatcatgtttgaagagcttccaaatgtggatcgaattttgaagttgtgcacagatatttttttagttcgagagacaggagaactggagctagaagaagatctctatgccaaattaatattcctatatcgctcaccagagacaatgatcaaatggactagagaaaaaacaaattgaaaccttagaacacagactgcaaataatgttaacatttgaattttttttaaaagcacaatattctcataagagctaagcatttctagttcgacggaaatggtttgtttctcttctgataggtagacaaaaggagctgatatccttctgcagtaaaagctaccttgcaagttaaggcactgttgaaaatgttatttgtaactccatttctctgaaatcagggctacttgctttatgttttagtcaacagtgtctcgcattctgattgatcatgtgaaggaatcatttatgggccccgtccctaagagaaacagaagaggagtcagaaagaaagatgcctgtgttttcctctgtggggcccgtgcacttcctggagagatgctacaatgcaatatacagcgctccatccccactggggaagctgctgtgatgagactagatgagccttcaacacactcagaaaatgcaacagcaatagggggcagacagctcctacctgtgtttctaggagcaaaagagagggaactaattgcccgtgaagacgccagtggaaggatcagcctcattctaagcaaaaacatagtattagtgatactcttactgccttatcttaaccaaggactaataggatacctttccattaaacaccagtgacttctcaggaaaaaaaaaaaaaaggagcaaaacaaatgatgtgtacacctgctttgttatggtccaccagtgaccagcttcaatgaggggaaccattctggagggctgcggtctcctgtgcaaacagacatgaggcagaagagtaaaaagaccaacccagtgggacctagaatactttgtaactctttaataactgaggtcaggaccgctcttctgccttccccttcccttaacgtgctttttcccatttccatgatttaaggcaatggtttttccagtatgtgacattttccttcctgtttttcaggtatatcaaagagtttacatattccaattcacatttttacatctgagacgggttttttaagttcataattatgaaagaaatatgtatattgagcttggggaaataaaaatggccttttcttaaattattattattggtaatacaacctcttcattaaataacaatgtagcatgaaaaatttatgattgaaatgtagttttcattccatattaagatacagtttctgagaagaatcattgaatggactagaatatgtcaaaaattgatcctgtgtagtttgggttcagggctgacttaaaataaagcacatcctgcaaagtc

SEQ ID NO: 15570 - DNA, 3652 bp, Homo sapiens
  ENST00000333590
attggtgctgcggaacagcagggagggactccggctgcagccgcgggaggtccggacactggcggccatggaactcaccggtaatagaggacacatctcttaactgggttgctctaagaactgatgtctaaaccgtctcagcatggcctgtagaggaggagctgggaatggccaccgtgcctcagctacactctctcgggttagccctggaagtctttacacatgtagaacccgtacccataatatatgcatggtatctgactttttctacccaaatatgggaggcgtggaaagccacatttaccagctctctcagtgcctgattgaaagagggcataaggttataattgtcacccatgcttatggaaatcgaaaaggcatccgttacctcaccagtggcctcaaagtctattacttgcctctgaaagtcatgtacaaccagtctacagccacgaccctctttcacagtctgccattgctcaggtacatatttgttcgggagagagtcacgataatccattcacatagttctttttctgctatggcccatgatgctctcttccacgccaagacaatggggcttcagacagtcttcacggaccattccctttttggatttgctgatgtcagctcggtgcttacaaacaagcttctaaccgtgtctctttgtgatacaaaccacatcatttgtgtgtcttatactagtaaggaaaatactgtactaagagcagcactgaatcctgaaatagtgtccgtcattcctaatgctgtagatcctactgacttcactccagacccatttagaaggcatgatagtataactattgttgttgtcagcagacttgtttacagaaaagggatcgatttgcttagtggtataatacctgaactctgtcagaaatatccagatttaaatttcataattggaggagagggaccaaagagaatcattttggaagaagttcgggaaagataccagctgcatgacagggtgcgtcttttgggagctttagaacacaaggatgttagaaatgtcttagttcaaggacatatttttctgaatacctcccttactgaagcattctgcatggcgatcgtggaagcagccagttgtggtttacaggttgtaagtaccagagttggtggaattcctgaggtgcttccagaaaaccttattattttatgtgagccttcagtaaaatctttgtgtgaaggattggaaaaggctattttccaactgaagtcagggacattgccagctccagaaaacatccataacatagtaaagactttctacacctggaggaatgttgcagaaagaactgaaaaggtatatgaccgggtatcagtggaagctgtgttgccaatggacaaacgactggacagacttatttctcactgcggcccagtaacaggctacatctttgctttgttggcagttttcaacttcctcttcctcattttcttgagatggatgactccagattctatcattgatgttgcaatagatgccactgggccacggggtgcctggactaataactattctcacagtaaaagagggggtgagaataatgagatatctgaaaccaggtagaaggaagcctagattgtaagattttaaacatttgtaatagttctataaagactatggaaaataaccttgcttttggggggtttttgtttttttagagttaatttagtaagttatgctacctctatatcattcaatattttctgttgaggaaagataaaaatgtatgcaattcctgagtgtagaaacttcttgcacttatttaaaatttaggagagaacatttaagccactcaggtatgcaatttttcagactactgaaatccctgtagcagagatgttttaacattatattttgagagctttgggtgctgaagggccaaacgttttctgggcattttttggccagtttttaatgtaacaccattagacactcaccagatgtttacaagttttctttaggggaactacaacaattatatgaactgttttatatcatgttcatatacatttattaggaatctaaatcatgtctttgaacatttattaggttcactcagtaggtgttacatgtaattaacaggttccttgagtaagatagtccatcagttaccagcacattttgaacccctgctctgtgtagaatgttgaactagatgcttcccgccattaaggaccaggggtgcattcactctttgtttaccattcaaatggcttacttcatcataattgtggttgatatgagatcaatatccaacatgccaaaaatgctcatgccagttaatgccaggaaaaaaatcaccgacacactactagtactttgttcctgttgtatgcattctcctaggtagagcctccatcttcagttgtgtttgtgaaggtattttttgctttttaaatactggggaccgatatcactgttgatagtgcagagaaaccctccacatttttcagtgcataattgagttttctataaatgccttcgtgttttctgagcagaatgtacgaggtgtgccatcccaaaaccagctgctaccctgtccttttaatgtaagtcactccccttcactgtggcctcgctgatgtctgataagtattgtcagtgtgcaaaaggctttacttcagaatggtttatttatagcaaactaagttgaaaattttagaaacagtctttgtgggtggatgttattaactgtcattgttgttgcccagagccatgggttttttaaccccaaattatccacatggtgtgtattatgaattctttgaactcttaaggtttttgtgagaaaaggactgtgaattcaaaacaataaggcacttgtgggtgcactacatagattctgacagtgttgtgattctgtataggatttttaaaaatgacaacattcacaaaatttattactttttaaaaaataacatgcctattaactggttgcactgatataaaagaaatatatttgtgttttgtttgtactaaaatgcaaaagcaagagtgcaatttttaaaatctagaagttaggggttttgttggagaaaaatggactgatctttaaactattcagtcttactgggatttttatgcatagaaactcacatataaacatgaaataaacagtgccagtattcataggaaagtgagaaactgtaatatttggccattattctattcaacaggttttagaggcatgccaccattttttccttatatttttgcttaatttttttaaattgtcatttaattcttaaactgtcatttatttgagatggaaataagatctaaagttagttgcctttgcctgtaaaacatgtgatttgcaaattattatttttcttttttttaacaaatggaagtaaatttgtttcacgtaaatcttaattttcaacctttctggataccttaattgtaactgtcagtttgcactggtcggtatatggaaacacattgctctaccctgctacttagttgattttaaagtgaatttacagtgatgagaaatttgtgaaaaatatattgtatttcttttgatgtttcaaaaggttgcctatgaaaaactgatttgttaaaacatgctacatgtccaaaaataaagaccagaatgacattttgataattttc

SEQ ID NO: 15571 - DNA, 2850 bp, Homo sapiens
  ENST00000635631
cctgatgctgttaaatttcagatctttttaaaaattaaaacagccctgcacatgtgggatcgatttgcttagtggtataatacctgaactctgtcagaaatatccagatttaaatttcataattggaggagagggaccaaagagaatcattttggaagaagttcgggaaagataccagctgcatgacagggtgcgtcttttgggagctttagaacacaaggatgttagaaatgtcttagttcaaggacatatttttctgaatacctcccttactgaagcattctgcatggcgatcgtggaagcagccagttgtggtttacaggttgtaagtaccagagttggtggaattcctgaggtgcttccagaaaaccttattattttatgtgagccttcagtaaaatctttgtgtgaaggattggaaaaggctattttccaactgaagtcagggacattgccagctccagaaaacatccataacatagtaaagactttctacacctggaggaatgttgcagaaagaactgaaaaggtatatgaccgggtatcagtggaagctgtgttgccaatggacaaacgactggacagacttatttctcactgcggcccagtaacaggctacatctttgctttgttggcagttttcaacttcctcttcctcattttcttgagatggatgactccagattctatcattgatgttgcaatagatgccactgggccacggggtgcctggactaataactattctcacagtaaaagagggggtgagaataatgagatatctgaaaccaggtagaaggaagcctagattgtaagattttaaacatttgtaatagttctataaagactatggaaaataaccttgcttttggggggtttttgtttttttagagttaatttagtaagttatgctacctctatatcattcaatattttctgttgaggaaagataaaaatgtatgcaattcctgagtgtagaaacttcttgcacttatttaaaatttaggagagaacatttaagccactcaggtatgcaatttttcagactactgaaatccctgtagcagagatgttttaacattatattttgagagctttgggtgctgaagggccaaacgttttctgggcattttttggccagtttttaatgtaacaccattagacactcaccagatgtttacaagttttctttaggggaactacaacaattatatgaactgttttatatcatgttcatatacatttattaggaatctaaatcatgtctttgaacatttattaggttcactcagtaggtgttacatgtaattaacaggttccttgagtaagatagtccatcagttaccagcacattttgaacccctgctctgtgtagaatgttgaactagatgcttcccgccattaaggaccaggggtgcattcactctttgtttaccattcaaatggcttacttcatcataattgtggttgatatgagatcaatatccaacatgccaaaaatgctcatgccagttaatgccaggaaaaaaatcaccgacacactactagtactttgttcctgttgtatgcattctcctaggtagagcctccatcttcagttgtgtttgtgaaggtattttttgctttttaaatactggggaccgatatcactgttgatagtgcagagaaaccctccacatttttcagtgcataattgagttttctataaatgccttcgtgttttctgagcagaatgtacgaggtgtgccatcccaaaaccagctgctaccctgtccttttaatgtaagtcactccccttcactgtggcctcgctgatgtctgataagtattgtcagtgtgcaaaaggctttacttcagaatggtttatttatagcaaactaagttgaaaattttagaaacagtctttgtgggtggatgttattaactgtcattgttgttgcccagagccatgggttttttaaccccaaattatccacatggtgtgtattatgaattctttgaactcttaaggtttttgtgagaaaaggactgtgaattcaaaacaataaggcacttgtgggtgcactacatagattctgacagtgttgtgattctgtataggatttttaaaaatgacaacattcacaaaatttattactttttaaaaaataacatgcctattaactggttgcactgatataaaagaaatatatttgtgttttgtttgtactaaaatgcaaaagcaagagtgcaatttttaaaatctagaagttaggggttttgttggagaaaaatggactgatctttaaactattcagtcttactgggatttttatgcatagaaactcacatataaacatgaaataaacagtgccagtattcataggaaagtgagaaactgtaatatttggccattattctattcaacaggttttagaggcatgccaccattttttccttatatttttgcttaatttttttaaattgtcatttaattcttaaactgtcatttatttgagatggaaataagatctaaagttagttgcctttgcctgtaaaacatgtgatttgcaaattattatttttcttttttttaacaaatggaagtaaatttgtttcacgtaaatcttaattttcaacctttctggataccttaattgtaactgtcagtttgcactggtcggtatatggaaacacattgctctaccctgctacttagttgattttaaagtgaatttacagtgatgagaaatttgtgaaaaatatattgtatttcttttgatgtttcaaaaggttgcctatgaaaaactgatttgttaaaacatgctacatgtccaaaaataaagaccagaatgacattttgataatttt

SEQ ID NO: 15572 - DNA, 3626 bp, Homo sapiens
  ENST00000542278
ggatcgtggcgggtggtggagggggtgaaaccgacccggttcgaagcccggaagttgggtaatagaggacacatctcttaactgggttgctctaagaactgatgtctaaaccgtctcagcatggcctgtagaggaggagctgggaatggccaccgtgcctcagctacactctctcgggttagccctggaagtctttacacatgtagaacccgtacccataatatatgcatggtatctgactttttctacccaaatatgggaggcgtggaaagccacatttaccagctctctcagtgcctgattgaaagagggcataaggttataattgtcacccatgcttatggaaatcgaaaaggcatccgttacctcaccagtggcctcaaagtctattacttgcctctgaaagtcatgtacaaccagtctacagccacgaccctctttcacagtctgccattgctcaggtacatatttgttcgggagagagtcacgataatccattcacatagttctttttctgctatggcccatgatgctctcttccacgccaagacaatggggcttcagacagtcttcacggaccattccctttttggatttgctgatgtcagctcggtgcttacaaacaagcttctaaccgtgtctctttgtgatacaaaccacatcatttgtgtgtcttatactagtaaggaaaatactgtactaagagcagcactgaatcctgaaatagtgtccgtcattcctaatgctgtagatcctactgacttcactccagacccatttagaaggcatgatagtataactattgttgttgtcagcagacttgtttacagaaaagggatcgatttgcttagtggtataatacctgaactctgtcagaaatatccagatttaaatttcataattggaggagagggaccaaagagaatcattttggaagaagttcgggaaagataccagctgcatgacagggtgcgtcttttgggagctttagaacacaaggatgttagaaatgtcttagttcaaggacatatttttctgaatacctcccttactgaagcattctgcatggcgatcgtggaagcagccagttgtggtttacaggttgtaagtaccagagttggtggaattcctgaggtgcttccagaaaaccttattattttatgtgagccttcagtaaaatctttgtgtgaaggattggaaaaggctattttccaactgaagtcagggacattgccagctccagaaaacatccataacatagtaaagactttctacacctggaggaatgttgcagaaagaactgaaaaggtatatgaccgggtatcagtggaagctgtgttgccaatggacaaacgactggacagacttatttctcactgcggcccagtaacaggctacatctttgctttgttggcagttttcaacttcctcttcctcattttcttgagatggatgactccagattctatcattgatgttgcaatagatgccactgggccacggggtgcctggactaataactattctcacagtaaaagagggggtgagaataatgagatatctgaaaccaggtagaaggaagcctagattgtaagattttaaacatttgtaatagttctataaagactatggaaaataaccttgcttttggggggtttttgtttttttagagttaatttagtaagttatgctacctctatatcattcaatattttctgttgaggaaagataaaaatgtatgcaattcctgagtgtagaaacttcttgcacttatttaaaatttaggagagaacatttaagccactcaggtatgcaatttttcagactactgaaatccctgtagcagagatgttttaacattatattttgagagctttgggtgctgaagggccaaacgttttctgggcattttttggccagtttttaatgtaacaccattagacactcaccagatgtttacaagttttctttaggggaactacaacaattatatgaactgttttatatcatgttcatatacatttattaggaatctaaatcatgtctttgaacatttattaggttcactcagtaggtgttacatgtaattaacaggttccttgagtaagatagtccatcagttaccagcacattttgaacccctgctctgtgtagaatgttgaactagatgcttcccgccattaaggaccaggggtgcattcactctttgtttaccattcaaatggcttacttcatcataattgtggttgatatgagatcaatatccaacatgccaaaaatgctcatgccagttaatgccaggaaaaaaatcaccgacacactactagtactttgttcctgttgtatgcattctcctaggtagagcctccatcttcagttgtgtttgtgaaggtattttttgctttttaaatactggggaccgatatcactgttgatagtgcagagaaaccctccacatttttcagtgcataattgagttttctataaatgccttcgtgttttctgagcagaatgtacgaggtgtgccatcccaaaaccagctgctaccctgtccttttaatgtaagtcactccccttcactgtggcctcgctgatgtctgataagtattgtcagtgtgcaaaaggctttacttcagaatggtttatttatagcaaactaagttgaaaattttagaaacagtctttgtgggtggatgttattaactgtcattgttgttgcccagagccatgggttttttaaccccaaattatccacatggtgtgtattatgaattctttgaactcttaaggtttttgtgagaaaaggactgtgaattcaaaacaataaggcacttgtgggtgcactacatagattctgacagtgttgtgattctgtataggatttttaaaaatgacaacattcacaaaatttattactttttaaaaaataacatgcctattaactggttgcactgatataaaagaaatatatttgtgttttgtttgtactaaaatgcaaaagcaagagtgcaatttttaaaatctagaagttaggggttttgttggagaaaaatggactgatctttaaactattcagtcttactgggatttttatgcatagaaactcacatataaacatgaaataaacagtgccagtattcataggaaagtgagaaactgtaatatttggccattattctattcaacaggttttagaggcatgccaccattttttccttatatttttgcttaatttttttaaattgtcatttaattcttaaactgtcatttatttgagatggaaataagatctaaagttagttgcctttgcctgtaaaacatgtgatttgcaaattattatttttcttttttttaacaaatggaagtaaatttgtttcacgtaaatcttaattttcaacctttctggataccttaattgtaactgtcagtttgcactggtcggtatatggaaacacattgctctaccctgctacttagttgattttaaagtgaatttacagtgatgagaaatttgtgaaaaatatattgtatttcttttgatgtttcaaaaggttgcctatgaaaaactgatttgttaaaacatgctacatgtccaaaaataaagaccagaatgacattttgataat

SEQ ID NO: 15573 - DNA, 3738 bp, Homo sapiens
  ENST00000635045
actggcggccatggaactcaccggtaatagaggacacatctcttaactgggttgctctaagaactgatgtctaaaccgtctcagcatggcctgtagaggaggagctgggaatggccaccgtgcctcagctacactctctcgggttagccctggaagtctttacacatgtagaacccgtacccataatatatgcatggtatctgactttttctacccaaatatgggaggcgtggaaagccacatttaccagctctctcagtgcctgattgaaagagggcataaggttataattgtcacccatgcttatggaaatcgaaaaggcatccgttacctcaccagtggcctcaaagtctattacttgcctctgaaagtcatgtacaaccagtctacagccacgaccctctttcacagtctgccattgctcaggtacatatttgttcgggagagagtcacgataatccattcacatagttctttttctgctatggcccatgatgctctcttccacgccaagacaatggggcttcagacagtcttcacggaccattccctttttggatttgctgatgtcagctcggtgcttacaaacaagcttctaaccgtgtctctttgtgatacaaaccacatcatttgtgtgtcttatactagtaaggaaaatactgtactaagagcagcactgaatcctgaaatagtgtccgtcattcctaatgctgtagatcctactgacttcactccagacccatttagaaggcatgatagtataactattgttgttgtcagcagacttgtttacagaaaagggatcgatttgcttagtggtataatacctgaactctgtcagaaatatccagatttaaatttcataattggaggagagggaccaaagagaatcattttggaagaagttcgggaaagataccagctgcatgacagggtgcgtcttttgggagctttagaacacaaggatgttagaaatgtcttagttcaaggacatatttttctgaatacctcccttactgaagcattctgcatggcgatcgtggaagcagccagttgtggtttacaggtaaaaagctttgagggcattcatggttgggatttctgtgtattttgaaaaataatgagacacattccataataatgttttaactggttttgttgatcttcctgaggtatgattatggtggagtatgtgttctttctttctttttaaggttgtaagtaccagagttggtggaattcctgaggtgcttccagaaaaccttattattttatgtgagccttcagtaaaatctttgtgtgaaggattggaaaaggctattttccaactgaagtcagggacattgccagctccagaaaacatccataacatagtaaagactttctacacctggaggaatgttgcagaaagaactgaaaaggtatatgaccgggtatcagtggaagctgtgttgccaatggacaaacgactggacagacttatttctcactgcggcccagtaacaggctacatctttgctttgttggcagttttcaacttcctcttcctcattttcttgagatggatgactccagattctatcattgatgttgcaatagatgccactgggccacggggtgcctggactaataactattctcacagtaaaagagggggtgagaataatgagatatctgaaaccaggtagaaggaagcctagattgtaagattttaaacatttgtaatagttctataaagactatggaaaataaccttgcttttggggggtttttgtttttttagagttaatttagtaagttatgctacctctatatcattcaatattttctgttgaggaaagataaaaatgtatgcaattcctgagtgtagaaacttcttgcacttatttaaaatttaggagagaacatttaagccactcaggtatgcaatttttcagactactgaaatccctgtagcagagatgttttaacattatattttgagagctttgggtgctgaagggccaaacgttttctgggcattttttggccagtttttaatgtaacaccattagacactcaccagatgtttacaagttttctttaggggaactacaacaattatatgaactgttttatatcatgttcatatacatttattaggaatctaaatcatgtctttgaacatttattaggttcactcagtaggtgttacatgtaattaacaggttccttgagtaagatagtccatcagttaccagcacattttgaacccctgctctgtgtagaatgttgaactagatgcttcccgccattaaggaccaggggtgcattcactctttgtttaccattcaaatggcttacttcatcataattgtggttgatatgagatcaatatccaacatgccaaaaatgctcatgccagttaatgccaggaaaaaaatcaccgacacactactagtactttgttcctgttgtatgcattctcctaggtagagcctccatcttcagttgtgtttgtgaaggtattttttgctttttaaatactggggaccgatatcactgttgatagtgcagagaaaccctccacatttttcagtgcataattgagttttctataaatgccttcgtgttttctgagcagaatgtacgaggtgtgccatcccaaaaccagctgctaccctgtccttttaatgtaagtcactccccttcactgtggcctcgctgatgtctgataagtattgtcagtgtgcaaaaggctttacttcagaatggtttatttatagcaaactaagttgaaaattttagaaacagtctttgtgggtggatgttattaactgtcattgttgttgcccagagccatgggttttttaaccccaaattatccacatggtgtgtattatgaattctttgaactcttaaggtttttgtgagaaaaggactgtgaattcaaaacaataaggcacttgtgggtgcactacatagattctgacagtgttgtgattctgtataggatttttaaaaatgacaacattcacaaaatttattactttttaaaaaataacatgcctattaactggttgcactgatataaaagaaatatatttgtgttttgtttgtactaaaatgcaaaagcaagagtgcaatttttaaaatctagaagttaggggttttgttggagaaaaatggactgatctttaaactattcagtcttactgggatttttatgcatagaaactcacatataaacatgaaataaacagtgccagtattcataggaaagtgagaaactgtaatatttggccattattctattcaacaggttttagaggcatgccaccattttttccttatatttttgcttaatttttttaaattgtcatttaattcttaaactgtcatttatttgagatggaaataagatctaaagttagttgcctttgcctgtaaaacatgtgatttgcaaattattatttttcttttttttaacaaatggaagtaaatttgtttcacgtaaatcttaattttcaacctttctggataccttaattgtaactgtcagtttgcactggtcggtatatggaaacacattgctctaccctgctacttagttgattttaaagtgaatttacagtgatgagaaatttgtgaaaaatatattgtatttcttttgatgtttcaaaaggttgcctatgaaaaactgatttgttaaaacatgctacatgtccaaaaataaagaccagaatgacattttgataa

SEQ ID NO: 15574 - DNA, 3246 bp, Homo sapiens
  ENST00000635598
gactccggctgcagccgcgggaggtccggacactggcggccatggaactcaccggtaatagaggacacatctcttaactgggttgctctaagaactgatgtctaaaccgtctcagcatggcctgtagaggaggagctgggaatggccaccgtgcctcagctacactctctcgggttagccctggaagtctttacacatgtagaacccgtacccataatatatgcatggtatctgactttttctacccaaatatgggaggcgtggaaagccacatttaccagctctctcagtgcctgattgaaagagggcataaggttataattgtcacccatgcttatggaaatcgaaaaggcatccgttacctcaccagtggcctcaaagtctattacttgcctctgaaagtcatgtacaaccagtctacagccacgaccctctttcacagtctgccattgctcagggatcgatttgcttagtggtataatacctgaactctgtcagaaatatccagatttaaatttcataattggaggagagggaccaaagagaatcattttggaagaagttcgggaaagataccagctgcatgacagggtgcgtcttttgggagctttagaacacaaggatgttagaaatgtcttagttcaaggacatatttttctgaatacctcccttactgaagcattctgcatggcgatcgtggaagcagccagttgtggtttacaggttgtaagtaccagagttggtggaattcctgaggtgcttccagaaaaccttattattttatgtgagccttcagtaaaatctttgtgtgaaggattggaaaaggctattttccaactgaagtcagggacattgccagctccagaaaacatccataacatagtaaagactttctacacctggaggaatgttgcagaaagaactgaaaaggtatatgaccgggtatcagtggaagctgtgttgccaatggacaaacgactggacagacttatttctcactgcggcccagtaacaggctacatctttgctttgttggcagttttcaacttcctcttcctcattttcttgagatggatgactccagattctatcattgatgttgcaatagatgccactgggccacggggtgcctggactaataactattctcacagtaaaagagggggtgagaataatgagatatctgaaaccaggtagaaggaagcctagattgtaagattttaaacatttgtaatagttctataaagactatggaaaataaccttgcttttggggggtttttgtttttttagagttaatttagtaagttatgctacctctatatcattcaatattttctgttgaggaaagataaaaatgtatgcaattcctgagtgtagaaacttcttgcacttatttaaaatttaggagagaacatttaagccactcaggtatgcaatttttcagactactgaaatccctgtagcagagatgttttaacattatattttgagagctttgggtgctgaagggccaaacgttttctgggcattttttggccagtttttaatgtaacaccattagacactcaccagatgtttacaagttttctttaggggaactacaacaattatatgaactgttttatatcatgttcatatacatttattaggaatctaaatcatgtctttgaacatttattaggttcactcagtaggtgttacatgtaattaacaggttccttgagtaagatagtccatcagttaccagcacattttgaacccctgctctgtgtagaatgttgaactagatgcttcccgccattaaggaccaggggtgcattcactctttgtttaccattcaaatggcttacttcatcataattgtggttgatatgagatcaatatccaacatgccaaaaatgctcatgccagttaatgccaggaaaaaaatcaccgacacactactagtactttgttcctgttgtatgcattctcctaggtagagcctccatcttcagttgtgtttgtgaaggtattttttgctttttaaatactggggaccgatatcactgttgatagtgcagagaaaccctccacatttttcagtgcataattgagttttctataaatgccttcgtgttttctgagcagaatgtacgaggtgtgccatcccaaaaccagctgctaccctgtccttttaatgtaagtcactccccttcactgtggcctcgctgatgtctgataagtattgtcagtgtgcaaaaggctttacttcagaatggtttatttatagcaaactaagttgaaaattttagaaacagtctttgtgggtggatgttattaactgtcattgttgttgcccagagccatgggttttttaaccccaaattatccacatggtgtgtattatgaattctttgaactcttaaggtttttgtgagaaaaggactgtgaattcaaaacaataaggcacttgtgggtgcactacatagattctgacagtgttgtgattctgtataggatttttaaaaatgacaacattcacaaaatttattactttttaaaaaataacatgcctattaactggttgcactgatataaaagaaatatatttgtgttttgtttgtactaaaatgcaaaagcaagagtgcaatttttaaaatctagaagttaggggttttgttggagaaaaatggactgatctttaaactattcagtcttactgggatttttatgcatagaaactcacatataaacatgaaataaacagtgccagtattcataggaaagtgagaaactgtaatatttggccattattctattcaacaggttttagaggcatgccaccattttttccttatatttttgcttaatttttttaaattgtcatttaattcttaaactgtcatttatttgagatggaaataagatctaaagttagttgcctttgcctgtaaaacatgtgatttgcaaattattatttttcttttttttaacaaatggaagtaaatttgtttcacgtaaatcttaattttcaacctttctggataccttaattgtaactgtcagtttgcactggtcggtatatggaaacacattgctctaccctgctacttagttgattttaaagtgaatttacagtgatgagaaatttgtgaaaaatatattgtatttcttttgatgtttcaaaaggttgcctatgaaaaactgatttgttaaaacatgctacatgtccaaaaataaagaccagaatgacattttgata

SEQ ID NO: 15575 - DNA, 3877 bp, Homo sapiens
  ENST00000637626
actggcggccatggaactcaccggtaatagaggacacatctcttaactgggttgctctaagaactgatgtctaaaccgtctcagcatggcctgtagaggaggagctgggaatggccaccgtgcctcagctacactctctcgggttagccctggaagtctttacacatgtagaacccgtacccataatatatgcatggtatctgactttttctacccaaatatgggaggcgtggaaagccacatttaccagctctctcagtgcctgattgaaagagggcataaggttataattgtcacccatgcttatggaaatcgaaaaggcatccgttacctcaccagtggcctcaaagtctattacttgcctctgaaagtcatgtacaaccagtctacagccacgaccctctttcacagtctgccattgctcaggtacatatttgttcgggagagagtcacgataatccattcacatagttctttttctgctatggcccatgatgctctcttccacgccaagacaatggggcttcagacagtcttcacggaccattccctttttggatttgctgatgtcagctcggtgcttacaaacaagcttctaaccgtgtctctttgtgatacaaaccacatcatttgtgtgtcttatactagtaaggaaaatactgtactaagagcagcactgaatcctgaaatagtgtccgtcattcctaatgctgtagatcctactgacttcactccagacccatttagaaggcatgatagtataactattgttgttgtcagcagacttgtttacagaaaagacggagtctcgctctgtctcccaggctggagtgcagtggcgcaatctcggctcactgcaaactccgcctcccgggttcacgccattctcctgcctcagcctccggagtagctgggactacaggcgcccgccactacgcccggctaattttttgtatttttagtagagacggggtttcaccatgttagccaggatggtctcaatttcctgaccttgtgatccgcctgccttggcctcccgaaatgctgggattactgggattacaggcgtgagccaccgcgccctgcctactcttacttttgaatatggatcgatttgcttagtggtataatacctgaactctgtcagaaatatccagatttaaatttcataattggaggagagggaccaaagagaatcattttggaagaagttcgggaaagataccagctgcatgacagggtgcgtcttttgggagctttagaacacaaggatgttagaaatgtcttagttcaaggacatatttttctgaatacctcccttactgaagcattctgcatggcgatcgtggaagcagccagttgtggtttacaggttgtaagtaccagagttggtggaattcctgaggtgcttccagaaaaccttattattttatgtgagccttcagtaaaatctttgtgtgaaggattggaaaaggctattttccaactgaagtcagggacattgccagctccagaaaacatccataacatagtaaagactttctacacctggaggaatgttgcagaaagaactgaaaaggtatatgaccgggtatcagtggaagctgtgttgccaatggacaaacgactggacagacttatttctcactgcggcccagtaacaggctacatctttgctttgttggcagttttcaacttcctcttcctcattttcttgagatggatgactccagattctatcattgatgttgcaatagatgccactgggccacggggtgcctggactaataactattctcacagtaaaagagggggtgagaataatgagatatctgaaaccaggtagaaggaagcctagattgtaagattttaaacatttgtaatagttctataaagactatggaaaataaccttgcttttggggggtttttgtttttttagagttaatttagtaagttatgctacctctatatcattcaatattttctgttgaggaaagataaaaatgtatgcaattcctgagtgtagaaacttcttgcacttatttaaaatttaggagagaacatttaagccactcaggtatgcaatttttcagactactgaaatccctgtagcagagatgttttaacattatattttgagagctttgggtgctgaagggccaaacgttttctgggcattttttggccagtttttaatgtaacaccattagacactcaccagatgtttacaagttttctttaggggaactacaacaattatatgaactgttttatatcatgttcatatacatttattaggaatctaaatcatgtctttgaacatttattaggttcactcagtaggtgttacatgtaattaacaggttccttgagtaagatagtccatcagttaccagcacattttgaacccctgctctgtgtagaatgttgaactagatgcttcccgccattaaggaccaggggtgcattcactctttgtttaccattcaaatggcttacttcatcataattgtggttgatatgagatcaatatccaacatgccaaaaatgctcatgccagttaatgccaggaaaaaaatcaccgacacactactagtactttgttcctgttgtatgcattctcctaggtagagcctccatcttcagttgtgtttgtgaaggtattttttgctttttaaatactggggaccgatatcactgttgatagtgcagagaaaccctccacatttttcagtgcataattgagttttctataaatgccttcgtgttttctgagcagaatgtacgaggtgtgccatcccaaaaccagctgctaccctgtccttttaatgtaagtcactccccttcactgtggcctcgctgatgtctgataagtattgtcagtgtgcaaaaggctttacttcagaatggtttatttatagcaaactaagttgaaaattttagaaacagtctttgtgggtggatgttattaactgtcattgttgttgcccagagccatgggttttttaaccccaaattatccacatggtgtgtattatgaattctttgaactcttaaggtttttgtgagaaaaggactgtgaattcaaaacaataaggcacttgtgggtgcactacatagattctgacagtgttgtgattctgtataggatttttaaaaatgacaacattcacaaaatttattactttttaaaaaataacatgcctattaactggttgcactgatataaaagaaatatatttgtgttttgtttgtactaaaatgcaaaagcaagagtgcaatttttaaaatctagaagttaggggttttgttggagaaaaatggactgatctttaaactattcagtcttactgggatttttatgcatagaaactcacatataaacatgaaataaacagtgccagtattcataggaaagtgagaaactgtaatatttggccattattctattcaacaggttttagaggcatgccaccattttttccttatatttttgcttaatttttttaaattgtcatttaattcttaaactgtcatttatttgagatggaaataagatctaaagttagttgcctttgcctgtaaaacatgtgatttgcaaattattatttttcttttttttaacaaatggaagtaaatttgtttcacgtaaatcttaattttcaacctttctggataccttaattgtaactgtcagtttgcactggtcggtatatggaaacacattgctctaccctgctacttagttgattttaaagtgaatttacagtgatgagaaatttgtgaaaaatatattgtatttcttttgatgtttcaaaaggttgcctatgaaaaactgatttgttaaaacatgctacatgtccaaaaataaagac

SEQ ID NO: 15576 - DNA, 2963 bp, Homo sapiens
  ENST00000638131
gcagccgcgggaggtccggacactggcggccatggaactcaccggtaatagaggacacatctcttaactgggttgctctaagaactgatgtctaaaccgtctcagcatggcctgtagaggaggagctgggaatggccaccgtgcctcagctacactctctcgggttagccctggaagtctttacacatgtagaacccgtacccataatatatgcatgggatcgatttgcttagtggtataatacctgaactctgtcagaaatatccagatttaaatttcataattggaggagagggaccaaagagaatcattttggaagaagttcgggaaagataccagctgcatgacagggtgcgtcttttgggagctttagaacacaaggatgttagaaatgtcttagttcaaggacatatttttctgaatacctcccttactgaagcattctgcatggcgatcgtggaagcagccagttgtggtttacaggttgtaagtaccagagttggtggaattcctgaggtgcttccagaaaaccttattattttatgtgagccttcagtaaaatctttgtgtgaaggattggaaaaggctattttccaactgaagtcagggacattgccagctccagaaaacatccataacatagtaaagactttctacacctggaggaatgttgcagaaagaactgaaaaggtatatgaccgggtatcagtggaagctgtgttgccaatggacaaacgactggacagacttatttctcactgcggcccagtaacaggctacatctttgctttgttggcagttttcaacttcctcttcctcattttcttgagatggatgactccagattctatcattgatgttgcaatagatgccactgggccacggggtgcctggactaataactattctcacagtaaaagagggggtgagaataatgagatatctgaaaccaggtagaaggaagcctagattgtaagattttaaacatttgtaatagttctataaagactatggaaaataaccttgcttttggggggtttttgtttttttagagttaatttagtaagttatgctacctctatatcattcaatattttctgttgaggaaagataaaaatgtatgcaattcctgagtgtagaaacttcttgcacttatttaaaatttaggagagaacatttaagccactcaggtatgcaatttttcagactactgaaatccctgtagcagagatgttttaacattatattttgagagctttgggtgctgaagggccaaacgttttctgggcattttttggccagtttttaatgtaacaccattagacactcaccagatgtttacaagttttctttaggggaactacaacaattatatgaactgttttatatcatgttcatatacatttattaggaatctaaatcatgtctttgaacatttattaggttcactcagtaggtgttacatgtaattaacaggttccttgagtaagatagtccatcagttaccagcacattttgaacccctgctctgtgtagaatgttgaactagatgcttcccgccattaaggaccaggggtgcattcactctttgtttaccattcaaatggcttacttcatcataattgtggttgatatgagatcaatatccaacatgccaaaaatgctcatgccagttaatgccaggaaaaaaatcaccgacacactactagtactttgttcctgttgtatgcattctcctaggtagagcctccatcttcagttgtgtttgtgaaggtattttttgctttttaaatactggggaccgatatcactgttgatagtgcagagaaaccctccacatttttcagtgcataattgagttttctataaatgccttcgtgttttctgagcagaatgtacgaggtgtgccatcccaaaaccagctgctaccctgtccttttaatgtaagtcactccccttcactgtggcctcgctgatgtctgataagtattgtcagtgtgcaaaaggctttacttcagaatggtttatttatagcaaactaagttgaaaattttagaaacagtctttgtgggtggatgttattaactgtcattgttgttgcccagagccatgggttttttaaccccaaattatccacatggtgtgtattatgaattctttgaactcttaaggtttttgtgagaaaaggactgtgaattcaaaacaataaggcacttgtgggtgcactacatagattctgacagtgttgtgattctgtataggatttttaaaaatgacaacattcacaaaatttattactttttaaaaaataacatgcctattaactggttgcactgatataaaagaaatatatttgtgttttgtttgtactaaaatgcaaaagcaagagtgcaatttttaaaatctagaagttaggggttttgttggagaaaaatggactgatctttaaactattcagtcttactgggatttttatgcatagaaactcacatataaacatgaaataaacagtgccagtattcataggaaagtgagaaactgtaatatttggccattattctattcaacaggttttagaggcatgccaccattttttccttatatttttgcttaatttttttaaattgtcatttaattcttaaactgtcatttatttgagatggaaataagatctaaagttagttgcctttgcctgtaaaacatgtgatttgcaaattattatttttcttttttttaacaaatggaagtaaatttgtttcacgtaaatcttaattttcaacctttctggataccttaattgtaactgtcagtttgcactggtcggtatatggaaacacattgctctaccctgctacttagttgattttaaagtgaatttacagtgatgagaaatttgtgaaaaatatattgtatttcttttgatgtttcaaaaggttgcctatgaaaaactgatttgttaaaac

SEQ ID NO: 15577 - DNA, 2113 bp, Homo sapiens
  ENST00000637296
actggcggccatggaactcaccggtaatagaggacacatctcttaactgggttgctctaagaactgatgtctaaaccgtctcagcatggcctgtagaggaggagctgggaatggccaccgtgcctcagctacactctctcggatcctactgacttcactccagacccatttagaaggcatgatagtataactattgttgttgtcagcagacttgtttacagaaaagggatcgatttgcttagtggtataatacctgaactctgtcagaaatatccagatttaaatttcataattggaggagagggaccaaagagaatcattttggaagaagttcgggaaagataccagctgcatgacagggtgcgtcttttgggagctttagaacacaaggatgttagaaatgtcttagttcaaggacatatttttctgaatacctcccttactgaagcattctgcatggcgatcgtggaagcagccagttgtggtttacaggttgtaagtaccagagttggtggaattcctgaggtgcttccagaaaaccttattattttatgtgagccttcagtaaaatctttgtgtgaaggattggaaaaggctattttccaactgaagtcagggacattgccagctccagaaaacatccataacatagtaaagactttctacacctggaggaatgttgcagaaagaactgaaaaggtatatgaccgggtatcagtggaagctgtgttgccaatggacaaacgactggacagacttatttctcactgcggcccagtaacaggctacatctttgctttgttggcagttttcaacttcctcttcctcattttcttgagatggatgactccagattctatcattgatgttgcaatagatgccactgggccacggggtgcctggactaataactattctcacagtaaaagagggggtgagaataatgagatatctgaaaccaggtagaaggaagcctagattgtaagattttaaacatttgtaatagttctataaagactatggaaaataaccttgcttttggggggtttttgtttttttagagttaatttagtaagttatgctacctctatatcattcaatattttctgttgaggaaagataaaaatgtatgcaattcctgagtgtagaaacttcttgcacttatttaaaatttaggagagaacatttaagccactcaggtatgcaatttttcagactactgaaatccctgtagcagagatgttttaacattatattttgagagctttgggtgctgaagggccaaacgttttctgggcattttttggccagtttttaatgtaacaccattagacactcaccagatgtttacaagttttctttaggggaactacaacaattatatgaactgttttatatcatgttcatatacatttattaggaatctaaatcatgtctttgaacatttattaggttcactcagtaggtgttacatgtaattaacaggttccttgagtaagatagtccatcagttaccagcacattttgaacccctgctctgtgtagaatgttgaactagatgcttcccgccattaaggaccaggggtgcattcactctttgtttaccattcaaatggcttacttcatcataattgtggttgatatgagatcaatatccaacatgccaaaaatgctcatgccagttaatgccaggaaaaaaatcaccgacacactactagtactttgttcctgttgtatgcattctcctaggtagagcctccatcttcagttgtgtttgtgaaggtattttttgctttttaaatactggggaccgatatcactgttgatagtgcagagaaaccctccacatttttcagtgcataattgagttttctataaatgccttcgtgttttctgagcagaatgtacgaggtgtgccatcccaaaaccagctgctaccctgtccttttaatgtaagtcactccccttcactgtggcctcgctgatgtctgataagtattgtcagtgtgcaaaaggctttacttcagaatggtttatttatagcaaactaagttgaaaattttagaaacagtctttgtgggtggatgttattaactgtcattgttgttgccca

SEQ ID NO: 15578 - DNA, 965 bp, Homo sapiens
  ENST00000634582
gcagccgcgggaggtccggacactggcggccatggaactcaccgggatcgatttgcttagtggtataatacctgaactctgtcagaaatatccagatttaaatttcataattggaggagagggaccaaagagaatcattttggaagaagttcgggaaagataccagctgcatgacagggtgcgtcttttgggagctttagaacacaaggatgttagaaatgtcttagttcaaggacatatttttctgaatacctcccttactgaagcattctgcatggcgatcgtggaagcagccagttgtggtttacaggttgtaagtaccagagttggtggaattcctgaggtgcttccagaaaaccttattattttatgtgagccttcagtaaaatctttgtgtgaaggattggaaaaggctattttccaactgaagtcagggacattgccagctccagaaaacatccataacatagtaaagactttctacacctggaggaatgttgcagaaagaactgaaaaggtatatgaccgggtatcagtggaagctgtgttgccaatggacaaacgactggacagacttatttctcactgcggcccagtaacaggctacatctttgctttgttggcagttttcaacttcctcttcctcattttcttgagatggatgactccagattctatcattgatgttgcaatagatgccactgggccacggggtgcctggactaataactattctcacagtaaaagagggggtgagaataatgagatatctgaaaccaggtagaaggaagcctagattgtaagattttaaacatttgtaatagttctataaagactatggaaaataaccttgcttttggggggtttttgtttttttagagttaatttagtaagttatgctacctctatatcattcaatattttctgttgaggaaagataaaaatgtatgcaattcctgagtgta

SEQ ID NO: 15579 - DNA, 1092 bp, Homo sapiens
  ENST00000482148
ccggtaatagaggacacatctcttaactgggttgctctaagaactgatgtctaaaccgtctcagcatggcctgtagaggaggagctgggaatggccaccgtgcctcagctacactctctcgggttagccctggaagtctttacacatgtagaacccgtacccataatatatgcatggtatctgactttttctacccaaatatgggaggcgtggaaagccacatttaccagctctctcagtgcctgattgaaagagggcataaggttataattgtcacccatgcttatggaaatcgaaaaggcatccgttacctcaccagtggcctcaaagtctattacttgcctctgaaagtcatgtacaaccagtctacagccacgaccctctttcacagtctgccattgctcagggtgcgtcttttgggagctttagaacacaaggatgttagaaatgtcttagttcaaggacatatttttctgaatacctcccttactgaagcattctgcatggcgatcgtggaagcagccagttgtggtttacaggttgtaagtaccagagttggtggaattcctgaggtgcttccagaaaaccttattattttatgtgagccttcagtaaaatctttgtgtgaaggattggaaaaggctattttccaactgaagtcagggacattgccagctccagaaaacatccataacatagtaaagactttctacacctggaggaatgttgcagaaagaactgaaaaggtatatgaccgggtatcagtggaagctgtgttgccaatggacaaacgactggacagacttatttctcactgcggcccagtaacaggctacatctttgctttgttggcagttttcaacttcctcttcctcattttcttgagatggatgactccagattctatcattgatgttgcaatagatgccactgggccacggggtgcctggactaataactattctcacagtaaaagagggggtgagaataatgagatatctgaaaccaggtagaaggaagcctagattgtaagattttaaacatttgtaatagttctataaagactatggaaaataaccttgcttttggggg

SEQ ID NO: 15580 - DNA, 854 bp, Homo sapiens
  ENST00000634640
gactccggctgcagccgcgggaggtccggacactggcggccatggaactcaccggtaatagaggacacatctcttaactgggttgctctaagaactgatgtctaaaccgtctcagcatggcctgtagaggaggagctgggaatggccaccgtgcctcagctacactctctcggggatcgatttgcttagtggtataatacctgaactctgtcagaaatatccagatttaaatttcataattggaggagagggaccaaagagaatcattttggaagaagttcgggaaagataccagctgcatgacagggtgcgtcttttgggagctttagaacacaaggatgttagaaatgtcttagttcaaggacatatttttctgaatacctcccttactgaagcattctgcatggcgatcgtggaagcagccagttgtggtttacaggttgtaagtaccagagttggtggaattcctgaggtgcttccagaaaaccttattattttatgtgagccttcagtaaaatctttgtgtgaaggattggaaaaggctattttccaactgaagtcagggacattgccagctccagaaaacatccataacatagtaaagactttctacacctggaggaatgttgcagaaagaactgaaaaggtatatgaccgggtatcagtggaagctgtgttgccaatggacaaacgactggacagacttatttctcactgcggcccagtaacaggctacatctttgctttgttggcagttttcaacttcctcttcctcattttcttgagatggatgactccagattctatcattgatgttgcaatagatgccactgggccacggggtgcctggacta

SEQ ID NO: 15581 - DNA, 153 bp, Homo sapiens
  ENST00000475746
caaggacatatttttctgaatacctcccttactgaagcattctgcatggcgatcgtggaagcagccagttgtggtttacaggtatatgaccgggtatcagtggaagctgtgttgccaatggacaaacgactggacagacttatttctcactgc

SEQ ID NO: 15582 - DNA, 520 bp, Homo sapiens
  ENST00000463173
agaacattagcagcaataagaatttaagtgtaatataaatagcagacttggtttataaattaaatttcttttgtagcatgagttttcactcctttcttcccctctcatttaaaaaatcagggtgcgtcttttgggagctttagaacacaaggatgttagaaatgtcttagttcaaggacatatttttctgaatacctcccttactgaagcattctgcatggcgatcgtggaagcagccagttgtggtttacaggttgtaagtaccagagttggtggaattcctgaggtgcttccagaaaaccttattattttatgtgagccttcagtaaaatctttgtgtgaaggattggaaaaggctattttccaactgaagtcagggacattgccagctccagaaaacatccataacatagtaaagactttctacacctggaggaatgttgcagaaagaactgaaaaggtatatgaccgggtatcagtggaagctgtgttgccaatggacaaacgactggacagactt

SEQ ID NO: 15583 - DNA, 743 bp, Homo sapiens
  ENST00000635480
cttagccaccttaaatataccttttttagaagtacgcaatgtataaacacaagtgaataacttaaagaatagtctgttgagatgaaacagaatagtccatattttgggtgtgtggaaggtaatgcatgtcaaggtctacgtcttcaagaattgtaactcttgggggaccactgccagtttgcaaacaattccactcctggaaaaggtttaagagagtttctctcctttatggagtgcatagctaatacttttcaaaataagtggattctcagtcgttctggtgaatttttttaagtttaaatattaatatctccaacattcaactttatattttcagggatcgatttgcttagtggtataatacctgaactctgtcagaaatatccagatttaaatttcataattggaggagagggaccaaagagaatcattttggaagaagttcgggaaagataccagctgcatgacagggtgcgtcttttgggagctttagaacacaaggatgttagaaatgtcttagttcaaggacatatttttctgaatacctcccttactgaagcattctgcatggcgatcgtggaagcagccagttgtggtttacaggttgtaagtaccagagttggtggaattcctgaggtgcttccagaaaaccttattattttatgtgagccttcagtaaaatctttgtgtgaaggattggaaaaggctattttccaactgaagtcagggacattgccagctcc

SEQ ID NO: 15584 - DNA, 680 bp, Homo sapiens
  ENST00000634286
gtcacccatgcttatggaaatcgaaaaggcatccgttacctcaccagtggcctcaaagtctattacttgcctctgaaagtcatgtacaaccagtctacagccacgaccctctttcacagtctgccattgctcaggagtttattggaccagatatcaaagtcccactggaatgtcttaagtgagagagaggataaatcaaagttttccttatccaggctttttggatgtctttttcctgagcctcctcttccaagcctgttttgctctcagtcaggatttaccagcactctgcatgtgtaggcacgctcacctgcttccttctgtagtgggatcgatttgcttagtggtataatacctgaactctgtcagaaatatccagatttaaatttcataattggaggagagggaccaaagagaatcattttggaagaagttcgggaaagataccagctgcatgacagggtgcgtcttttgggagctttagaacacaaggatgttagaaatgtcttagttcaaggacatatttttctgaatacctcccttactgaagcattctgcatggcgatcgtggaagcagccagttgtggtttacaggttgtaagtaccagagttggtggaattcctgaggtgcttccagaaaaccttattattttatgtgagccttcagtaaaatctttgtg

SEQ ID NO: 15585 - DNA, 582 bp, Homo sapiens
  ENST00000474662
actggcggccatggaactcaccggtaatagaggacacatctcttaactgggttgctctaagaactgatgtctaaaccgtctcagcatggcctgtagaggaggagctgggaatggccaccgtgcctcagctacactctctcggggatcgatttgcttagtggtataatacctgaactctgtcagaaatatccagatttaaatttcataattggaggagagggaccaaagagaatcattttggaagaagttcgggaaagataccagctgcatgacaggtattgatgaatttcatgttgtcttgagggagaagatgtcaattatctctatttggttttaactgcatgcgtaccttaggtgtgttgcttctcctgcatgtaattgatatacatataattgatataaatctaatgcaaggactgttttcaaaatttttatataaataggaaacctagttaattcactattttttccattagcccaatattatttgactttggggggccattgttggaggcaccatgaaaggcacaaaaaacagctgctttaactggaagcgtttgcagatttccaggccatactgtg

SEQ ID NO: 15586 - DNA, 100 bp, Homo sapiens
  ENST00000637799
catgaaattgagtctcagagaggggatcgatttgcttagtggtataatacctgaactctgtcagaaatatccagatttaaatttcataattggaggagag

SEQ ID NO: 15587 - DNA, 1320 bp, Homo sapiens
  ENST00000634484
gcattctgtattctgaattcctcctgggacattagtgatgtgtttttttgtaacttaggaattgtacctaatttattttttaaccaaatagcatatcttcttgagatggctagctgagaaagagtatgacacaagtgtgatcaaggatcagcaaaattaactacccatgcaaagattaaacctgttacctttacttccctaatgtggtattttaactagctgagctaaccaccaatggagtgatggtatggcctttcctgtactcaattcagtaattgaacagttatttatcgaaccctctccagatgccaggcaccctgcagaaagtaacattctgaaaaggaacagccatgcctgtagcccaaaagtgagtagttgtattaatggtccattccttattaacaaattaatttcctcaggagtttattggaccagatatcaaagtcccactggaatgtcttaagtgagagagaggataaatcaaagttttccttatccaggctttttggatgtctttttcctgagcctcctcttccaagcctgttttgctctcagtcaggatttaccagcactctgcatgtgtaggcacgctcacctgcttccttctgtagtggtaatgacaacctacatttgtattctgcagttgataaagcctgttcgtggtacaatacctcatttgaccctcccaacaactgtagggtagatgttatctacatgaaattgagtctcagagagggtaagtaactcacccaggttacacagtaagtaacagagatgacacacgagttcagcttttctggagctaagttctcctcttcctccacccatgcccagccactcatatcctaggtgtagatcagaaggttcttaaaaatattgttagactgagctttaaaagcagtttggatcagagattttcattgtctgttttgtgttcacatggcagtcgaaagtctctaggttccattgcattatacccttcttagaggctccagaataaatttttttatagtggtggggaaaagcccttattcttagaataagaatatagatcattggtaatagtaatcagttccatttcttatgagatacttgtcaggattaaatgacataatgaatttaaagtatattgcctgtcatagcaagcactctgttactgttagctattatcatttatgactattgctctatgttgttttttgtttgtttgaagaatgggctcttaaccttgtacgagaaagaaaagggtgaggaagaaaatggattgaaggaattgtaggagactaaatgttaaaagtcattaaactaccttctggttta

SEQ ID NO: 15588 - DNA, 572 bp, Homo sapiens
  ENST00000635543
gggtgaaaccgacccggttcgaagcccggaagttgggtcggagggtctccagagtaatagaggacacatctcttaactgggttgctctaagaactgatgtctaaaccgtctcagcatggcctgtagaggaggagctgggaatggccaccgtgcctcagctacactctctcgggttagccctggaagtctttacacatgtagaacccgtacccataatatatgcatggtatctgactttttctacccaaatatgggaggcgtggaaagccacatttaccagctctctcagtgcctgattgaaagagggcataaggttataattgtcacccatgcttatggaaatcgaaaaggcatccgttacctcaccagtggcctcaaagtctattacttgcctctgaaagtcatgtacaaccagtctacagccacgaccctctttcacagtctgccattgctcaggtacatatttgttcgggagagagtcacgataatccattcacatagttctttttctgctatggcccatgatgctctcttccacgccaagacaatggggcttcagacagtcttcacgg

SEQ ID NO: 15589 - DNA, 760 bp, Homo sapiens
  ENST00000561272
gcggccgcctggcgctgcagcgccgctactactccccgtcctgccgggaattctgcctcagctgccctcggctctcgctgcgttcgctcaccgctgtcacctgcacggtgtggctggcggcctacggactcttcaccctctgcgagaacagcatgatcctctctgctgccatcttcatcaccctcttaggtctgcttggttatctccattttgtgaagattgatcaggagactctgttaatcattgattcccttggcattcagatgacttcatcttatgcttcaggcaaagaaagcactaccttcatagaaatgggcaaggtcaaggatattgtcatcaatgaggccatttacatgcagaaggtgatttactacctctgcatcttattgaaagatccagtggaaccacatgggatatcccaagtagtacccgtcttccaggctgcatggtgcattcattctaagctggcaacccgaccctcctgcttcctgaacagaaccttacctgggccatcagggcagccatctcaagagccaattccttgttgataggaaacctccctgccactatctctctactggtttgagaggcaaggagcagccgttctcggtccgtctcccctttgacttgactgcgaaagtacagcctacaaagaagagaataagaaaccaggactcagcagggattccaaacagggatggggctttctctgggtctgttacctttatttccaaaaagataaagtactcttttcccacta

SEQ ID NO: 15590 - DNA, 1420 bp, Homo sapiens
  ENST00000216452
aagcgggtctggagcgggcgagacggccagggccggcgagcgcagtgcagcgccgcgcggtgcgggcggccgagtgggggcgtcatggaggatgagcggagcttttcggatatctgcggcggccgcctggcgctgcagcgccgctactactccccgtcctgccgggaattctgcctcagctgccctcggctctcgctgcgttcgctcaccgctgtcacctgcacggtgtggctggcggcctacggactcttcaccctctgcgagaacagcatgatcctctctgctgccatcttcatcaccctcttaggtctgcttggttatctccattttgtgaagattgatcaggagactctgttaatcattgattcccttggcattcagatgacttcatcttatgcttcaggcaaagaaagcactaccttcatagaaatgggcaaggtcaaggatattgtcatcaatgaggccatttacatgcagaaggtgatttactacctctgcatcttattgaaagatccagtggaaccacatgggatatcccaagtagtacccgtcttccagagtgccaagccccggctggactgcttgattgaagtatacaggagctgccaggagatcctggcacaccagaaagccacatcaacaagcccatgagccccagcgttcagaaggccagcattgtcttccatgggagatgactcttaagccataggggctggttttccgtactccaaaccatcaggtggacacagtcctaggaaccattatggatgtagtgcatcttagagccatagagcaggtgactggaaatctaactcagtatatttccgtgtattatagtgttttccttgtaaggttttgcctactttaccaaaggaggggagaccttaagaattttgacacagtatgtcaaaagtaatgtcagcaaagaacactttcggaaattgctaagcatgttcaggtttactttgttgatgtttgtgaagcaaaacaatgggaaactgacatcagatgtcttgagaaagctatattttccaatagtaccccttgtgtaaagttacgaaaaaaacaagcccttcagtactggttagcaggaagaaatgtcctacaaaagacgagtctgtcaacctagtgcctgtgttctgtacagggcttatttatttactgttaataaacagatcttccaaaacacacagttacctggttcacagatagctgctttttattgacaaacaagatcatagtatttcagtcatggtgtcaagcacattaatacttttctgttactcagcatttttttttatatcagttcaaaagctacttttgccaagaaggatgagacaaaaggccagacagaaattggactttggttttcagacatgggactctcatgttaacaaagaataaataagcaaatattgaa

SEQ ID NO: 15591 - DNA, 841 bp, Homo sapiens
  ENST00000558987
ccctcttaggtctgcttggttatctccattttgtgaagattgatcaggagactctgttaatcattgattcccttggcattcagatgacttcatcttatgcttcaggcaaagaaagcactaccttcatagaaatgggcaaggtcaaggatattgtcatcaatgaggccatttacatgcagaaggtgatttactacctctgcatcttattgaaagatccagtggaaccacatgggatatcccaagtagtacccgtcttccagagacagagtctcactttgtcacctaggctggagtgcagtgacaatcaccactcattgcagcctccacctcccaggctcaagaaatcctcctgcctcagcctcctgagaacttgggactacagagtgccaagccccggctggactgcttgattgaagtatacaggagctgccaggagatcctggcacaccagaaagccacatcaacaagcccatgagccccagcgttcagaaggccagcattgtcttccatgggagatgactcttaagccataggggctggttttccgtactccaaaccatcaggtggacacagtcctaggaaccattatggatgtagtgcatcttagagccatagagcaggtgactggaaatctaactcagtatatttccgtgtattatagtgttttccttgtaaggttttgcctactttaccaaaggaggggagaccttaagaattttgacacagtatgtcaaaagtaatgtcagcaaagaacactttcggaaattgctaagcatgttcaggtttactttgttgatgtttgtgaagcaaaacaatgggaaactgacatcagatgtcttga

SEQ ID NO: 15592 - DNA, 560 bp, Homo sapiens
  ENST00000559118
aaaaagaatgcaaaatgagtttcacttagactttgctatttgatttattttcttacagcagaaggtgatttactacctctgcatcttattgaaagatccagtggaaccacatgggatatcccaagtagtacccgtcttccagagtgccaagccccggctggactgcttgattgaagtatacaggagctgccaggagatcctggcacaccagaaagccacatcaacaagcccatgagccccagcgttcagaaggccagcattgtcttccatgggagatgactcttaagccataggggctggttttccgtactccaaaccatcaggtggacacagtcctaggaaccattatggatgtagtgcatcttagagccatagagcaggtgactggaaatctaactcagtatatttccgtgtattatagtgttttccttgtaaggttttgcctactttaccaaaggaggggagaccttaagaattttgacacagtatgtcaaaagtaatgtcagcaaagaacactttcggaaattgctaagcatgttcaggtttactttgttgatgtt

SEQ ID NO: 15593 - DNA, 903 bp, Homo sapiens
  ENST00000560722
gagacggccagggccggcgagcgcagtgcagcgccgcgcggtgcgggcggccgagtgggggcgtcatggaggatgagcggagcttttcggatatctgcggcggccgcctggcgctgcagcgccgctactactccccgtcctgccgggaattctgcctcagctgccctcggctctcgctgcgttcgctcaccgctgtcacctgcacggtgtggctggcggcctacggactcttcaccctctgcgagaacagcatgatcctctctgctgccatcttcatcaccctcttaggtctgcttggttatctccattttgtgaagattgatcaggagactctgttaatcattgattcccttggcattcagatgacttcatcttatgcttcaggcaaagaaagcactaccttcatagaaatgggcaaggtcaaggatattgtcatcaatgaggccatttacatgaaggtgatttactacctctgcatcttattgaaagatccagtggaaccacatgggatatcccaagtagtacccgtcttccagagtgccaagccccggctggactgcttgattgaagtatacaggagctgccaggagatcctggcacaccagaaagccacatcaacaagcccatgagccccagcgttcagaaggccagcattgtcttccatgggagatgactcttaagccataggggctggttttccgtactccaaaccatcaggtggacacagtcctaggaaccattatggatgtagtgcatcttagagccatagagcaggtgactggaaatctaactcagtatatttccgtgtattatagtgttttccttgtaaggttttgcctactttaccaaaggaggggagaccttaagaattttgacacagtatgtcaaaagtaatgtcagcaa

SEQ ID NO: 15594 - DNA, 499 bp, Homo sapiens
  ENST00000558493
gtcctgccgggaattctgcctcagctgccctcggctctcgctgcgttcgctcaccgctgtcacctgcacggtgtggctggcggcctacggactcttcaccctctgcgagaacagcatgatcctctctgctgccatcttcatcaccctcttaggtctgcttggttatctccattttgtgaagattgatcaggagactctgttaatcattgattcccttggcattcagatgacttcatcttatgcttcaggcaaagaaagcactaccttcatagaaatgggcaaggtcaaggatattgtcatcaatgaggccatttacatgagtgccaagccccggctggactgcttgattgaagtatacaggagctgccaggagatcctggcacaccagaaagccacatcaacaagcccatgagccccagcgttcagaaggccagcattgtcttccatgggagatgactcttaagccataggggctggttttccgtactccaaaccatca

SEQ ID NO: 15595 - DNA, 583 bp, Homo sapiens
  ENST00000558198
acggccagggccggcgagcgcagtgcagcgccgcgcggtgcgggcggccgagtgggggcgtcatggaggatgagcggagcttttcggatatctgcggcggccgcctggcgctgcagcgccgctactactccccgtcctgccgggaattctgcctcagctgccctcggctctcgctgcgttcgctcaccgctgtcacctgcacggtgtggctggcggcctacggactcttcaccctctgcgagcatgatcctctctgctgccatcttcatcaccctcttaggtctgcttggttatctccattttgtgaagattgatcaggagactctgttaatcattgattcccttggcattcagatgacttcatcttatgcttcaggcaaagaaagcactaccttcatagaaatgggcaaggtcaaggatattgtcatcaatgaggccatttacatgagtgccaagccccggctggactgcttgattgaagtatacaggagctgccaggagatcctggcacaccagaaagccacatcaacaagcccatgagccccagcgttcagaaggccagcattgtcttccatgggagatg

SEQ ID NO: 15596 - DNA, 593 bp, Homo sapiens
  ENST00000561303
gcagtgcagcgccgcgcggtgcgggcggccgagtgggggcgtcatggaggatgagcggagcttttcggatatctgcggcggccgcctggcgctgcagcgccgctactactccccgtcctgccgggaattctgcctcagctgccctcggctctcgctgcgttcgctcaccgctgtcacctgcacggtgtggctggcggcctacggactcttcaccctctgcgagaacagcatgatcctctctgctgccatcttcatcaccctcttaggtctgcttggttatctccattttgtgaagattgatcaggagactctgttaatcattgattcccttggcattcagatgacttcatcttatgcttcaggcaaagaaagcactaccttcatagaaatgggcaaggtcaaggatattgtcatcaatgaggccatttacatggtaagtatttaaaagcagaaggtgatttactacctctgcatcttattgaaagatccagtggaaccacatgggatatcccaagtagtacccgtcttccagagtgccaagccccggctggactgcttgattgaagtatacaggagctgccaggagatcctgg

SEQ ID NO: 15597 - DNA, 594 bp, Homo sapiens
  ENST00000558001
ggtctggagcgggcgagacggccagggccggcgagcgcagtgcagcgccgcgcggtgcgggcggccgagtgggggcgtcatggaggatgagcggagcttttcggatatctgcggcggccgcctggcgctgcagcgccgctactactccccgtcctgccgggaattctgcctcagctgccctcggctctcgctgcgttcgctcaccgctgtcacctgcacggtgtggctggcggcctacggactcttcaccctctgcgagcatgatcctctctgctgccatcttcatcaccctcttaggtctgcttggttatctccattttgtgaagattgatcaggagactctgttaatcattgattcccttggcattcagatgacttcatcttatgcttcaggcaaagaaagcactaccttcatagaaatgggcaaggtcaaggatattgtcatcaatgaggccatttacatgcagaaggtgatttactacctctgcatcttattgaaagatccagtggaaccacatgggatatcccaagtagtacccgtcttccagagtgccaagccccggctggactgcttgattgaagtatacaggagct

SEQ ID NO: 15598 - DNA, 1049 bp, Homo sapiens
  ENST00000559581
agacggccagggccggcgagcgcagtgcagcgccgcgcggtgcgggcggccgagtgggggcgtcatggaggatgagcggagcttttcggatatctgcggcggccgcctggcgctgcagcgccgctactactccccgtcctgccgggaattctgcctcagctgccctcggctctcgctgcgttcgctcaccgctgtcacctgcacggtgtggctggcggcctacggactcttcaccctctgcgagatgacttcatcttatgcttcaggcaaagaaagcactaccttcatagaaatgggcaaggtcaaggatattgtcatcaatgaggccatttacatgcagaaggtgatttactacctctgcatcttattgaaagatccagtggaaccacatgggatatcccaagtagtacccgtcttccagagacagagtctcactttgtcacctaggctggagtgcagtgacaatcaccactcattgcagcctccacctcccaggctcaagaaatcctcctgcctcagcctcctgagaacttgggactacaggtgtgcaccatctcgcctggctaattttttttttttatttttagtagagatgaggtcttgccatgttgcctaggctgatcttgaactcctgagttcaagcaattctcctgcctcagcctcccaaagtgttgggattacaagcatgagccagcatacctggcctcatgcacattttaaagaacacaatcaaatatatagcaacttctgcctataaatcaccattcatctactttgactctgtcagtctactactgtacactttttttagatagaggtaattgatcttacattgtacactattgtgtgtcttgctttgtaaataatttaatatgtatgtatcctacaaaggccattatatttattattttaaataattgtataatatattgaaatatcagtttatttagccactcttgccagcttttaaaatcatgcctgggtttttttgttttgctcttacaaaaaaaaaaaaacacttatcagctggtgcagtggctcatgcctgt

SEQ ID NO: 15599 - DNA, 476 bp, Homo sapiens
  ENST00000559415
gagacggccagggccggcgagcgcagtgcagcgccgcgcggtgcgggcggccgagtgggggcgtcatggaggatgagcggagcttttcggatatctgcggcggccgcctggcgctgcagcgccgctactactccccgtcctgccgggaattctgcctcagctgccctcggctctcgctgcgttcgctcaccgctgtcacctgcacggtgtggctggcggcctacggactcttcaccctctgcgagaacagcatgatcctctctgctgccatcttcatcaccctcttaggcaaagaaagcactaccttcatagaaatgggcaaggtcaaggatattgtcatcaatgaggccatttacatgcagaaggtgatttactacctctgcatcttattgaaagatccagtggaaccacatgggatatcccaagtagtacccgtcttccagagacagagtctcactttgtcacctaggctggag

SEQ ID NO: 15600 - DNA, 962 bp, Homo sapiens
  ENST00000559097
agcgggtctggagcgggcgagacggccagggccggcgagcgcagtgcagcgccgcgcggtgcgggcggccgagtgggggcgtcatggaggatgagcggagcttttcggatatctgcggcggccgcctggcgctgcagcgccgctactactccccgtcctgccgggaattctgcctcagctgccctcggctctcgctgcgttcgctcaccgctgtcacctgcacggtgtggctggcggcctacggactcttcaccctctgcgagaacagcatgatcctctctgctgccatcttcatcaccctcttaggtctgcttggttatctccattttgtgaagattgatcaggagactctgttaatcattgattcccttggcattcagatgacttcatcttatgcttcaggcaaagaaagcactaccttcatagaaatgggcaaggtcaaggatattgtcatcaatgaggccatttacatggtaagtatttaaaaggtaagtattacaggcctctctggaggaggtagccagcccatgggatgttcccagatttaaactaaaaccgtaaaagtgagacttatatttaaaaggtaaatctctttatttttaaagagatgcagcaggttttcatggatagggaattagcatttcaactttatcttcaagaccaacttcaaaattatcactggcattttttccttctctttctatcttttttctttttttttttttgagacagggtctcactctgttgcccaggctggagtgcagtggctcgatcacagctcactgcagcctcaacttcccaggctcaagccattctcccacctcagcctcctgagtagctgggactacaggcatgcaccaccatgcttggctcgttttttctatgttttgcagagatgcagtctcactatgttgcctaggctggtcttgaattcctgggctcaagccatcctcctgctgtgg

SEQ ID NO: 15601 - DNA, 2397 bp, Homo sapiens
  ENST00000268758
ccccacggtggccggagcagccggaagctagcatggcggccgccggggctgcggctacacacctagctccgcctcatggtgcctgtcactgtcgtgtttacgcgggagtcagtgcccctggacgaccaggagaagctgcccttcaccgttgtgcatgaaagagagattcctctgaaatacaaaatgaaaatcaaatgccgtttccagaaggcctatcggagggctttggaccatgaggaggaggccctgtcatcgggcagtgtgcaagaggcagaagccatgttagatgagcctcaggaacaagcggagggctccctgactgtgtacgtgatatctgaacactcctcacttcttccccaggacatgatgagctacattgggcccaagaggacagcagtggtgcgggggataatgcaccgggaggcctttaacatcattggccgccgcatagtccaggtggcccaggccatgtctttgactgaggatgtgcttgctgctgctctggctgaccaccttccagaggacaagtggagcgctgagaagaggcggcctctcaagtccagcttgggctatgagatcaccttcagtttactcaacccagaccccaagtcccatgatgtctactgggacattgagggggctgtccggcgctatgtgcaacctttcctgaatgccctcggtgccgctggcaacttctctgtggactctcagattctttactatgcaatgttgggggtgaatccccgctttgactcagcttcctccagctactatttggacatgcacagcctcccccatgtcatcaacccagtggagtcccggctgggatccagtgctgcctccttgtaccctgtgctcaactttctactctacgtgcctgagcttgcacactcaccgctgtacattcaggacaaggatggcgctccagtggccaccaatgccttccatagtccccgctggggtggcattatggtatataatgttgactccaaaacctataatgcctcagtgctgccagtgagagtcgaggtggacatggtgcgagtgatggaggtgttcctggcacagttgcggttgctctttgggattgctcagccccagctgcctccaaaatgcctgctttcagggcctacgagtgaagggctaatgacctgggagctagaccggctgctctgggctcggtcagtggagaacctggccacagccaccaccacccttacctccctggcgcagcttctgggcaagatcagcaacattgtcattaaggacgacgtggcatctgaggtgtacaaggctgtagctgccgtccagaagtcggcagaagagttggcgtctgggcacctggcatctgcctttgtcgccagccaggaagctgtgacatcctctgagcttgccttctttgacccgtcactcctccacctcctttatttccctgatgaccagaagtttgccatctacatcccactcttcctgcctatggctgtgcccatcctcctgtccctggtcaagatcttcctggagacccgcaagtcctggagaaagcctgagaagacagactgagcagggcagcacctccataggaagccttcctttctggccaaggtgggcggtgttagattgtgaggcacgtacatggggcctgccggaatgacttaaatatttgtctccagtctccactgttggctctccagcaaccaaagtacaacactccaagatgggttcatcttttcttcctttcccattcacctggctcaatcctcctccaccaccaggggcctcaaaaggcacatcatccgggtctccttatcttgtttgataaggctgctgcctgtctccctctgtggcaaggactgtttgttcttttgccccatttctcaacatagcacacttgtgcactgagaggagggagcattatgggaaagtccctgccttccacacctctctctagtccctgtgggacagccctagcccctgctgtcatgaaggggccaggcattggtcacctgtgggaccttctccctcactcccctccctcctagttggctttgtctgtcaggtgcagtctggcgggagtccaggaggcagcagctcaggacatggtgctgtgtgtgtgtgtgtgtgtgtgtgtgtgtgtgtgtgtcagaggttccagaaagttccagatttggaatcaaacagtcctgaattcaaatccttgtttttgcacttattgtctggagagctttggataaggtattgaatctctctgagcctcagtttttcatttgttcaaatggcactgatgatgtctcccttacaagatggttgtgaggagtaaatgtgatcagcatgtaaagtgtctggcgtgtagtaggctcttaataaacactggctgaatatgaattggaatgatacaaa

SEQ ID NO: 15602 - DNA, 3088 bp, Homo sapiens
  ENST00000487231
atggtaatagtcacactacgcagaccccagagcccatgcttctgggacaggcaggtgtccctgaaactgtgttccttctgttttccttctggtgtcctccatggcccagcctgtgggaggggcaggcaccaggaaggtgagggtgctatgtgctcatgcccctcttctgccggccccacttttgtttccgccagtgttttctatactgtgaccctttgcccttacctaggatcattctgtgtccatcttagatcttcgccttatttgtgggagtcttgcaaggttgggagccttgtctcccttgttagactggaagtttctcatgggggagaattctaaaatgggataagaaaaaaatatgttctacaggactttcaagggggtaattgggataatgtatttaatgctctccgtagtaggtactcaaaaaatattagctataccatgaggtttatagcttctaaagagcacagaatatgttttccttttctctccagagtgcctagggcagagctgtgcaagggcctggtatgatgttgtggcaatctcattccccctttcaggtatataatgttgactccaaaacctataatgcctcagtgctgccagtgagagtcgaggtggacatggtgcgagtgatggaggtgttcctggcacagttgcggtgaggtcctggatgatccacttggggacatagtctccttggctgtagaggggagttgcaaagtggaatcaagtcttacctggcagggatatcttggctgtgcctagagccccagggaaaccaagaaaagtttctaaggatcccatcatccttctaagaaggactagtaggtgacaaaatcatttatttttttttttgagacggagtcttgctctgttgcccaggccggagtgcagtggtgccattttggctcactgcaacctccacctcccgggttcaagcaattctctgcctcagcctcccgagtagctgggactacaggtgcccgccaccacaactggctaattttttgtaattttagtagaaacggggtttcaccatcttggccaggctggtcttgaactcctgacctcgtgatccacccgcttaggcctcccaaagtgctgggattacaggcgtgagccactgtgcccagccagcaaaaccagttttaagaaaaatagactcatgaatgtcaggtccatggagtgtgattagggctgcttaagaaaatagctgttaattcttatgctgcctgatggattgagagtggctgcctgaggctctgtgttgaggattctaaggctgtatctgggctcattaggaaagagtattcttctgattgactagcagtgtctctcacggatgcaggcttagagaagcacagcacatgtgccttggcaaaggcagtcctggatcatcccttaatgctaagtcccattggccccatttgttcaaagagagggtagaaaaggtgaaaggattaaactgagttggtgttatcagaagtattttagccatggaacctttttttaaaaaacaagatcttggaaatctaatgtagaaacaggtaaaagcagaaacacctgttgaagcagcgtttggggccaacttgtttggtgttgccccttatgcccccaagaccctgaggtacttccctttaacccctatggttctgggtaagattgaaaatcactggctcaggacagatatttgagaaatcttagccatgatctcccgccttgtggtctcagccaccttgatcttactccgatgttcctacaggttgctctttgggattgctcagccccagctgcctccaaaatgcctgctttcagggcctacgagtgaagggctaatgacctgggagctagaccggctgctctgggctcggtcagtggagaacctggccacagccaccaccacccttacctccctggcgcagcttctgggcaagatcagcaacattgtcattaaggacgacgtggcatctgaggtgtacaaggctgtagctgccgtccagaagtcggcagaagagttggcgtctgggcacctggcatctgcctttgtcgccagccaggaagctgtgacatcctctgagcttgccttctttgacccgtcactcctccacctcctttatttccctgatgaccagaagtttgccatctacatcccactcttcctgcctatggctgtgcccatcctcctgtccctggtcaagatcttcctggagacccgcaagtcctggagaaagcctgagaagacagactgagcagggcagcacctccataggaagccttcctttctggccaaggtgggcggtgttagattgtgaggcacgtacatggggcctgccggaatgacttaaatatttgtctccagtctccactgttggctctccagcaaccaaagtacaacactccaagatgggttcatcttttcttcctttcccattcacctggctcaatcctcctccaccaccaggggcctcaaaaggcacatcatccgggtctccttatcttgtttgataaggctgctgcctgtctccctctgtggcaaggactgtttgttcttttgccccatttctcaacatagcacacttgtgcactgagaggagggagcattatgggaaagtccctgccttccacacctctctctagtccctgtgggacagccctagcccctgctgtcatgaaggggccaggcattggtcacctgtgggaccttctccctcactcccctccctcctagttggctttgtctgtcaggtgcagtctggcgggagtccaggaggcagcagctcaggacatggtgctgtgtgtgtgtgtgtgtgtgtgtgtgtgtgtgtgtgtcagaggttccagaaagttccagatttggaatcaaacagtcctgaattcaaatccttgtttttgcacttattgtctggagagctttggataaggtattgaatctctctgagcctcagtttttcatttgttcaaatggcactgatgatgtctcccttacaagatggttgtgaggagtaaatgtgatcagcatgtaaagtgtctggcgtgtagtaggctcttaataaacactggctgaatatgaattggaatgata

SEQ ID NO: 15603 - DNA, 2658 bp, Homo sapiens
  ENST00000492429
gatgcagacaagtgagagagcttaggcattcaggaagctcagagtagtttagtgtggctgaaatgtgagtgagtgaccaaagatgaagccggttaggcaggcaggagccaggtcataaaggaccatgttaaggagtttgaactttaacctgatatgggtggctagtgattgagggatattaagcagggaactgacataaggtcagatttctggtttgcataaaactatctgtagtaatatgggtacattgtgggagtggccaagaaagctgtcgtagacagtcaaggggcctttgaggagggagaattcgggggtgttttggagctaaggactatgtttccatcggtatggcacatctcgggagaacattctgaagccctttactagagacaccctggacaggaggatatcctaatgattgttagttggggaatcagtcccagagtgagtgaccagcaagttagaggccgacctgggactaaggtccaggtccagcatgttttgatattctgctttccctttataccacaggatccagtgctgcctccttgtaccctgtgctcaactttctactctacgtgcctgagcttgcacactcaccgctgtacattcaggacaaggatggcgctccagtggccaccaatgccttccatagtccccgctggggtggcattatggtaatagtcacactacgcagaccccagagcccatgcttctgggacaggcaggtgtccctgaaactgtgttccttctgttttccttctggtgtcctccatggcccagcctgtgggaggggcaggcaccaggaaggtgagggtgctatgtgctcatgcccctcttctgccggccccacttttgtttccgccagtgttttctatactgtgaccctttgcccttacctaggatcattctgtgtccatcttagatcttcgccttatttgtgggagtcttgcaaggttgggagccttgtctcccttgttagactggaagtttctcatgggggagaattctaaaatgggataagaaaaaaatatgttctacaggactttcaagggggtaattgggataatgtatttaatgctctccgtagtaggtactcaaaaaatattagctataccatgaggtttatagcttctaaagagcacagaatatgttttccttttctctccagagtgcctagggcagagctgtgcaagggcctggtatgatgttgtggcaatctcattccccctttcaggtatataatgttgactccaaaacctataatgcctcagtgctgccagtgagagtcgaggtggacatggtgcgagtgatggaggtgttcctggcacagttgcggttgctctttgggattgctcagccccagctgcctccaaaatgcctgctttcagggcctacgagtgaagggctaatgacctgggagctagaccggctgctctgggctcggtcagtggagaacctggccacagccaccaccacccttacctccctggcgcagcttctgggcaagatcagcaacattgtcattaaggacgacgtggcatctgaggtgtacaaggctgtagctgccgtccagaagtcggcagaagagttggcgtctgggcacctggcatctgcctttgtcgccagccaggaagctgtgacatcctctgagcttgccttctttgacccgtcactcctccacctcctttatttccctgatgaccagaagtttgccatctacatcccactcttcctgcctatggctgtgcccatcctcctgtccctggtcaagatcttcctggagacccgcaagtcctggagaaagcctgagaagacagactgagcagggcagcacctccataggaagccttcctttctggccaaggtgggcggtgttagattgtgaggcacgtacatggggcctgccggaatgacttaaatatttgtctccagtctccactgttggctctccagcaaccaaagtacaacactccaagatgggttcatcttttcttcctttcccattcacctggctcaatcctcctccaccaccaggggcctcaaaaggcacatcatccgggtctccttatcttgtttgataaggctgctgcctgtctccctctgtggcaaggactgtttgttcttttgccccatttctcaacatagcacacttgtgcactgagaggagggagcattatgggaaagtccctgccttccacacctctctctagtccctgtgggacagccctagcccctgctgtcatgaaggggccaggcattggtcacctgtgggaccttctccctcactcccctccctcctagttggctttgtctgtcaggtgcagtctggcgggagtccaggaggcagcagctcaggacatggtgctgtgtgtgtgtgtgtgtgtgtgtgtgtgtgtgtgtgtcagaggttccagaaagttccagatttggaatcaaacagtcctgaattcaaatccttgtttttgcacttattgtctggagagctttggataaggtattgaatctctctgagcctcagtttttcatttgttcaaatggcactgatgatgtctcccttacaagatggttgtgaggagtaaatgtgatcagcatgtaaagtgtctggcgtgtagtaggctcttaataaacactggctgaatatgaattggaatgata

SEQ ID NO: 15604 - DNA, 2815 bp, Homo sapiens
  ENST00000395346
agctctgcccccacggtggccggagcagccggaagctagcatggcggccgccggggctgcggctacacacctaggtgcggtgggcttcgggtggggggcctgcagctagctgatggcaagggaggaatagcaggggtggggattgtggtgtgcgagaggtcccgcggacggggggctcgggggtctcttcagacgagattcccttcaggcttgggccgggtcccttcgcacggagatcccaatgaacgcgggcccctggaggccggtggttggggcttctccgcgtcggggatggggccggtaccctagcccgtttccagcgcctcagtcggttccccatgccctcagaggtggcccggggcaagcgcgccgccctcttcttcgctgcggtggccatcgtgctggggctaccgctctggtggaagaccacggagacctaccgggcctcgttgccttactcccagatcagtggcctgaatgcccttcagctccgcctcatggtgcctgtcactgtcgtgtttacgcgggagtcagtgcccctggacgaccaggagaagctgcccttcaccgttgtgcatgaaagagagattcctctgaaatacaaaatgaaaatcaaatgccgtttccagaaggcctatcggagggctttggaccatgaggaggaggccctgtcatcgggcagtgtgcaagaggcagaagccatgttagatgagcctcaggaacaagcggagggctccctgactgtgtacgtgatatctgaacactcctcacttcttccccaggacatgatgagctacattgggcccaagaggacagcagtggtgcgggggataatgcaccgggaggcctttaacatcattggccgccgcatagtccaggtggcccaggccatgtctttgactgaggatgtgcttgctgctgctctggctgaccaccttccagaggacaagtggagcgctgagaagaggcggcctctcaagtccagcttgggctatgagatcaccttcagtttactcaacccagaccccaagtcccatgatgtctactgggacattgagggggctgtccggcgctatgtgcaacctttcctgaatgccctcggtgccgctggcaacttctctgtggactctcagattctttactatgcaatgttgggggtgaatccccgctttgactcagcttcctccagctactatttggacatgcacagcctcccccatgtcatcaacccagtggagtcccggctgggatccagtgctgcctccttgtaccctgtgctcaactttctactctacgtgcctgagcttgcacactcaccgctgtacattcaggacaaggatggcgctccagtggccaccaatgccttccatagtccccgctggggtggcattatggtatataatgttgactccaaaacctataatgcctcagtgctgccagtgagagtcgaggtggacatggtgcgagtgatggaggtgttcctggcacagttgcggttgctctttgggattgctcagccccagctgcctccaaaatgcctgctttcagggcctacgagtgaagggctaatgacctgggagctagaccggctgctctgggctcggtcagtggagaacctggccacagccaccaccacccttacctccctggcgcagcttctgggcaagatcagcaacattgtcattaaggacgacgtggcatctgaggtgtacaaggctgtagctgccgtccagaagtcggcagaagagttggcgtctgggcacctggcatctgcctttgtcgccagccaggaagctgtgacatcctctgagcttgccttctttgacccgtcactcctccacctcctttatttccctgatgaccagaagtttgccatctacatcccactcttcctgcctatggctgtgcccatcctcctgtccctggtcaagatcttcctggagacccgcaagtcctggagaaagcctgagaagacagactgagcagggcagcacctccataggaagccttcctttctggccaaggtgggcggtgttagattgtgaggcacgtacatggggcctgccggaatgacttaaatatttgtctccagtctccactgttggctctccagcaaccaaagtacaacactccaagatgggttcatcttttcttcctttcccattcacctggctcaatcctcctccaccaccaggggcctcaaaaggcacatcatccgggtctccttatcttgtttgataaggctgctgcctgtctccctctgtggcaaggactgtttgttcttttgccccatttctcaacatagcacacttgtgcactgagaggagggagcattatgggaaagtccctgccttccacacctctctctagtccctgtgggacagccctagcccctgctgtcatgaaggggccaggcattggtcacctgtgggaccttctccctcactcccctccctcctagttggctttgtctgtcaggtgcagtctggcgggagtccaggaggcagcagctcaggacatggtgctgtgtgtgtgtgtgtgtgtgtgtgtgtgtgtgtgtgtcagaggttccagaaagttccagatttggaatcaaacagtcctgaattcaaatccttgtttttgcacttattgtctggagagctttggataaggtattgaatctctctgagcctcagtttttcatttgttcaaatggcactgatgatgtctcccttacaagatggttgtgaggagtaaatgtgatcagcatgtaaagtgtctggcgtgtagtaggctcttaataaacactggctgaatatgaattggaatgata

SEQ ID NO: 15605 - DNA, 2877 bp, Homo sapiens
  ENST00000308360
tccattttcagatgagcctcggagctgcctgtagttgcccagctagtatttaaggactgcagaggttgcgctcttgattgcggggctagaagtgtgttctacagggaagcggggaacttcgttccagcagcgccgaaacccgcacggcccctaggctgtccctccgcgcccgggtgacttcctttcagatccccagcgaagctcccagcggagccctcccacccctcgcccgcttgctcccgtctgcgggtctggagtagcgctcgcgattggccccgatcaccgccgcggtcctgccccctcgttgcagagattccgattgggtgaggctcacgaagctctgcccccacggtggccggagcagccggaagctagcatggcggccgccggggctgcggctacacacctagaggtggcccggggcaagcgcgccgccctcttcttcgctgcggtggccatcgtgctggggctaccgctctggtggaagaccacggagacctaccgggcctcgttgccttactcccagatcagtggcctgaatgcccttcagctccgcctcatggtgcctgtcactgtcgtgtttacgcgggagtcagtgcccctggacgaccaggagaagctgcccttcaccgttgtgcatgaaagagagattcctctgaaatacaaaatgaaaatcaaatgccgtttccagaaggcctatcggagggctttggaccatgaggaggaggccctgtcatcgggcagtgtgcaagaggcagaagccatgttagatgagcctcaggaacaagcggagggctccctgactgtgtacgtgatatctgaacactcctcacttcttccccaggacatgatgagctacattgggcccaagaggacagcagtggtgcgggggataatgcaccgggaggcctttaacatcattggccgccgcatagtccaggtggcccaggccatgtctttgactgaggatgtgcttgctgctgctctggctgaccaccttccagaggacaagtggagcgctgagaagaggcggcctctcaagtccagcttgggctatgagatcaccttcagtttactcaacccagaccccaagtcccatgatgtctactgggacattgagggggctgtccggcgctatgtgcaacctttcctgaatgccctcggtgccgctggcaacttctctgtggactctcagattctttactatgcaatgttgggggtgaatccccgctttgactcagcttcctccagctactatttggacatgcacagcctcccccatgtcatcaacccagtggagtcccggctgggatccagtgctgcctccttgtaccctgtgctcaactttctactctacgtgcctgagcttgcacactcaccgctgtacattcaggacaaggatggcgctccagtggccaccaatgccttccatagtccccgctggggtggcattatggtatataatgttgactccaaaacctataatgcctcagtgctgccagtgagagtcgaggtggacatggtgcgagtgatggaggtgttcctggcacagttgcggttgctctttgggattgctcagccccagctgcctccaaaatgcctgctttcagggcctacgagtgaagggctaatgacctgggagctagaccggctgctctgggctcggtcagtggagaacctggccacagccaccaccacccttacctccctggcgcagcttctgggcaagatcagcaacattgtcattaaggacgacgtggcatctgaggtgtacaaggctgtagctgccgtccagaagtcggcagaagagttggcgtctgggcacctggcatctgcctttgtcgccagccaggaagctgtgacatcctctgagcttgccttctttgacccgtcactcctccacctcctttatttccctgatgaccagaagtttgccatctacatcccactcttcctgcctatggctgtgcccatcctcctgtccctggtcaagatcttcctggagacccgcaagtcctggagaaagcctgagaagacagactgagcagggcagcacctccataggaagccttcctttctggccaaggtgggcggtgttagattgtgaggcacgtacatggggcctgccggaatgacttaaatatttgtctccagtctccactgttggctctccagcaaccaaagtacaacactccaagatgggttcatcttttcttcctttcccattcacctggctcaatcctcctccaccaccaggggcctcaaaaggcacatcatccgggtctccttatcttgtttgataaggctgctgcctgtctccctctgtggcaaggactgtttgttcttttgccccatttctcaacatagcacacttgtgcactgagaggagggagcattatgggaaagtccctgccttccacacctctctctagtccctgtgggacagccctagcccctgctgtcatgaaggggccaggcattggtcacctgtgggaccttctccctcactcccctccctcctagttggctttgtctgtcaggtgcagtctggcgggagtccaggaggcagcagctcaggacatggtgctgtgtgtgtgtgtgtgtgtgtgtgtgtgtgtgtgtgtcagaggttccagaaagttccagatttggaatcaaacagtcctgaattcaaatccttgtttttgcacttattgtctggagagctttggataaggtattgaatctctctgagcctcagtttttcatttgttcaaatggcactgatgatgtctcccttacaagatggttgtgaggagtaaatgtgatcagcatgtaaagtgtctggcgtgtagtaggctcttaataaacactggctgaatatgaattggaatgata

SEQ ID NO: 15606 - DNA, 919 bp, Homo sapiens
  ENST00000484580
cagtgttcctcatcccagttttgtcctccttttggttccatgatggaaagcagccccattccagaggagaaacaagttcagctcagctgggagtacaggctgcccctcttctttgatccacaagagcctctgacttccctgactcctgtttctgtaggctatgagatcaccttcagtttactcaacccagaccccaagtcccatgatgtctactgggacattgagggggctgtccggcgctatgtgcaacctttcctgaatgccctcggtgccgctggcaacttctctgtggactctcagattctttactatgcaatgttgggggtgaatccccgctttgactcagcttcctccagctactatttggacatgcacagcctcccccatgtcatcaacccagtggagtcccggctgggatccagtgctgcctccttgtaccctgtgctcaactttctactctacgtgcctgagcttgcacactcaccgctgtacattcaggacaaggatggcgctccagtggccaccaatgccttccatagtccccgctggggtggcattatggtaatagtcacactacgcagaccccagagcccatgcttctgggacaggcaggtgtccctgaaactgtgttccttctgttttccttctggtgtcctccatggcccagcctgtgggaggggcaggcaccaggaaggtgagggtgctatgtgctcatgcccctcttctgccggccccacttttgtttccgccagtgttttctatactgtgaccctttgcccttacctaggatcattctgtgtccatcttagatcttcgccttatttgtgggagtcttgcaaggttgggagccttgtctcccttgttagactggaagtttctcatgggggagaattctaaaatgggataagaaaaaaatatg

SEQ ID NO: 15607 - DNA, 699 bp, Homo sapiens
  ENST00000582615
gattggcttacccaagcctgaccactgtgtcagctgaatgtgagtgaaggggtgggttaggcattctttggggctggggggagatggaatggtgttttgctcttggtgtaccacctgttcttgcccccagaggcagaagccatgttagatgagcctcaggaacaagcggagggctccctgactgtgtacgtgatatctgaacactcctcacttcttccccaggacatgatgagctacattgggcccaagaggacagcagtggtgcgggggataatgcaccgggaggcctttaacatcattggccgccgcatagtccaggtggcccaggccatgtctttgactgaggatgtgcttgctgctgctctggctgaccaccttccagaggacaagtggagcgctgagaagaggcggcctctcaagtccagcttgggctatgagatcaccttcagtttactcaacccagaccccaagtcccatgatgtctactgggacattgagggggctgtccggcgctatgtgcaacctttcctgaatgccctcggtgccgctggcaacttctctgtggactctcagattctttactatgcaatgttgggggtgaatccccgctttgactcagcttcctccagctactatttggacatgcacagcctcccccatgtcatcaacccagtggagtcccggctgggatccagtgct

SEQ ID NO: 15608 - DNA, 608 bp, Homo sapiens
  ENST00000577620
tatatactcatagctcagaaatgctgagttaatagctcatgaatctcaagagaggtgcaaacctgttggtcattggcaaaggggcagattcggaacagtaggagccagggtgctttttggctttcttttctgagccatgggcattctgtctcttgctcacccccacaggacatgatgagctacattgggcccaagaggacagcagtggtgcgggggataatgcaccgggaggcctttaacatcattggccgccgcatagtccaggtggcccaggccatgtctttgactgaggatgtgcttgctgctgctctggctgaccaccttccagaggacaagtggagcgctgagaagaggcggcctctcaagtccagcttgggctatgagatcaccttcagtttactcaacccagaccccaagtcccatgatgtctactgggacattgagggggctgtccggcgctatgtgcaacctttcctgaatgccctcggtgccgctggcaacttctctgtggactctcagattctttactatgcaatgttgggggtgaatccccgctttgactcagcttcctccagctactatttggacatgcacagcctcccccatgt

SEQ ID NO: 15609 - DNA, 578 bp, Homo sapiens
  ENST00000465444
agaggttgattggcttacccaagcctgaccactgtgtcagctgaataggcagaagccatgttagatgagcctcaggaacaagcggagggctccctgactgtgtacgtgatatctgaacactcctcacttcttccccaggacatgatgagctacattgggcccaagaggacagcagtggtgcgggggataatgcaccgggaggcctttaacatcattggccgccgcatagtccaggtggcccaggccatgtctttgactgaggatgtgcttgctgctgctctggctgaccaccttccagaggacaagtggagcgctgagaagaggcggcctctcaagtccagcttgggctatgagatcaccttcagtttactcaacccagaccccaagtcccatgatgtctactgggacattgagggggctgtccggcgctatgtgcaacctttcctgaatgccctcggtgccgctggcaacttctctgtggactctcagattctttactatgcaatgttgggggtgaatccccgctttgactcagcttcctccagctactatttggacatgcacagcctcccccatgt

SEQ ID NO: 15610 - DNA, 372 bp, Homo sapiens
  ENST00000580968
agagaggttgattggcttacccaagcctgaccactgtgtcagctgaataggcagaagccatgttagatgagcctcaggaacaagcggagggctccctgactgtgtacgtgatatctgaacactcctcacttcttccccaggctatgagatcaccttcagtttactcaacccagaccccaagtcccatgatgtctactgggacattgagggggctgtccggcgctatgtgcaacctttcctgaatgccctcggtgccgctggcaacttctctgtggactctcagattctttactatgcaatgttgggggtgaatccccgctttgactcagcttcctccagctactatttggacatgcacagcctcccccatgt

SEQ ID NO: 15611 - DNA, 584 bp, Homo sapiens
  ENST00000584080
acgaagctctgcccccacggtggccggagcagccggaagctagcatggcggccgccggggctgcggctacacacctagctccgcctcatggtgcctgtcactgtcgtgtttacgcgggagtcagtgcccctggacgaccaggagaagctgcccttcaccgttgtgcatgaaagagagattcctctgaaatacaaaatgaaaatcaaatgccgtttccagaaggcctatcggagggctttggaccatgaggaggaggccctgtcatcgggcagtgtgcaagaggcagaagccatgttagatgagcctcaggaacaagcggagggctccctgactgtgtacgtgatatctgaacactcctcacttcttccccaggctatgagatcaccttcagtttactcaacccagaccccaagtcccatgatgtctactgggacattgagggggctgtccggcgctatgtgcaacctttcctgaatgccctcggtgccgctggcaacttctctgtggactctcagattctttactatgcaatgttgggggtgaatccccgctttgactcagcttcctccagctactatttggac

SEQ ID NO: 15612 - DNA, 594 bp, Homo sapiens
  ENST00000582721
gaagctctgcccccacggtggccggagcagccggaagctagcatggcggccgccggggctgcggctacacacctagaggtggcccggggcaagcgcgccgccctcttcttcgctgcggtggccatcgtgctggggctaccgctctggtggaagaccacggagacctaccgggcctcgttgccttactcccagatcagtggcctgaatgcccttcaggtgagactgctgtgcgggagggtcgggggacagcccccccggcaaggtggagactcagtgacggccctgatgctccttcctgtagctccgcctcatggtgcctgtcactgtcgtgtttacgcgggagtcagtgcccctggacgaccaggagaagctgcccttcaccgttgtgcatgaaagagagattcctctgaaatacaaaatgaaaatcaaatgccgtttccagaaggcctatcggagggctttggaccatgaggaggaggccctgtcatcgggcagtgtgcaagaggcagaagccatgttagatgagcctcaggaacaagcggagggctccctgactgtgtacgtgatatctgaacactcctcacttcttcccca

SEQ ID NO: 15613 - DNA, 481 bp, Homo sapiens
  ENST00000577594
agccggaagctagcatggcggccgccggggctgcggctacacacctagaggtggcccggggcaagcgcgccgccctcttcttcgctgcggtggccatcgtgctggggctaccgctctggtggaagaccacggagacctaccgggcctcgttgccttactcccagatcagtggcctgaatgcccttcagctccgcctcatggtgcctgtcactgtcgtgtttacgcgggagtcagtgcccctggacgaccaggagaagctgcccttcaccgttgtgcatgaaagagagattcctctgaaatacaaaatgaaaatcaaatgccgtttccagaaggcctatcggagggctttggaccatgaggaggaggccctgtcatcgggcagtgtgcaaggtatgggaagggatgagcacaccattttaatgtgaagccctctttttccttctgatctctaagtgcatagttcccatgctttggcttactt

SEQ ID NO: 15614 - DNA, 546 bp, Homo sapiens
  ENST00000583631
aagctagcatggcggccgccggggctgcggctacacacctaggtgcggtgggcttcgggtggggggcctgcagctagctgatggcaagggaggaatagcaggggtggggattgtggtgtgcgagaggtcccgcggacggggggctcgggggtctcttcagacgagattcccttcaggcttgggccgggtcccttcgcacggagatcccaatgaacgcgggcccctggaggccggtggttggggcttctccgcgtcggggatggggccggtaccctagcccgtttccagcgcctcagtcggttccccatgccctcagaggtggcccggggcaagcgcgccgccctcttcttcgctgcggtggccatcgtgctggggctaccgctctggtggaagaccacggagacctaccgggcctcgttgccttactcccagatcagtggcctgaatgcccttcagacaaaatgaaaatcaaatgccgtttccagaaggcctatcggagggctttggaccatgaggaggaggccctgtcatcgggcagtgtgcaag

SEQ ID NO: 15615 - DNA, 577 bp, Homo sapiens
  ENST00000584413
tgcggggctagaagtgtgttctacagggaagcggggaacttcgttccagcagcgccgaaacccgcacggcccctaggctgtccctccgcgcccgggtgacttcctttcagatccccagcgaagctcccagcggagccctcccacccctcgcccgcttgctcccgtctgcgggtctggagtagcgctcgcgattggccccgatcaccgccgcggtcctgccccctcgttgcagagattccgattggaggtggcccggggcaagcgcgccgccctcttcttcgctgcggtggccatcgtgctggggctaccgctctggtggaagaccacggagacctaccgggcctcgttgccttactcccagatcagtggcctgaatgcccttcagctccgcctcatggtgcctgtcactgtcgtgtttacgcgggagtcagtgcccctggacgaccaggagaagctgcccttcaccgttgtgcatgaaagagagattcctctgaaatacaaaatgaaaatcaaatgccgtttccagaaggcctatcggagggctttggaccatgaggaggaggccctgtcatcgggc

SEQ ID NO: 15616 - DNA, 2701 bp, Homo sapiens
  ENST00000412723
agtctccgcgctgctgaggcgcgcccggccgctcccacggcctcccctccgccctgcggtcccgccgcctccggggcctcctgggaccctggccctcgccgggcaggacgccgccagcgctgaaggcgcagcccggaggccgcgcggatgcagatctgtggatccagcgtagcatctgtagcagctgggacatcattccaggttttgggcccggtgtgttggcaacaactggatctgaagatggcagtcagggtgctttggggtggtctcagcctgctccgagtgctgtggtgtctccttccgcagacgggctatgtgcacccagatgagttcttccagtcccctgaggtgatggcagaggacatcctgggcgttcaggccgcgcggccctgggagttttaccccagcagctcctgccgctcggtgctcttccccctgctgatctctggttccaccttctggctgctcaggctctgggaggagctggggccgtggcctggcctggtgagcggctatgcgctgctggtggggcctcgactcctcctcactgccctttcctttgctctggacggggccgtgtaccacctggccccgccgatgggggcggatcgctggaacgccctggccctgctgtctggttcctacgtcaccctggtcttctacacaaggaccttctccaacaccattgagggactcctcttcacgtggctgctggtgctggtatcctcccatgtaacgtggggccctacacgcaaggagccggcgccgggtccacggtggcgcagctggcttcttggaggcattgtggctgctggcttcttcaaccggcccacctttctggcctttgctgtggtccccctctacctctggggcactcgtggagccacaaaccctggtttgaagtctctgacccgggaggccctggtgctgctccctggggcagccctcacagcagcggtgtttgtggccacggacagctggtatttctccagccccgctacatccaggaaccttgtcctgacacctgtcaacttcttgcactacaacctgaatccccaaaacctggcgagacatggcacgcacgcgcggctcactcacctggcagtcaacggcttcctgctcttcggggtgctgcatgcccaggccctgcaggctgcgtggcaacggctgcaagtcggcctccaggcctctgcacaaatgggcctcctgagggcactgggtgcccggagcctgctgtccagccccaggtcctatctccttctcctctacttcatgcctctggccctgctatctgcctttagccaccaggaggctcggttcctgattcccctcctggtccccctggtcctgctttgtagtccacagacgcagcctgtgccttggaagggcactgtggtcctcttcaacgccctcggtgccctcctcttcggctgcctgcatcaggggggcctggtgcctggcctggagtacctggagcaggtggtccatgcccctgtgctcccaagcacacccacccactacacactcctcttcactcacacctacatgcccccccggcacctcctacacctcccaggcctgggggcaccagtggaggtggtggacatgggggggactgaggactgggccctgtgccaaaccctgaaaagcttcaccagacaaccagcctgccaagtggctggtgggccatggctctgccgcctctttgtggtaacccctggcaccaccaggcgtgccgtggagaagtgcagcttccccttcaagaatgaaacacttttatttccccatctgaccctggaggatccaccagccctgtcctccttgctgagtggggcttggagggaccacctcagtcttcacattgtggagctgggggaagaaacctgacaatatgacagagcacccactgcccaagactcagccatagaagatgccgccccaccttctacttgggtagctgggctgggacgctgggacaggaccccgtcctccttcatgactcccactgctgcctctcctgggcatggctgttagctgttctgccttctgggtgagctggcactcttctccctgagaccaaagatttgacctgtcggtcttgatgtcaaggtccccaaagaccaggttaagtgacgacacctgtctgttcctgccctgttgcttccagccactgtgatgtttgaaatatgtgatagtacctggttgtgaaaaaagacaatgaactgctagtgacattcctcaatgacctctcccaaacctcccatgatgccttacccttgctgtcatgacaaccctctggcttcctaagacccatctgcctatcgaaatatgtgcaagtcagtgagacgaagtatagagaacaggtggcccagatccaggggacccaacttctggccccttggtctgtcacctcctcgctgtgtgatcttgagaaagctccttccactcacccaccccacttcccagtctgttgggatcagaggaactttgaggtgtctgccggctaacattgtgtcattcctggagtccacagtacacgtcccctgcctcaacaggcacagctctcacaaagctcttcaagcatggaagtgggagttgtgttgtacttcatggcactctgatgcctgctgtctcagtgtttggttattatgcaaacaagtaatgtttgaaatatataatagcactggagattttctcccta

SEQ ID NO: 15617 - DNA, 1947 bp, Homo sapiens
  ENST00000413127
cagggtgctttggggtggtctcagcctgctccgagtgctgtggtgtctccttccgcagacgggctatgtgcacccagatgagttcttccagtcccctgaggtgatggcaggctctgggaggagctggggccgtggcctggcctggtgagcggctatgcgctgctggtggggcctcgactcctcctcactgccctttcctttgctctggacggggccgtgtaccacctggccccgccgatgggggcggatcgctggaacgccctggccctgctgtctggttcctacgtcaccctggtcttctacacaaggaccttctccaacaccattgagggactcctcttcacgtggctgctggtgctggtatcctcccatgtaacgtggggccctacacgcaaggagccggcgccgggtccacggtggcgcagctggcttcttggaggcattgtggctgctggcttcttcaaccggcccacctttctggcctttgctgtggtccccctctacctctggggcactcgtggagccacaaaccctggtttgaagtctctgacccgggaggccctggtgctgctccctggggcagccctcacagcagcggtgtttgtggccacggacagctggtatttctccagccccgctacatccaggaaccttgtcctgacacctgtcaacttcttgcactacaacctgaatccccaaaacctggcgagacatggcacgcacgcgcggctcactcacctggcagtcaacggcttcctgctcttcggggtgctgcatgcccaggccctgcaggctgcgtggcaacggctgcaagtcggcctccaggcctctgcacaaatgggcctcctgagggcactgggtgcccggagcctgctgtccagccccaggtcctatctccttctcctctacttcatgcctctggccctgctatctgcctttagccaccaggaggctcggttcctgattcccctcctggtccccctggtcctgctttgtagtccacagacgcagcctgtgccttggaagggcactgtggtcctcttcaacgccctcggtgccctcctcttcggctgcctgcatcaggggggcctggtgcctggcctggagtacctggagcaggtggtccatgcccctgtgctcccaagcacacccacccactacacactcctcttcactcacacctacatgcccccccggcacctcctacacctcccaggcctgggggcaccagtggaggtggtggacatgggggggactgaggactgggccctgtgccaaaccctgaaaagcttcaccagacaaccagcctgccaagtggctggtgggccatggctctgccgcctctttgtggtaacccctggcaccaccaggcgtgccgtggagaagtgcagcttccccttcaagaatgaaacacttttatttccccatctgaccctggaggatccaccagccctgtcctccttgctgagtggggcttggagggaccacctcagtcttcacattgtggagctgggggaagaaacctgacaatatgacagagcacccactgcccaagactcagccatagaagatgccgccccaccttctacttgggtagctgggctgggacgctgggacaggaccccgtcctccttcatgactcccactgctgcctctcctgggcatggctgttagctgttctgccttctgggtgagctggcactcttctccctgagaccaaagatttgacctgtcggtcttgatgtcaaggtccccaaagaccaggttaagtgacgacacctgtctgttcctgccctgttgcttccagccactgtgatgtttgaaatatgtgatagtacctggttgtgaaaaaagacaatgaactgctagtgacattcctcaatgacctctcccaaacctcccatgatgccttacccttgctgtcatgacaaccctctggcttcctaa

SEQ ID NO: 15618 - DNA, 675 bp, Homo sapiens
  ENST00000443835
tccctcccggcccgccctgcgccggcggcggcggccccagtctccgcgctgctgaggcgcgcccggccgctcccacggcctcccctccgccctgcggtcccgccgcctccggggcctcctgggaccctggccctcgccgggcaggacgccgccagcgctgaaggcgcagcccggaggccgcgcggatgcagatctgtggatccagcgtagcatctgtagcagctgggacatcattccaggttttgggcccggtgtgttggcaacaactggatctgaagatggcagtcagggtgctttggggtggtctcagcctgctccgagtgctgtggtgtctccttccgcagacgggctatgtgcacccagatgagttcttccagtcccctgaggtgatggcaggaccttctccaacaccattgagggactcctcttcacgtggctgctggtgctggtatcctcccatgtaacgtggggccctacacgcaaggagccggcgccgggtccacggtggcgcagctggcttcttggaggcattgtggctgctggcttcttcaaccggcccacctttctggcctttgctgtggtccccctctacctctggggcactcgtggagccacaaaccctggtttgaagtctctgacccgggaggccctggtgctgctccctggggcagccct

SEQ ID NO: 15619 - DNA, 868 bp, Homo sapiens
  ENST00000238138
aggggccgccggggagggagcccgagcgcggcggggcgagaccggtccccgcccggcgttgcccggcccgagggacggcggcgcccccaggaccctccccagcgcggccccagctcgctccgggaccgcggggccaggccgggcgggagcgcggggacgtacacggcggccccgcccgcgcgctcctcctccctcccggcccgccctgcgccggcggcggcggccccagtctccgcgctgctgaggcgcgcccggccgctcccacggcctcccctccgccctgcggtcccgccgcctccggggcctcctgggaccctggccctcgccgggcaggacgccgccagcgctgaaggcgcagcccggaggccgcgcggatgcagatctgtggatccagcgtagcatctgtagcagctgggacatcattccaggttttgggcccggtgtgttggcaacaactggatctgaagatggcagtcagggtgctttggggtggtctcagcctgctccgagtgctgtggtgtctccttccgcagacgggctatgtgcacccagatgagttcttccagtcccctgaggtgatggcaggtaaaactccgcatgtgtggctgagacaagctgcagcagagtctgcttgagaagctgacgggagactttgtggggagggagtagcatgtctgggtagatgagtagtaaatccacaagcagagcagcagcctctctctctggggtaagaacttggaagtggggacttcatatctccttcccgagtggtgacactgaccttctgggtaatgctaataaaccaccagtctctttgatgtatccctgcttggaccaacaatacaggtcattcagaatgagagctgtg

SEQ ID NO: 15620 - DNA, 1652 bp, Homo sapiens
  ENST00000372453
cgccacgctctgcacagtctattttcggagcctagccagagacgggaaaactgaccaagataatggaatctgaaaatatggattctgaaaatatgaagacagaaaatatggaatctcaaaatgtagactttgagagtgtttcttcagttacagctctggaagccctctctaagctacttaatcctgaagaagaggatgattctgactatggacagacaaatggtttatctactattggagccatgggtcctgggaatattggaccaccccaaatagaagagctcaaagtcatccctgaaaccagcgaggaaaataatgaggacatctggaattcagaagagattccagaaggagcagaatatgatgatatgtgggatgttagagaaatcccagagtatgagattatattcagacagcaggtgggaactgaagatatatttttagggttgtcaaaaaaggactcctcaacaggttgttgcagtgaactagtggctaaaattaaattgccaaatacaaacccttctgatattcaaattgatatccaggaaacaatccttgaccttcgtactcctcagaagaagctgttgataactcttcctgagctggtggaatgtaccagtgccaaagcattctatatcccagagactgaaactcttgaaatcactatgactatgaaaagagagttagatattgctaatttcttctgaaactgcatgaaaaagataaaaagtagtaaaatggcattggtaacaattaaaaaactttgaaaaaaatgattgttttctatattctctttattattctgacatatttttgaaagggacaaaattcagttctagtgatattgtgaccatttacagtaatttctattactctgttaggaaatatgtttccttggccaggtgcaatggctcatgcctgtaatcccaacactttgggaggccgaagcaggcggatcacttgaggtcaggagtttgagaccagcctggtcaacatggcgaaaccctgtctctactaaaaatacgaaaattagcctggcgtggtggcaggtgcctgtaatcccagctactctgtctcaaaaaacaaacaaaaaaaggaaatatgttttcttatgtaaataaactattctatttttatagtgatagctgagtagaatctttacaggttaaaaaattagaatatttcatggtcaattacataattgaaatatgatcatgaaatggttggtccacttacttcagtagtctgaaaaacttatgctaattatttacatttacactgtgatacaatcagttgcatagcaattggtcattattattaccagagaattttatttggttgctttttcattgatttgagcaaatgatttacagtgttctctgtttaggctctcactgttgttctggaatatacaggtaataaatagtttgatgtaccatactatcaacatatttacttgagtaaggaacacttttgtgcgtacagtattatttggcttcttcagttgtgcttttaatgcttggatatagttaggttaaaaacattttttatatgcactaataattattagcattgcctttttgggtactgtatttatatgtagtcaattgaaatccttgactttaaaataaatttaaagtgtggcacattta

SEQ ID NO: 15621 - DNA, 993 bp, Homo sapiens
  ENST00000336387
gcacgatttatcctggcctagcatgccttggttaggaaatgttttgggggatatcacacttcagactgaaaaaaaaatggccccagtacttactacgtgaataatgtcctttgtgcgacaacttgaacgctgtggtctgagggttccagtgttgcttggttagataagctgaggagtgagaagtaatcagaccttcacttggtgggcccgagtgtactgtgcagagactacttgtacctacaagacctgctactcgccaagggctgattgggagagtaaataatggaatctgaaaatatggattctgaaaatatgaagacagaaaatatggaatctcaaaatgtagactttgagagtgtttcttcagttacagctctggaagccctctctaagctacttaatcctgaagaagaggatgattctgactatggacagacaaatggtttatctactattggagccatgggtcctgggaatattggaccaccccaaatagaagagctcaaagtcatccctgaaaccagcgaggaaaataatgaggacatctggaattcagaagagattccagaaggagcagaatatgatgatatgtgggatgttagagaaatcccagagtatgagattatattcagacagcaggtgggaactgaagatatatttttagggttgtcaaaaaaggactcctcaacaggttgttgcagtgaactagtggctaaaattaaattgccaaatacaaacccttctgatattcaaattgatatccaggaaacaatccttgaccttcgtactcctcagaagaagctgttgataactcttcctgagctggtggaatgtaccagtgccaaagcattctatatcccagagactgaaactcttgaaatcactatgactatgaaaagagagttagatattgctaatttcttctgaaactgcatgaaaaagataaaaagtagtaaaatggcattggtaacaattaaaaaactttgaaaaaaa

SEQ ID NO: 15622 - DNA, 1926 bp, Homo sapiens
  ENST00000535523
cgccacgctctgcacagtctattttcggagcctagccagagacgggaaaactgaccaaggcacgatttatcctggcctagcatgccttggttaggaaatgttttgggggatatcacacttcagactgaaaaaaaaatggccccagtacttactacgtgaataatgtcctttgtgcgacaacttgaacgctgtggtctgagggttccagtgttgcttggttagataagctgaggagtgagaagtaatcagaccttcacttggtgggcccgagtgtactgtgcagagactacttgtacctacaagacctgctactcgccaagggctgattgggagaataatggaatctgaaaatatggattctgaaaatatgaagacagaaaatatggaatctcaaaatgtagactttgagagtgtttcttcagttacagctctggaagccctctctaagctacttaatcctgaagaagaggatgattctgactatggacagacaaatggtttatctactattggagccatgggtcctgggaatattggaccaccccaaatagaagagctcaaagtcatccctgaaaccagcgaggaaaataatgaggacatctggaattcagaagagattccagaaggagcagaatatgatgatatgtgggatgttagagaaatcccagagtatgagattatattcagacagcaggtgggaactgaagatatatttttagggttgtcaaaaaaggactcctcaacaggttgttgcagtgaactagtggctaaaattaaattgccaaatacaaacccttctgatattcaaattgatatccaggaaacaatccttgaccttcgtactcctcagaagaagctgttgataactcttcctgagctggtggaatgtaccagtgccaaagcattctatatcccagagactgaaactcttgaaatcactatgactatgaaaagagagttagatattgctaatttcttctgaaactgcatgaaaaagataaaaagtagtaaaatggcattggtaacaattaaaaaactttgaaaaaaatgattgttttctatattctctttattattctgacatatttttgaaagggacaaaattcagttctagtgatattgtgaccatttacagtaatttctattactctgttaggaaatatgtttccttggccaggtgcaatggctcatgcctgtaatcccaacactttgggaggccgaagcaggcggatcacttgaggtcaggagtttgagaccagcctggtcaacatggcgaaaccctgtctctactaaaaatacgaaaattagcctggcgtggtggcaggtgcctgtaatcccagctactctgtctcaaaaaacaaacaaaaaaaggaaatatgttttcttatgtaaataaactattctatttttatagtgatagctgagtagaatctttacaggttaaaaaattagaatatttcatggtcaattacataattgaaatatgatcatgaaatggttggtccacttacttcagtagtctgaaaaacttatgctaattatttacatttacactgtgatacaatcagttgcatagcaattggtcattattattaccagagaattttatttggttgctttttcattgatttgagcaaatgatttacagtgttctctgtttaggctctcactgttgttctggaatatacaggtaataaatagtttgatgtaccatactatcaacatatttacttgagtaaggaacacttttgtgcgtacagtattatttggcttcttcagttgtgcttttaatgcttggatatagttaggttaaaaacattttttatatgcactaataattattagcattgcctttttgggtactgtatttatatgtagtcaattgaaatccttgactttaaaataaatttaaagtgtggcacattt

SEQ ID NO: 15623 - DNA, 7686 bp, Homo sapiens
  ENST00000367187
aaatttacttccccaaaacactgggacattgggatggaattcactcaccccaaatcatcaccctggttaaggagactaaagaatcagaagacatttgtgctttggggagcagaggccctcagggtatagagaaggaagaagagagaggttcactgtagtcctgaagcagaaataagacctgtggctgaaggaagccttagcaattcactccttcctcttcctgagaactctctgtaggaagtctcacctagcagaggcttcacagtatttcagagaagccaaagattgtttgcctctttggaaactgttatccttccatcatgactgtgtcactcctgccactgttccaccatagagatggcgtcctttgcagcaaaccgtaagttataaggatgagggaagaagagtagagggccaaaaggattccattttgaggaaaaactacagtttgccttgccaggtagaagaatcaggcgcccagacaccatgtcacaaccctccagaactgacgttggcaggaagtagagactttgttgcctgtgtcccccatcctcaccatgtcttcgactcagggcaatggggaacactggaagtccctggagtcagtgggcatcagccgcaaagagctagcgatggccgaagccctgcagatggagtatgatgccctgtcccggctccggcatgacaaggaggagaacagagccaagcagaacgcagacccctctctcatcagctgggatgagcctggggtagacttttacagcaagccagcaggaaggcggaccgacctcaagctgttacgcggtctctctggctctgatcctacccttaactacaactcactctccccacaggaagggccgcccaaccactctacctcccaagggccacagcctggctcagatccctggcccaaaggctccctgtctggagactatctctacatttttgatggttcagatgggggagtctcttcgtccccaggaccaggggacatagagggctcttgcaagaaactatccccacctcctctgcctccccgagcttctatctgggatacccctcccctgcctcccagaaaggggtccccctcatcctccaagatctcccagcccagtgacatcaacactttctctttggtcgaacaattgccgggcaaactgctagagcatcggatcctagaagaggaagaggtgctgggaggtgggggtcaggggcgcctactggggtctgtggactatgatggtatcaatgatgcaattactaggctcaacttgaaatcgacctatgatgcggagatgttgcgggatgccaccaggggctggaaggagggccgagggccgctggacttcagcaaagacacctctggaaaacccgtggccaggagcaagactatgccccctcaggtgcccccccgcacctatgcctcccgctatggcaaccgaaagaatgcgacgcctggcaagaaccgccggatttctgcagccccggtgggctcccggccccacactgttgccaatggccatgagttgtttgaggtctcagaagagagagatgaggaggttgctgcattttgccacatgctggatatccttcgatctggctctgacatccaagactacttcctcactggctatgtctggagtgctgtcacccctagcccagagcacctcggggatgaggtcaacctgaaggtgactgtgttgtgtgacaggcttcaagaggcactcactttcacctgcaactgttcctccactgtagacttgcttatctaccagaccctgtgctacacccatgatgacctgaggaatgtggacgtgggtgactttgtgctaaagccctgcgggctggaggagttcctgcagaacaagcatgccttgggcagtcatgagtacatccaatactgccgcaagtttgacattgacattcggctacagctgatggagcagaaggttgtgcgcagtgacctggcccggacggtgaatgatgaccagagcccctccaccttgaactacctcgtccatctccaagagaggcctgtcaagcagaccatcagcaggcaggccctgagtcttctgttcgacacttaccacaatgaggtggatgccttcctgctggctgatggagacttcccactgaaggctgacagggtggtccagtccgtcaaggccatctgcaacgccctggccgccgtggaaacccctgagatcaccagtgctctcaaccagctgcccccctgcccctcccgcatgcagcctaaaattcagaaggatcccagtgtcttggctgtgagggaaaaccgagagaaggtcgtggaagccctgaccgctgccatcttggacctggtggagctgtactgcaacacattcaacgcagacttccagacggcagtgcccgggagccgcaagcatgacctggtccaggaggcctgccatttcgccaggtccctggccttcactgtctatgccacccaccgcatccccatcatctgggctaccagctatgaagatttctacctctcctgctccctcagccatggcggcaaggagctgtgcagccccctgcagacccgaagagctcacttctccaagtacctcttccacctcatcgtctgggaccagcagatctgcttcccagtgcaggtgaaccggctgcctcgggagacactgctgtgtgccactctctatgctctgcccatccccccaccggggagctcctcagaggccaataagcagcggcgggtgcctgaagccctgggctgggtcactaccccactcttcaacttcaggcaggtcctgacctgtggccggaagcttctgggtttgtggccagcaacacaggaaaatcccagcgcccgttggagtgcacctaatttccaccagccagacagtgtcatcctgcagattgacttccccacctcggcctttgacatcaagttcaccagcccccctggagacaagttcagcccccgctatgagtttggcagcctccgggaagaagaccagcgcaagcttaaagacatcatgcagaaagagtccttgtactggctcactgatgctgacaagaagcgcctgtgggagaagcgatattactgccactcggaggtgagctcgctccccctggtgctcgccagcgcccccagctgggagtgggcttgcctgcctgacatctatgttctcctgaagcagtggacccacatgaaccaccaggatgccctggggctcctgcatgccaccttcccggaccaggaggtgcgtcgtatggctgtgcagtggattggctcactctcagatgctgagctgctagactacctgccccagctggtacaggccctgaagtatgaatgctacctggacagcccgttggtgcgcttcctcctgaaacgagctgtgtctgacttgagagtgactcactacttcttctggttactgaaggacggcctcaaggactctcagttcagcatccgctaccagtatctgctggcagccttactgtgctgctgtggcaaggggctgagagaagagtttaaccgccagtgctggcttgtcaatgccctggccaaactggcccagcaggtccgggaggcagccccatctgcaaggcagggaatcctccgcacgggcctggaggaggtgaagcagttctttgccctcaatggctcgtgccgcttgccactcagccccagtctgctggttaagggaattgtgcccagggactgttcctacttcaactccaatgctgtccccctcaaactctccttccaaaatgtggatcccctgggtgagaacatccgtgtcatcttcaagtgtggggacgaccttcgccaggacatgctaacgctgcagatgattcgcatcatgagcaagatctgggtccaggaggggctggacatgcgcatggtcatcttccgctgcttctccaccggccggggcagagggatggtggagatgatccctaatgctgagaccctgcgtaagatccaggtggagcatggggtgaccggctcgttcaaggaccggcccctggcagactggctgcagaaacacaaccctggggaggacgagtatgagaaggctgtggagaactttatctactcctgcgctggctgctgcgtggccacgtacgtcttgggcatctgtgaccgacataatgacaacatcatgctgaagaccactggtcacatgttccacattgattttggccgcttcctgggccatgcccagatgtttggcaacatcaagcgggaccgtgccccctttgtcttcacctcggacatggcgtatgtcatcaacgggggtgacaagccttccagccgcttccatgattttgttgacctttgctgccaagcctacaacctcattcgcaagcacacccacctcttcctcaaccttctgggcctgatgttgtcctgtgggatccctgaactctcagacctggaggacctcaagtatgtgtacgatgccctgaggcctcaggatacagaggccaatgccactacctacttcactaggttgattgagtccagcctgggcagtgtagccacaaagctcaattttttcatccataatctggctcagatgaagttcacgggctcagatgaccggctgaccctctcctttgcctcccgaacacacactctcaagagctctggccgaatcagtgatgttttcctctgccgccatgagaagatcttccaccccaacaaaggctatatatatgtggtaaaggtgatgcgagagaacactcacgaggccacctacatccagcggacctttgaggagttccaggaattacacaataagttgcggctgctcttcccttcttcccacttgcccagcttccctagtcgcttcgtgatcggccgctcccggggagaggcggtggccgagcggcggagggaggagctaaacggttacatctggcacttgatccacgcaccccctgaggtggccgagtgtgatttggtgtacaccttcttccacccactgccccgggatgagaaggctatgggcaccagcccagctcctaagtcctcagatggcacatgggcccggcccgtcggaaaggtgggaggggaggtgaagctgtccatctcctacaaaaacaataaactcttcatcatggtgatgcatattcggggcttgcaactgctccaggatggaaatgaccctgacccctatgtgaaaatttacctccttcctgaccctcagaaaaccactaagaggaaaaccaaagtggcccggaaaacctgcaatcctacctacaatgagatgttggtatatgatgggatccccaagggtgacctgcagcagcgggagctccagctgagcgtgctgagtgagcagggattctgggagaacgtcctcctcggtgaggtgaacatccgcctgcgagagctggacctggctcaggagaagaccggctggttcgccctgggatctcgaagtcatggcaccttgtgagcccagcagagccaccacccagcatcccaggctggtggcaggagctgggggagaggactctcccctgtgagactcctccttgtgaagggccagggccctgggcaggcctccagctcggtccaggtgattctggcctctgtggtaggaggcagggagagtaagacatgctctgctgtctcttcctctggagactgaacttgggttggttgtgatgagcagccccttggaggctgtgaggttgcagcaaagttttaagtttaccttgtgtcaagggagcaatgcttggtttggggagtgtgtggggtgggctgtatgaagtagcattttgggggtgggtgggtggatatcttaatttttatttttaaaaaatgaaatagtgatgttgtcctaactgggacaggaagccttgcgagaagggacgtacctatgccccagaaggcaagagaggaagactatttggactttttgtatgattaaggttcttattggacttttccctaggttttttttttttgttattgttgttgttgtttcgttttctagctataggaactatctggggaggggcccagtgggtcctcggccagagccctctctaaggacaggttggggagggttggggagggctgcctgtgctggactgaggcttgtgccactgggcctttctgattttgcctccaaaggagagcgctgtgatacctacatgtgtaaggaagggccttccgtattggggttctgccaaggacccgtattcagggacccatgctcttttggggggacttttcctcttgtcttccctactttattaggacttgccctgaataccattttctaccccttgcccctccattctcctggcccttctgggggtcagctggtctctatgaatatgctgggggtgcttccccataggtctctcccttcatttgtctctggtgggacaaaatactgactcagtccttagatgtagtttcacccaagagcatcttggccctgggaagaggtccctaggctgcagatgctactgactgcttgctaggtagcctctggaaagcattccccatccatcactccccacttctttctgctgtgctgcttccctcccaaactccatttctgtcaccctttttataagacttttcctcattctgtggggccataaacctatttagtctggagccaaagggatgccctatctgaaggaaaggggcatggggtgggggattccatcaaaactgttgttttttgccccatgatttttctttggtcagtaggaggctggattggagtggtgattattcccctggagctaagctcaggagcccgaagggagagactgagactgactcccttatctcttcatattctttattccctaccagatggatttttttttttttttttggagacggagtctcgccctgtcgccaggctggagtgtagtggcatgatctcgactcactgcaaaatctgcctcccgggttcaagcgattctcctacctcagcctcccgagtagctgggattacaggcatgtgccaccacgccaagctaatttttgtatttttagtagagacggggtttcaccatgttggccaggatggtctcgatctcttgacctcgtgatctgcctgccttggcctcccaaagtgctgggattacaggcgtgagccaccatgccccgccccagatggattttacatttgctcttttgtgtttcgctccaaagggttgtcttcctcgccaaaaggagggagggactttgaatttgatatgaatctttaaaaccagaattggctggatatttcccatgattgggaaaagagtgaaatgaggacattctgtaaactgtccctccctaattccaaggatcagaaactccccgttttgctgactcattccataactggagaaagaagctccattgaccgaagccacagggcagcatggaagtttaaattttctctaaaattaaaatgccaaggataaagctggctgcttccaggagggggaagaggagtggggagtgggcggtgaaacttttccagatgaacggaccataaatgtgttactggctttgtgcctgtagctcattttattatgacctatatgctcctgatttaaagagatctgtgtactgtttacttcccacttcccagaatcccttgtatctcctttctcgggaattgtattttctaataaatgacatttgagaaaaaaatgaaa

SEQ ID NO: 15624 - DNA, 526 bp, Homo sapiens
  ENST00000462752
aagagctctggccgaatcagtgatgttttcctctgccgccatgagaagatcttccaccccaacaaaggctatatatatgtggtaaaggtgatgcgagagaacactcacgaggccacctacatccagcggacctttgaggagttccaggaattacacaataagttgcggctgctcttcccttcttcccacttgcccaggtagctgccccctttactatctgcacagagggatgtcggggagggggaaaggatacgggatgggaggtggtcagggctgcaggggcagaaaatacccttttggactaaacatctgcctgctttgcttggcctggtatggagtttgatgacaagtgctccccctgctggccaagctctccttgcacgcaagagctctcactccaggcccactggccagaaaggaaggcatggttgaatctgatgtttcaaaatttctaattttttaaagagttacaccatttttcaaatggataagcaaaatgtcatatgtacatacagtgggatattat

SEQ ID NO: 15625 - DNA, 402 bp, Homo sapiens
  ENST00000479079
ccctgagagggaggctgtatcctcagcctcagcctcagcctgacttcctgggccacctgttgcttgaagccacaggagtggcccctcctaatttgacttcctgtcctccataggatctgcttcccagtgcaggtgaaccggctgcctcgggagacactgctgtgtgccactctctatgctctgcccatccccccaccggggagctcctcagaggccaataagcagcggcgggtgcctgaagccctgggctgggtcactaccccactcttcaacttcaggcaggtcctgacctgtggccggaagcttctgggtttgtggccagcaacacaggaaaatcccagcgcccgttggagtgcacctaatttccaccagccagacagtgtcatcctgcaggtgaggctt

SEQ ID NO: 15626 - DNA, 651 bp, Homo sapiens
  ENST00000496872
tacgtaaaaataaggattatgtttaacattgtataactgtcattttatgaaaagctcatgacatgcttctgcttttttctcattttaccgcagatgggtgaactttgtcacagctattagagactgactagcatttggggaccactgtcttaggccatcccattctagccaatgccatggcaacaaggtagggcttgtggaggcctcatgactttcccttctgaccccttcccttcccagagaaggtcgtggaagccctgaccgctgccatcttggacctggtggagctgtactgcaacacattcaacgcagacttccagacggcagtgcccgggagccgcaagcatgacctggtccaggaggcctgccatttcgccaggtccctggccttcactgtctatgccacccaccgcatccccatcatctgggctaccagctatgaagatttctacctctcctgctccctcagccatggcggcaaggagctgtgcagccccctgcagacccgaagagctcacttctccaagtacctcttccacctcatcgtctgggaccagcagtaagcccttcccccaggcttcagtgcccaggccactgtagacctgctcagcctctgaaatatccctggggccagataactagtccaggact

SEQ ID NO: 15627 - DNA, 830 bp, Homo sapiens
  ENST00000367184
acatccctagagctcagggatttttaaaggccctgctctgagaggtggggctgttcccgctatttatagggactgggagattcctgttcccagctctgagttcctcacacccagctgggcctgctcactgagtcagggcaccctggtaggtggtcacctctgtcactccttctctctcctgcctcccctactccctcacccttccccatcccctgcatgtcatcagagttctgagacagagctcagcccagaatctccttgaagaagcggacacaaagcaaaaagctcttgccagttctgagtggggaaatgcggccttggtcctccccggctcagcttgttgcaggggctcagcctgctgggaggggggaccccttgggccctcggcctataccaccgccccgctttcgtcgggcttccagccagagggaacctccttatcccaggccagcggagccagctctggaactggctggctccaaatgccagcctgatacccctgctgccagcctctgcccggcagactcccccagccagcatcgggtgatgccaccagggcctgccagctgggcaaacgtgggctcccggccccacactgttgccaatggccatgagttgtttgaggtctcagaagagagagatgaggaggttgctgcattttgccacatgctggatatccttcgatctggctctgacatccaagactacttcctcactggctatgtctggagtgctgtcacccctagcccagagcacctcggggatgaggtcaacctgaaggtgactgtgttgtgtgacaggcttcaagaggcactcactttcacctgcaa

SEQ ID NO: 15628 - DNA, 846 bp, Homo sapiens
  ENST00000415899
agtgcgccgggtgtccgggagatggcttcccctctctcgcccgctgctgccgctattgtctcacccggggtggcctgactctgcgagctcgcgcacgctctcggcggagagcacccctccccacccccacaagctggtccttgcgccctttgctgcctctccctctgccccttggagcctagggtctgtgcggagcctggagaggggagcggcccgggagcaggcggcgtgcggccggccagctcctctcgcgctggtgcaagaggcgcctggagccgcagagcgagcccgggaggcgcggagcgagcagcccacgtcgccaggcacaagacacgtcggatgttgcagcagagccagcagctagcgcaggcgcccagacaccatgtcacaaccctccagaactgacgttggcaggaagtagagactttgttgcctgtgtcccccatcctcaccatgtcttcgactcagggcaatggggaacactggaagtccctggagtcagtgggcatcagccgcaaagagctagcgatggccgaagccctgcagatggagtatgatgccctgtcccggctccggcatgacaaggaggagaacagagccaagcagaacgcagacccctctctcatcagctgggatgagcctggggtagacttttacagcaagccagcaggaaggcggaccgacctcaagctgttacgcggtctctctggctctgatcctacccttaactacaactcactctccccacaggaagggccgcccaaccactctacctcccaagggccacagcctggctcagatccctggcccaaaggctccctgtctggagactatctctacattttt

SEQ ID NO: 15629 - DNA, 727 bp, Homo sapiens
  ENST00000429009
ggcttcccctctctcgcccgctgctgccgctattgtctcacccggggtggcctgactctgcgagctcgcgcacgctctcggcggagagcacccctccccacccccacaagctggtccttgcgccctttgctgcctctccctctgccccttggagcctagggtctgtgcggagcctggagaggggagcggcccgggagcaggcggcgtgcggccggccagctcctctcgcgctggtgcaagaggcgcctggagccgcagagcgagcccgggaggcgcggagcgagcagcccacgtcgccaggcacaagacacgtcggatgttgcagcagagccagcagctagcgcagatggcgtcctttgcagcaaaccgtaagttataaggatgagggaagaagagtagagggccaaaaggattccattttgaggaaaaactacagtttgccttgccaggtagaagaatcaggcgcccagacaccatgtcacaaccctccagaactgacgttggcaggaagtagagactttgttgcctgtgtcccccatcctcaccatgtcttcgactcagggcaatggggaacactggaagtccctggagtcagtgggcatcagccgcaaagagctagcgatggccgaagccctgcagatggagtatgatgccctgtcccggctccggcatgacaaggaggagaacagagccaagcagaacgcagacccctctctcatcagctggg

SEQ ID NO: 15630 - DNA, 7522 bp, Homo sapiens
  ENST00000424712
aagaatcagaagacatttgtgctttggggagcagaggccctcagggtatagagaaggaagaagagagaggttcactgtagtcctgaagcagaaataagacctgtggctgaaggaagccttagcaattcactccttcctcttcctgagaactctctgtaggaagtctcacctagcagaggcttcacagtatttcagagaagccaaagattgtttgcctctttggaaactgttatccttccatcatgactgtgtcactcctgccactgttccaccatagagatggcgtcctttgcagcaaaccgtaagttataaggatgagggaagaagagtagagggccaaaaggattccattttgaggaaaaactacagtttgccttgccaggtagaagaatcaggcgcccagacaccatgtcacaaccctccagaactgacgttggcaggaagtagagactttgttgcctgtgtcccccatcctcaccatgtcttcgactcagggcaatggggaacactggaagtccctggagtcagtgggcatcagccgcaaagagctagcgatggccgaagccctgcagatggagtatgatgccctgtcccggctccggcatgacaaggaggagaacagagccaagcagaacgcagacccctctctcatcagctgggatgagcctggggtagacttttacagcaagccagcaggaaggcggaccgacctcaagctgttacgcggtctctctggctctgatcctacccttaactacaactcactctccccacaggaagggccgcccaaccactctacctcccaagggccacagcctggctcagatccctggcccaaaggctccctgtctggagactatctctacatttttgatggttcagatgggggagtctcttcgtccccaggaccaggggacatagagggctcttgcaagaaactatccccacctcctctgcctccccgagcttctatctgggatacccctcccctgcctcccagaaaggggtccccctcatcctccaagatctcccagcccagtgacatcaacactttctctttggtcgaacaattgccgggcaaactgctagagcatcggatcctagaagaggaagaggtgctgggaggtgggggtcaggggcgcctactggggtctgtggactatgatggtatcaatgatgcaattactaggctcaacttgaaatcgacctatgatgcggagatgttgcgggatgccaccaggggctggaaggagggccgagggccgctggacttcagcaaagacacctctggaaaacccgtggccaggagcaagactatgccccctcaggtgcccccccgcacctatgcctcccgctatggcaaccgaaagaatgcgacgcctggcaagaaccgccggatttctgcagccccggtgggctcccggccccacactgttgccaatggccatgagttgtttgaggtctcagaagagagagatgaggaggttgctgcattttgccacatgctggatatccttcgatctggctctgacatccaagactacttcctcactggctatgtctggagtgctgtcacccctagcccagagcacctcggggatgaggtcaacctgaaggtgactgtgttgtgtgacaggcttcaagaggcactcactttcacctgcaactgttcctccactgtagacttgcttatctaccagaccctgtgctacacccatgatgacctgaggaatgtggacgtgggtgactttgtgctaaagccctgcgggctggaggagttcctgcagaacaagcatgccttgggcagtcatgagtacatccaatactgccgcaagtttgacattgacattcggctacagctgatggagcagaaggttgtgcgcagtgacctggcccggacggtgaatgatgaccagagcccctccaccttgaactacctcgtccatctccaagagaggcctgtcaagcagaccatcagcaggcaggccctgagtcttctgttcgacacttaccacaatgaggtggatgccttcctgctggctgatggagacttcccactgaaggctgacagggtggtccagtccgtcaaggccatctgcaacgccctggccgccgtggaaacccctgagatcaccagtgctctcaaccagctgcccccctgcccctcccgcatgcagcctaaaattcagaaggatcccagtgtcttggctgtgagggaaaaccgagagaaggtcgtggaagccctgaccgctgccatcttggacctggtggagctgtactgcaacacattcaacgcagacttccagacggcagtgcccgggagccgcaagcatgacctggtccaggaggcctgccatttcgccaggtccctggccttcactgtctatgccacccaccgcatccccatcatctgggctaccagctatgaagatttctacctctcctgctccctcagccatggcggcaaggagctgtgcagccccctgcagacccgaagagctcacttctccaagtacctcttccacctcatcgtctgggaccagcagatctgcttcccagtgcaggtgaaccggctgcctcgggagacactgctgtgtgccactctctatgctctgcccatccccccaccggggagctcctcagaggccaataagcagcggcgggtgcctgaagccctgggctgggtcactaccccactcttcaacttcaggcaggtcctgacctgtggccggaagcttctgggtttgtggccagcaacacaggaaaatcccagcgcccgttggagtgcacctaatttccaccagccagacagtgtcatcctgcagattgacttccccacctcggcctttgacatcaagttcaccagcccccctggagacaagttcagcccccgctatgagtttggcagcctccgggaagaagaccagcgcaagcttaaagacatcatgcagaaagagtccttgtactggctcactgatgctgacaagaagcgcctgtgggagaagcgatattactgccactcggagtggacccacatgaaccaccaggatgccctggggctcctgcatgccaccttcccggaccaggaggtgcgtcgtatggctgtgcagtggattggctcactctcagatgctgagctgctagactacctgccccagctggtacaggccctgaagtatgaatgctacctggacagcccgttggtgcgcttcctcctgaaacgagctgtgtctgacttgagagtgactcactacttcttctggttactgaaggacggcctcaaggactctcagttcagcatccgctaccagtatctgctggcagccttactgtgctgctgtggcaaggggctgagagaagagtttaaccgccagtgctggcttgtcaatgccctggccaaactggcccagcaggtccgggaggcagccccatctgcaaggcagggaatcctccgcacgggcctggaggaggtgaagcagttctttgccctcaatggctcgtgccgcttgccactcagccccagtctgctggttaagggaattgtgcccagggactgttcctacttcaactccaatgctgtccccctcaaactctccttccaaaatgtggatcccctgggtgagaacatccgtgtcatcttcaagtgtggggacgaccttcgccaggacatgctaacgctgcagatgattcgcatcatgagcaagatctgggtccaggaggggctggacatgcgcatggtcatcttccgctgcttctccaccggccggggcagagggatggtggagatgatccctaatgctgagaccctgcgtaagatccaggtggagcatggggtgaccggctcgttcaaggaccggcccctggcagactggctgcagaaacacaaccctggggaggacgagtatgagaaggctgtggagaactttatctactcctgcgctggctgctgcgtggccacgtacgtcttgggcatctgtgaccgacataatgacaacatcatgctgaagaccactggtcacatgttccacattgattttggccgcttcctgggccatgcccagatgtttggcaacatcaagcgggaccgtgccccctttgtcttcacctcggacatggcgtatgtcatcaacgggggtgacaagccttccagccgcttccatgattttgttgacctttgctgccaagcctacaacctcattcgcaagcacacccacctcttcctcaaccttctgggcctgatgttgtcctgtgggatccctgaactctcagacctggaggacctcaagtatgtgtacgatgccctgaggcctcaggatacagaggccaatgccactacctacttcactaggttgattgagtccagcctgggcagtgtagccacaaagctcaattttttcatccataatctggctcagatgaagttcacgggctcagatgaccggctgaccctctcctttgcctcccgaacacacactctcaagagctctggccgaatcagtgatgttttcctctgccgccatgagaagatcttccaccccaacaaaggctatatatatgtggtaaaggtgatgcgagagaacactcacgaggccacctacatccagcggacctttgaggagttccaggaattacacaataagttgcggctgctcttcccttcttcccacttgcccagcttccctagtcgcttcgtgatcggccgctcccggggagaggcggtggccgagcggcggagggaggagctaaacggttacatctggcacttgatccacgcaccccctgaggtggccgagtgtgatttggtgtacaccttcttccacccactgccccgggatgagaaggctatgggcaccagcccagctcctaagtcctcagatggcacatgggcccggcccgtcggaaaggtgggaggggaggtgaagctgtccatctcctacaaaaacaataaactcttcatcatggtgatgcatattcggggcttgcaactgctccaggatggaaatgaccctgacccctatgtgaaaatttacctccttcctgaccctcagaaaaccactaagaggaaaaccaaagtggcccggaaaacctgcaatcctacctacaatgagatgttggtatatgatgggatccccaagggtgacctgcagcagcgggagctccagctgagcgtgctgagtgagcagggattctgggagaacgtcctcctcggtgaggtgaacatccgcctgcgagagctggacctggctcaggagaagaccggctggttcgccctgggatctcgaagtcatggcaccttgtgagcccagcagagccaccacccagcatcccaggctggtggcaggagctgggggagaggactctcccctgtgagactcctccttgtgaagggccagggccctgggcaggcctccagctcggtccaggtgattctggcctctgtggtaggaggcagggagagtaagacatgctctgctgtctcttcctctggagactgaacttgggttggttgtgatgagcagccccttggaggctgtgaggttgcagcaaagttttaagtttaccttgtgtcaagggagcaatgcttggtttggggagtgtgtggggtgggctgtatgaagtagcattttgggggtgggtgggtggatatcttaatttttatttttaaaaaatgaaatagtgatgttgtcctaactgggacaggaagccttgcgagaagggacgtacctatgccccagaaggcaagagaggaagactatttggactttttgtatgattaaggttcttattggacttttccctaggttttttttttttgttattgttgttgttgtttcgttttctagctataggaactatctggggaggggcccagtgggtcctcggccagagccctctctaaggacaggttggggagggttggggagggctgcctgtgctggactgaggcttgtgccactgggcctttctgattttgcctccaaaggagagcgctgtgatacctacatgtgtaaggaagggccttccgtattggggttctgccaaggacccgtattcagggacccatgctcttttggggggacttttcctcttgtcttccctactttattaggacttgccctgaataccattttctaccccttgcccctccattctcctggcccttctgggggtcagctggtctctatgaatatgctgggggtgcttccccataggtctctcccttcatttgtctctggtgggacaaaatactgactcagtccttagatgtagtttcacccaagagcatcttggccctgggaagaggtccctaggctgcagatgctactgactgcttgctaggtagcctctggaaagcattccccatccatcactccccacttctttctgctgtgctgcttccctcccaaactccatttctgtcaccctttttataagacttttcctcattctgtggggccataaacctatttagtctggagccaaagggatgccctatctgaaggaaaggggcatggggtgggggattccatcaaaactgttgttttttgccccatgatttttctttggtcagtaggaggctggattggagtggtgattattcccctggagctaagctcaggagcccgaagggagagactgagactgactcccttatctcttcatattctttattccctaccagatggatttttttttttttttttggagacggagtctcgccctgtcgccaggctggagtgtagtggcatgatctcgactcactgcaaaatctgcctcccgggttcaagcgattctcctacctcagcctcccgagtagctgggattacaggcatgtgccaccacgccaagctaatttttgtatttttagtagagacggggtttcaccatgttggccaggatggtctcgatctcttgacctcgtgatctgcctgccttggcctcccaaagtgctgggattacaggcgtgagccaccatgccccgccccagatggattttacatttgctcttttgtgtttcgctccaaagggttgtcttcctcgccaaaaggagggagggactttgaatttgatatgaatctttaaaaccagaattggctggatatttcccatgattgggaaaagagtgaaatgaggacattctgtaaactgtccctccctaattccaaggatcagaaactccccgttttgctgactcattccataactggagaaagaagctccattgaccgaagccacagggcagcatggaagtttaaattttctctaaaattaaaatgccaaggataaagctggctgcttccaggagggggaagaggagtggggagtgggcggtgaaacttttccagatgaacggaccataaatgtgttactggctttgtgcctgtagctcattttattatgacctatatgctcctgatttaaagagatctgtgtactgtttacttcccacttcccagaatcccttgtatctcctttctcgggaattgtattttctaataaatgacatttgagaaaaaaatga

SEQ ID NO: 15631 - DNA, 7011 bp, Homo sapiens
  ENST00000521381
gcgccgggcgctggagctgcgggcgcacggagaggagtcgccagcagctggagcggagttggaggaagcagcggcagcggcgagggcggcaggctagctgtcggagacggcaagcacggatcgggcacggccggcgggtcgcagccgggctggaggccggtcggaaccgagcgggcaggaggccaccgctgcagcgcgggccccgcagaggaaggaagccggcgggcggggtgaagctcgtgtgtggagtgccacggtacaatcagacgacagatggacagtgtgacaaaagtgtcagaaaggattgggcctcgctgtgagagtcagcctggattcaaagtgttgacaagttgctgaaaaggaagccagtgagaggactgtggcacgcagaggaagtggagccctgtcttcggtcacaccattgatggaggacagatggacagccgtatggccagtcacctctcctcttaaacctttggagagtggtcctttgtcctctgctggacacataataggaattctaacacattctctgaattcacttttcataaaaacgtaaaatcagactgctctgtacaaccaggctcaactgttgcatggtagcagatttgcaaacatgagtgctgaggggtaccagtacagagcgctgtatgattataaaaaggaaagagaagaagatattgacttgcacttgggtgacatattgactgtgaataaagggtccttagtagctcttggattcagtgatggacaggaagccaggcctgaagaaattggctggttaaatggctataatgaaaccacaggggaaaggggggactttccgggaacttacgtagaatatattggaaggaaaaaaatctcgcctcccacaccaaagccccggccacctcggcctcttcctgttgcaccaggttcttcgaaaactgaagcagatgttgaacaacaagctttgactctcccggatcttgcagagcagtttgcccctcctgacattgccccgcctcttcttatcaagctcgtggaagccattgaaaagaaaggtctggaatgttcaactctatacagaacacagagctccagcaacctggcagaattacgacagcttcttgattgtgatacaccctccgtggacttggaaatgatcgatgtgcacgttttggctgacgctttcaaacgctatctcctggacttaccaaatcctgtcattccagcagccgtttacagtgaaatgatttctttagctccagaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccagctctgataatactgaaaacctcataaaagttatagaaattttaatctcaactgaatggaatgaacgacagcctgcaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagatatatgaatatgacaaagtattgctgagtccaacaatgttgttttaagactcttaaaatacggtacctggcaatgtttatttcataaagaattgtgaacttcttgaatctagggagggggaatgtagtgaagggatgtatcaagtggggtggtgggagggggaggcaaggttatatgcactttctcatgatttacagagaagtgaataactgcaaagtgaagttgcttcttctacttcagtcttctctcactttgatttgctagttgttatcaattaatgacaattacaaacctactgtatctctaatacagtgtgactggtcaggtatttcagttcttaggaaggaagtgccaagtttgtttttgggttcctggaacagcgctcacctttgtttagaacactggtttaaagggataatcatctctgtcacattagactatccatcatgaccagcaaatactcattttaggaaaaaaaaaagcatgatctgaaaaatacttttggtggtatgttggttaccctcctagctttccatttggtttagaacataaagcaaatagacacagtcatactgtcactgctctggactgtgtggagctcgctaaagtcatggtcattgcaggaatccaagtggcagtccttctcattcattctaatcattgtatgtgcttcactacgggggggagaaggaaacgttagcatcatgtttcccatttagggcaggagtgagaggtctctcttcctgatttagatatgcaaaagctggtatgttcagtaggaactgtacatgtgttgggaggcataaagactaattagcaaccataatatggtcactaccctaatagactaaatgaaatcttgcaatttcaaattactctttctccatattagatttacccacagctatatttctgtttaagtactagggtgagggttttctgttactttgttttttaatgttgttccttttgaaagaatcagtcttgcagctgagtgaaaaatctgtggaatgtattatttgtcctctttacatgaaactactcatacttaagcaaaagtcagtcttatagcaagactgttagccctcaaacttgactctactgatctgaccatttccctctcatcgccagacaactgacgatttccctggttttagtctgcgtctctgctttaaagttattgtgatatccttctagatcatacacaagtctaacagttaattagttaacagtttttaaactaggtttgtgggtatttttttggtagcacatgtatgctattacatacaaatttttatttctaaaatataagatctgagattgaatattttcattaaaagctacagttttgtgaatctttgtgcttcaacattctttgcaagatgatacggtatttaggcatttgccttatttttgcatctcacaaacataagtgcaatagatcttttcattgaacagcaaagtaggattcatcattccatatgacttgagttacaccagacctgttctgcccaatgcctttttgattacagtgtagcttgcccaccgcatttgtcgttttagatactttgctagccggccactttggatttcatcagacagtcctaacaatattgtctgaacggctgaatatgaatagatacagcagaggcactcctgatatatgatttttatccatgcgtcagtttttcccacccagtgtagcatcctaaagataaagccagaagctaagctgcagtgaggctgtgattgggcgtagaagtgggagcattgggacctcacattacacacacgagagatcataaccatgtgaaaaggcaaaaagcatgtgtttgcaacatctgataacttcatggcctttgataaatgtatatatgtatatgtgcatggactgtgtttccagtacacctttcagccaaaacagatccacagtagttgttgagttcaagtacataaagtacataacaagcgaacgtctagtacaattcttacttatgtgtatgggatttttccctttgaggttgctttgttttgtcttacaaaggtgaaaattgtttgtaagtgaagtgagaagttcatatttctttggcttttttgtgtttttaaaagttactccttttagggagctggtctgatgacttgcttagcttggaaatccttgttttcagtgtgtcgagtcaaaatgtgtttatgtgagctgtcactgtggggaaccaattgctttgtcatatagctggttatgaactagtaacatgtttgggaagtcctactgatgttcctttggaagaaaaaatctgctggttttaacaactgtgcttttgctatgtatggtatccaagttagttgaaacgcagacactgagatctgtttgagtttagggtcatttttagaaaggggcagtttaaagcacaatgtctcacatgggacaaagttccaaaatgccaaattcttattttttaaaaagctagttctataaaatactggtattatgggtggggaggaaatagaattgagtcaattggaaagactatccaacttaacatgaaacttgtcaccatgagatagcattagctgcccaggatgctgctatatatatatatatatatatatatgtgtgtgtgtgtgtgtgtgtgtgtgtatatatatatatatatatatatatatatatatatatatatgtgtgtgtatatatatatatatgtgtatatatatatgtatatacatatatgtatatatatgcacatatatatatgtatttaaaaaaatcaaaacaaaaaaaaactcatttatacctgtgtattttttaaagctacaatctgttcaatgtttttaaaaatctgtttatatgacattgttaaaataaagttggtcttttgacgagagggaggatgtcacggtcagttgtaactttgccttcacaaggcaactggggtggggggtgggggtagtgtgcctccttgacatttcgttcaagttatagattcaatggagctatgtcttgttttaagttgctttaatgcattgtattagatcttcaaacagaataaaggttgttttgaaactgaa

SEQ ID NO: 15632 - DNA, 3891 bp, Homo sapiens
  ENST00000521657
agttggaggaagcagcggcagcggcgagggcggcaggctagctgtcggagacggcaagcacggatcgggcacggccggcgggtcgcagccgggctggaggccggtcggaaccgagcgggcaggaggccaccgctgcagcgcgggccccgcagaggaaggaagccggcgggcggggtaggtgaagctcgtgtgtggagtgccacggtacaatcagacgacagatggacagtgtgacaaaagtgtcagaaaggattgggcctcgctgtgagagtcagcctggattcaaagtgttgacaagttgctgaaaaggaagccagtgagaggactgtggcacgcagaggaagtggagccctgtcttcggtcacaccattgatggaggacagatggacagccgtatggccagtcacctctcctcttaaacctttggagagtggtcctttgtcctctgctggacacataataggaattctaacacattctctgaattcacttttcataaaaacgtaaaatcagactgctctgtacaaccaggctcaactgttgcatggtagcagatttgcaaacatgagtgctgaggggtaccagtacagagcgctgtatgattataaaaaggaaagagaagaagatattgacttgcacttgggtgacatattgactgtgaataaagggtccttagtagctcttggattcagtgatggacaggaagccaggcctgaagaaattggctggttaaatggctataatgaaaccacaggggaaaggggggactttccgggaacttacgtagaatatattggaaggaaaaaaatctcgcctcccacaccaaagccccggccacctcggcctcttcctgttgcaccaggttcttcgaaaactgaagcagatgttgaacaacaagctttgactctcccggatcttgcagagcagtttgcccctcctgacattgccccgcctcttcttatcaagctcgtggaagccattgaaaagaaaggtctggaatgttcaactctatacagaacacagagctccagcaacctggcagaattacgacagcttcttgattgtgatacaccctccgtggacttggaaatgatcgatgtgcacgttttggctgacgctttcaaacgctatctcctggacttaccaaatcctgtcattccagcagccgtttacagtgaaatgatttctttagctccagaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccagctctgataatactgaaaacctcataaaagttatagaaattttaatctcaactgaatggaatgaacgacagcctgcaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaa

SEQ ID NO: 15633 - DNA, 586 bp, Homo sapiens
  ENST00000517643
aaaaagcaactcactagctatacaactttttgacagattacactgttcttgaaaaaccgtttagaagaaagcagataagagttttcttaggtgcaaaagttgattaaactttaggaagcaagtgtttttgaccagtataaagaaaataagagtaatgtgtgggggtgtgtgtgtgtgtgtgtgtgtgtgcgcgcgcgtgcctgcggctaaagtttgggaagaaatgttggttcagagttaaggtttaagttggaaaggccagtggaggaggctccctgccttgcagaactgctgggtattgtcactgcttgcctcttcagcttttatatgcaggtgaagctcgtgtgtggagtgccacggtacaatcagacgacagatggacagtgtgacaaaagtgtcagaaaggattgggcctcgctgtgagagtcagcctggattcaaagtgttgacaagttgctgaaaaggaagccagtgagaggactgtggcacgcagaggaagtggagccctgtcttcggtcacaccattgatggaggacagatggacagccgtatggccagtcacctctcctcttaaacctttggagag

SEQ ID NO: 15634 - DNA, 865 bp, Homo sapiens
  ENST00000517412
ctgtggcacgcagaggaagtggagccctgtcttcggtcacaccattgatggaggacagatggacagccgtatggccagtcacctctcctcttaaacctttggagagtggtcctttgtcctctgctggacacataataggaattctaacacattctctgaattcacttttcataaaaacgtaaaatcagactgctctgtacaaccaggctcaactgttgcatggtagcagatttgcaaacatgagtgctgaggggtaccagtacagagcgctgtatgattataaaaaggaaagagaagaagatattgacttgcacttgggtgacatattgactgtgaataaagggtccttagtagctcttggattcagtgatggacaggaagccaggcctgaagaaattggctggttaaatggctataatgaaaccacaggggaaaggggggactttccgggaacttacgtagaatatattggaaggaaaaaaatctcgcctcccacaccaaagccccggccacctcggcctcttcctgttgcaccaggttcttcgaaaactgaagcagatgttgaacaacaagctttgactctcccggatcttgcagagcagtttgcccctcctgacattgccccgcctcttcttatcaagctcgtggaagccattgaaaagaaaggtaaccagactgctagagggcatcagttcctttgttctacccttatttcatggctcttattatttgtctcttgtgcattcattaagtaaatttcctactaccagctatgtccagatactctgctggacactcaaactgtttggggctaagtactgggaaaaatgtctcagtctataatttctaactctagattatcatg

SEQ ID NO: 15635 - DNA, 395 bp, Homo sapiens
  ENST00000520675
acagcaaaagaacctcatcagaaccgcaggctggaaagagctttgactctcccggatcttgcagagcagtttgcccctcctgacattgccccgcctcttcttatcaagctcgtggaagccattgaaaagaaaggtctggaatgttcaactctatacagaacacagagctccagcaacctggcagaattacgacagcttcttgattgtgatacaccctccgtggacttggaaatgatcgatgtgcacgttttggctgacgctttcaaacgctatctcctggacttaccaaatcctgtcattccagcagccgtttacagtgaaatgatttctttagctccagaagtacaaagctccgaagaatatattcagctattgaagaagcttattaggtcgcc

SEQ ID NO: 15636 - DNA, 552 bp, Homo sapiens
  ENST00000523807
acacttgaagctgctcaatactggaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccagctctgataatactgaaaacctcataaaagttatagaaattttaatctcaactgaatggaatgaacgacagcctgcaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatg

SEQ ID NO: 15637 - DNA, 705 bp, Homo sapiens
  ENST00000522084
acacactgagctttttgcatttccatttgacctgagatttctactttctcataatgcgttttctaatgagaaggacaaatgtactgtgtgcttctcccaacaactttttaaatgactcctatagcttgaagaaagagcagaacttttctaggtgtttattcactgatacctggaagtagtcgcttactcatttctctttttttttttttttaaacttgtagaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccagctctgataatactgaaaacctcataaaagttatagaaattttaatctcaactgaatggaatgaacgacagcctgcaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaag

SEQ ID NO: 15638 - DNA, 2625 bp, Homo sapiens
  ENST00000320694
atctttatctaagggagacgtgcgagcgcctgggctcctttcctccccgatacagtagcgaaatccagttggcttctcaatgaggagccggcagtgagcggcggtggcccggacgcactgccgggcggggcgtggggcggagggacgagccgagccgagccaagcggagctgggccactgtgcacgcccggagggtcctggcggcgcccccgctcctgcgcgcactctcggcgccggacacgagcactgcctgccgggaacaggctggggggaggtgcgggggcttggcccacttggtggaagaacagctttggggattttttttttttcattgtcggatacaggcatttcaaagggaaaccgttgaaatgcataacctgcaaacactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaa

SEQ ID NO: 15639 - DNA, 540 bp, Homo sapiens
  ENST00000521409
ttcattgtcggatacaggcatttcaaagggaaaccgttgaaatgcataacctgcaaaggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagaccca

SEQ ID NO: 15640 - DNA, 2439 bp, Homo sapiens
  ENST00000336483
tataggttttaaaatgaattccaagacaccattacaaagaaagccggactcttttcttataactgagctcagccaaggaaactcttgcacaaatgtacaatactgtttggaatatggaagacctggatttagaatatgccaagacagatataaattgtggcacagacttgatgttttatatagaaatggacccaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaa

SEQ ID NO: 15641 - DNA, 558 bp, Homo sapiens
  ENST00000518292
aaagaaagccggactcttttcttataactgagctcagccaaggaaactcttgcacaaatgtacaatactgtttggaatatggaagacctggatttagaatatgccaagacagatataaattgtggcacagacttgatgttttatatagaaatggacccaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggtaagccagggaatatagctgaaattagggttttgggctgatattaaaacatatttccttattccaaaatgttaatacctttatttttatattgtttttacaggaaagggggaaataacaaattaatcaaaatatttcatcgagatgggaaatatggcttctctgacccattaaccttcagttctgtggttga

SEQ ID NO: 15642 - DNA, 945 bp, Homo sapiens
  ENST00000517698
ggactcttttcttataactgagctcagccaaggaaactcttgcacaaatgtacaatactgtttggaatatggaagacctggatttagaatatgccaagacagatataaattgtggcacagacttgatgttttatatagaaatggacccaccagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactga

SEQ ID NO: 15643 - DNA, 3722 bp, Homo sapiens
  ENST00000518813
agacttgatgttttatatagaaatggacccaccaggtaatactgcagtattattgtagagagttagttaatttcgtggctttttaatttttcgaaagctactgtaaaagatcctttttggatttctgtttttattaatttgtttcattgataaaaattagtttgctcatggcttaaaaattaaacagattgtttgactgtctgtggaagcaagcagctcaggctgtgtgtggtaaatgcttattcttacttgaatggatatgaattgaactccagtttttcactggtgtcttttgttaatcgagatccttccctgggtgagttatgttgtgggatattgtccctgtaattaaaatgatgcatcttttgtgctgcttttctctgttgccagtggatgagaacagtgtagcactttgcagtgataacacttggtactttagaaagcatgtaaaatgtagcagtgattacaactcagttctctaaatgttgagactttgcttgctctctcatattaagatattataatgaaaaaagaagttgactttccattattgttagtctttgtaaaatattcttggtagatacctgaaatcattttttgtataagttaaaatagtaacagtgctttaaaacttatgacagaatttacctaaaaatcctagatttattttgtttcctaagtaagttgttttattccaatgttagctctccccctgcccccatttaaggtattcaggaatactgcagtcttttatttgtcaccaattggtatatatgaatactgatttgacattgaggaagggggatatcatttttaatcagacctagtatatagagcacaatttatccaacagaatattaacatattaaagagatttagggcacagatgagagtttcttaaagtggcttttggcagaacagtgcctgaaatactaagattagagaaacccaattgctcctcttaaaacatactgctgtagatgagcctttttattactgcaacagagtttgtggaggacagagaccaaatttgtctttcgtaattaaataagaggaaattaaagccaactcatgttattcctgctactcatatgttcatagtttcttactttagatggatttgaccaggcatgaaactttaatataactagaatctagaagtacagaatgtcatgactctggatttactttgaaatttattcacatggccagcccaatttatttgttagtttctaaggctctctctcttttctccttttcagtttcatttctttttgagccatgctctgaaagattttttttaagaaaattatcttccatattgcatggaattgtgaactaatgctatatatttcagttactctaactttttatttttttaaagtaaaagtattcatctaaagaaatttagttctaatgtagttgggattgcgaacaactttttctttttcatctgcagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatg

SEQ ID NO: 15644 - DNA, 567 bp, Homo sapiens
  ENST00000519025
aaagacgaccagaaaaagtcactgagcactggagaactggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggc

SEQ ID NO: 15645 - DNA, 2473 bp, Homo sapiens
  ENST00000523872
attattgacagagatgtcagtgaagtgccagagtgaagtggcactgcctaagaacagagtgtgaaggcactctatctattaagcacaactctaagaattcttgccttaaacacaataagaaaacaatgccattttatgttagctttgggaagggggagtaagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagat

SEQ ID NO: 15646 - DNA, 1468 bp, Homo sapiens
  ENST00000520550
taagaaaacaatgccattttatgttagctttgggaagggggagtaaggttggagaaactcttttgagatcatgagtttctgtgctcatttgtcagagagattgtaatgtttggttgaaaaaataaaaacttagtaccacagatacaccaatagtgaaagtgatatgcacctgtttgtgatgagactgcaattgctaacatttctatttaaacaaattattagctcttattagtgagctctgaaaatgcaattcattaatttaaatctatgtgggcaggaggaatatgggcactcactgtactttccacttgattttgctgtgaacctaaaactgctctaaaaaatagcctattttaaaaaatataaatctgtggtcactaaaccttaagatgagcattgttttgtgttttcatttcagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagagtaagtagttactaaagatggtgatagcagaagatttttctcattttaggaaaatgcatgacttgctttgtttttagaacaagtgaggaattttactgagtttggaacatcttgtaggagaaaatgtataaactcagtgccattatccagaattttaaaaaaagaaagcttagctaaggaggactaggatttatttttactcataatgctgtgaaacaactctctgtgtccataatgatgtccctgaacatctga

SEQ ID NO: 15647 - DNA, 664 bp, Homo sapiens
  ENST00000432297
gctgggtccctgaatcaccgactggaggagagttacctacaagagccttcatccaggagcatccacactgcaatgatataggaatgaggcggcccctccacagggcccctctcctgcctggacggctctgctggtctccccgtcccctggagaagaacaaggccatgggtcggcccctgctgctgcccctactgcccttgctgctgccgccagcatttctgcagcctagtggctccacaggatctggtccaagctacctttatggggtcactcaaccaaaacacctctcagcctccatgggtggctctgtggaaatccccttctccttctattacccctgggagttagccacagctcccgacgtgagaatatcctggagacggggccacttccacaggcagtccttctacagcacaaggccgccttccattcacaaggattatgtgaaccggctctttctgaactggacagagggtcagaagagcggcttcctcaggatctccaacctgcagaagcaggaccagtctgtgtatttctgccgagttgagctggacacacggagctcagggaggcagcagtggcagtccatcgaggggaccaaactctccatcacccagggtcagcagcggactaaagccacaaccccagccagggaacccttcca

SEQ ID NO: 15648 - DNA, 1316 bp, Homo sapiens
  ENST00000198536
aataggggaaaataagccagatggataaaggaagtgctggtcaccctggaggtgcactggtttggggaaggctcctggcccccacagccctcttcggagcctgagcccggctctcctcactcacctcaacccccaggcggcccctccacagggcccctctcctgcctggacggctctgctggtctccccgtcccctggagaagaacaaggccatgggtcggcccctgctgctgcccctactgcccttgctgctgccgccagcatttctgcagcctagtggctccacaggatctggtccaagctacctttatggggtcactcaaccaaaacacctctcagcctccatgggtggctctgtggaaatccccttctccttctattacccctgggagttagccacagctcccgacgtgagaatatcctggagacggggccacttccacaggcagtccttctacagcacaaggccgccttccattcacaaggattatgtgaaccggctctttctgaactggacagagggtcagaagagcggcttcctcaggatctccaacctgcagaagcaggaccagtctgtgtatttctgccgagttgagctggacacacggagctcagggaggcagcagtggcagtccatcgaggggaccaaactctccatcacccaggctgtcacgaccaccacccagaggcccagcagcatgactaccacctggaggctcagtagcacaaccaccacaaccggcctcagggtcacacagggcaaacgacgctcagactcttggcacataagtctggagactgctgtgggggtggcagtggctgtcactgtgctcggaatcatgattttgggactgatctgcctcctcaggtggaggagaaggaaaggtcagcagcggactaaagccacaaccccagccagggaacccttccaaaacacagaggagccatatgagaatatcaggaatgaaggacaaaatacagatcccaagctaaatcccaaggatgacggcatcgtctatgcttcccttgccctctccagctccacctcacccagagcacctcccagccaccgtcccctcaagagcccccagaacgagaccctgtactctgtcttaaaggcctaaccaatggacagccctctcaagactgaatggtgaggccaggtacagtggcgcacacctgtaatcccagctactctgaagcctgaggcagaatcaagtgagcccaggagttcagggccagctttgataatggagcgagatgccatctctagttaaaaatatatattaacaataaagtaacaaatttaaaaagat

SEQ ID NO: 15649 - DNA, 1043 bp, Homo sapiens
  ENST00000453419
aagccagatggataaaggaagtgctggtcaccctggaggtgcactggtttggggaaggctcctggcccccacagccctcttcggagcctgagcccggctctcctcactcacctcaacccccaggcggcccctccacagggcccctctcctgcctggacggctctgctggtctccccgtcccctggagaagaacaaggccatgggtcggcccctgctgctgcccctactgcccttgctgctgccgccagcatttctgcagcctagtggctccacaggatctggtccaagctacctttatggggtcactcaaccaaaacacctctcagcctccatgggtggctctgtggaaatccccttctccttctattacccctgggagttagccacagctcccgacgtgagaatatcctggagacggggccacttccacaggcagtccttctacagcacaaggccgccttccattcacaaggattatgtgaaccggctctttctgaactggacagagggtcagaagagcggcttcctcaggatctccaacctgcagaagcaggaccagtctgtgtatttctgccgagttgagctggacacacggagctcagggaggcagcagtggcagtccatcgaggggaccaaactctccatcacccagggtcagcagcggactaaagccacaaccccagccagggaacccttccaaaacacagaggagccatatgagaatatcaggaatgaaggacaaaatacagatcccaagctaaatcccaagctccacctcacccagagcacctcccagccaccgtcccctcaagagcccccagaacgagaccctgtactctgtcttaaaggcctaaccaatggacagccctctcaagactgaatggtgaggccaggtacagtggcgcacacctgtaatcccagctactctgaagcctgaggcagaatcaagtgagcccaggagttcagggccagctttgataatggagcgagatgccatctctagttaaaaatatatattaacaataaagtaacaaatttaaaaa

SEQ ID NO: 15650 - DNA, 892 bp, Homo sapiens
  ENST00000484934
acagccctcttcggagcctgagcccggctctcctcactcacctcaacccccaggcggcccctccacagggcccctctcctgcctggacggctctgctggtctccccgtcccctggagaagaacaaggccatgggtcggcccctgctgctgcccctactgcccttgctgctgccgccagcatttctgcagcctagtggctccacaggatctggtccaagctacctttatggggtcactcaaccaaaacacctctcagcctccatgggtggctctgtggaaatccccttctccttctattacccctgggagttagccacagctcccgacgtgagaatatcctggagacggggccacttccacaggcagtccttctacagcacaaggccgccttccattcacaaggattatgtgaaccggctctttctgaactggacagagggtcagaagagcggcttcctcaggatctccaacctgcagaagcaggaccagtctgtgtatttctgccgagttgagctggacacacggagctcagggaggcagcagtggcagtccatcgaggggaccaaactctccatcacccagggtgagtccagctgccctggcacccgctttgcccaccgcagtgaggcttttatgatcactggtgacatcgtccccagcacctcagaccccacttcttctgacgacccctaagttctctctttggcccctaacacttcctcaggcctttgccacctctccccttttctcttccccttgtctccacaactgatctgctttccccaaccatccccctcactgtcccctccagatccagccccgcccccactcctcaggcctcagcagctgctggaccctctaattatccttcattctttctccaaaatgaggc

SEQ ID NO: 15651 - DNA, 909 bp, Homo sapiens
  ENST00000394000
acagccctcttcggagcctgagcccggctctcctcactcacctcaacccccaggcggcccctccacagggcccctctcctgcctggacggctctgctggtctccccgtcccctggagaagaacaaggccatgggtcggcccctgctgctgcccctactgcccttgctgctgccgccagcatttctgcagcctagtggctccacaggatctggtccaagctacctttatggggtcactcaaccaaaacacctctcagcctccatgggtggctctgtggaaatccccttctccttctattacccctgggagttagccacagctcccgacgtgagaatatcctggagacggggccacttccacaggcagtccttctacagcacaaggccgccttccattcacaaggattatgtgaaccggctctttctgaactggacagagggtcagaagagcggcttcctcaggatctccaacctgcagaagcaggaccagtctgtgtatttctgccgagttgagctggacacacggagctcagggaggcagcagtggcagtccatcgaggggaccaaactctccatcacccaggggaacccttccaaaacacagaggagccatatgagaatatcaggaatgaaggacaaaatacagatcccaagctaaatcccaaggatgacggcatcgtctatgcttcccttgccctctccagctccacctcacccagagcacctcccagccaccgtcccctcaagagcccccagaacgagaccctgtactctgtcttaaaggcctaaccaatggacagccctctcaagactgaatggtgaggccaggtacagtggcgcacacctgtaatcccagctactctgaagcctgaggcagaatcaagtgagcccaggagttcagggccagctt

SEQ ID NO: 15652 - DNA, 1011 bp, Homo sapiens
  ENST00000350573
acagccctcttcggagcctgagcccggctctcctcactcacctcaacccccaggcggcccctccacagggcccctctcctgcctggacggctctgctggtctccccgtcccctggagaagaacaaggccatgggtcggcccctgctgctgcccctactgcccttgctgctgccgccagcatttctgcagcctagtggctccacaggatctggtccaagctacctttatggggtcactcaaccaaaacacctctcagcctccatgggtggctctgtggaaatccccttctccttctattacccctgggagttagccacagctcccgacgtgagaatatcctggagacggggccacttccacaggcagtccttctacagcacaaggccgccttccattcacaaggattatgtgaaccggctctttctgaactggacagagggtcagaagagcggcttcctcaggatctccaacctgcagaagcaggaccagtctgtgtatttctgccgagttgagctggacacacggagctcagggaggcagcagtggcagtccatcgaggggaccaaactctccatcacccagggtcagcagcggactaaagccacaaccccagccagggaacccttccaaaacacagaggagccatatgagaatatcaggaatgaaggacaaaatacagatcccaagctaaatcccaaggatgacggcatcgtctatgcttcccttgccctctccagctccacctcacccagagcacctcccagccaccgtcccctcaagagcccccagaacgagaccctgtactctgtcttaaaggcctaaccaatggacagccctctcaagactgaatggtgaggccaggtacagtggcgcacacctgtaatcccagctactctgaagcctgaggcagaatcaagtgagcccaggagttcagggccagctttgataatggagcgagatgccatctctagttaaaaatatatattaacaataaagtaacaaatttaaaaa

SEQ ID NO: 15653 - DNA, 683 bp, Homo sapiens
  ENST00000474013
gtggctccacaggatctggtccaagctacctttatggggtcactcaaccaaaacacctctcagcctccatgggtggctctgtggaaatccccttctccttctattacccctgggagttagccacagctcccgacgtgagaatatcctggagacggggccacttccacaggcagtccttctacagcacaaggccgccttccattcacaaggattatgtgaaccggctctttctgaactggacagagggtcagaagagcggcttcctcaggatctccaacctgcagaagcaggaccagtctgtgtatttctgccgagttgagctggacacacggagctcagggaggcagcagtggcagtccatcgaggggaccaaactctccatcacccaggggacctgcagggacggacactctcgctgcctgcgccctggtaaaccactgcaccatcttaaccactgtgttggttttggagcagatggaaagtggctccataatctaaatgaagcaagacagccttgaactttgatttcctacatatttccttaaatggccttttttgagagatttgggtttttctcaggccttctcttcctctttccttaattcctgcttgcttttctcacctctctgcataggtcagatttgttgtttttttcactaataaattgtattttcaattaattc

SEQ ID NO: 15654 - DNA, 2369 bp, Homo sapiens
  ENST00000360612
agcggaccgacgcgacacgccgtgcgcctccgcggctgcgctacgaaaacgagtcccggagcggccccgcgcccgccgcacccggccctcgcccgcccgaagacaggcgccaagctgccccgccgtctccccagctagcgcccggccgccgccgcctcgcgggccccgggcggaagggggcggggtcccgattcgccccgcccccgcggagggatacgcggcgccgcggcccaaaacccccgggcgaggcggccggggcgggtgaggcgctccgcctgctgcgcgtctacgcggtccccgcgggccttccgggcccactgcgccgcgcggaccgcctcgggctcggacggccggtgtccccggcgcgccgctcgcccggatcggccgcggcttcggcgcctggggctcggggctccggggaggccgtcgcccgcgatgctgctctccaagttcggctccctggcgcacctctgcgggcccggcggcgtggaccacctcccggtgaagatcctgcagccagccaaggcggacaaggagagcttcgagaaggcgtaccaggtgggcgccgtgctgggtagcggcggcttcggcacggtctacgcgggtagccgcatcgccgacgggctcccggtggctgtgaagcacgtggtgaaggagcgggtgaccgagtggggcagcctgggcggcgcgaccgtgcccctggaggtggtgctgctgcgcaaggtgggcgcggcgggcggcgcgcgcggcgtcatccgcctgctggactggttcgagcggcccgacggcttcctgctggtgctggagcggcccgagccggcgcaggacctcttcgactttatcacggagcgcggcgccctggacgagccgctggcgcgccgcttcttcgcgcaggtgctggccgccgtgcgccactgccacagctgcggggtcgtgcaccgcgacattaaggacgaaaatctgcttgtggacctgcgctccggagagctcaagctcatcgacttcggttcgggtgcgctgctcaaggacacggtctacaccgacttcgacggcacccgagtgtacagccccccggagtggatccgctaccaccgctaccacgggcgctcggccaccgtgtggtcgctgggcgtgcttctctacgatatggtgtgtggggacatccccttcgagcaggacgaggagatcctccgaggccgcctgctcttccggaggagggtctctccagagtgccagcagctgatccggtggtgcctgtccctgcggccctcagagcggccgtcgctggatcagattgcggcccatccctggatgctgggggctgacgggggcgtcccggagagctgtgacctgcggctgtgcaccctcgaccctgatgacgtggccagcaccacgtccagcagcgagagcttgtgaggagctgcacctgactgggagctaggggaccacctgccttggccagacctgggacgcccccagaccctgactttctcctgcgtgggccgtctcctcctgcggaagcagtgacctctgacccctggtgaccttcgctttgagtgccttttgaacgctggtcccgcgggacttggttttctcaagctctgtctgtccaaagacgctccggtcgaggtcccgcctgccctgggtggatacttgaaccccagacgcccctctgtgctgctgtgtccggaggcggccttcccatctgcctgcccacccggagctctttccgccggcgcagggtcccaagcccacctcccgccctcagtcctgcggtgtgcgtctgggcacgtcctgcacacacaatgcaagtcctggcctccgcgcccgcccgcccacgcgagccgtacccgccgccaactctgttatttatggtgtgaccccctggaggtgccctcggcccaccggggctatttattgtttaatttatttgttgaggttatttcctctgagcagtctgcctctcccaagccccaggggacagtggggaggcaggggagggggtggctgtggtccagggaccccaggccctgattcctgtgcctggcgtctgtcccggccccgcctgtcagaagatgaacatgtatagtggctaacttaaggggagtgggtgaccctgacacttccaggcactgtgcccagggtttgggttttaaattattgactttgtacagtctgcttgtgggctctgaaagctggggtggggccagagcctgagcgtttaatttattcagtacctgtgtttgtgtgaatgcggtgtgtgcaggcatcgcagatgggggttctttcagttcaaaagtgagatgtctggagatcatatttttttatacaggtatttcaattaaaatgtttttgtacatagtggataa

SEQ ID NO: 15655 - DNA, 723 bp, Homo sapiens
  ENST00000467480
gggcgggtgaggcgctccgcctgctgcgcgtctacgcggtccccgcgggccttccgggcccactgcgccgcgcggaccgcctcgggctcggacggccggtgtccccggcgcgccgctcgcccggatcggccgcggcttcggcgcctggggctcggggctccggggaggccgtcgcccgcgatgctgctctccaagttcggctccctggcgcacctctgcgggcccggcggcgtggaccacctcccggtgaagatcctgcagccaggtacgcgcggggccggcggggccggggccggggccagggcggggaccgggggcgccccgggccgcaccaaccccgcccgcgcctccctgcagccaaggcggacaaggagagcttcgagaaggcgtaccaggtgggcgccgtgctgggtagcggcggcttcggcacggtctacgcgggtagccgcatcgccgacgggctcccggtggctgtgaagcacgtggtgaaggagcgggtgaccgagtggggcagcctgggcggcgcgaccgtgcccctggaggtggtgctgctgcgcaaggtgggcgcggcgggcggcgcgcgcggcgtcatccgcctgctggactggttcgagcggcccgacggcttcctgctggtgctggagcggcccgagccggcgcaggacctcttcgactttatcacggagcgcggcgccctggacgagccgctggcgcgccgcttct

SEQ ID NO: 15656 - DNA, 1094 bp, Homo sapiens
  ENST00000373662
cgccgagggactgcagagccacccacccccgtggctcctactgcgcacgcgtgaaaaaagccaggttgaggggaacgggggagcttcgggcgtagagtgtggggagtgggggatctggtgcaaattagggtgcgtgaaagaagtcacaaaaagcgcagaggccaggcttcccgccctaatccggcctttgtctccgcccctctgcctttgtttcggcccaagcgtcttattggtcagacatcttcagccccattggtccaagagccaaaggacggggtctgccccaagctgtgcctgcttccggagccgcaataagaacggtcaattgagatgcggctttcaggcatttgtttaggacatgcccatggcggggcttctaaaggggcttgtacggcaactggagcggttcagcgttcaacaacaagcttccaagatgccgcccaaaggaaaaagtggttctggaaaagcggggaaagcttgtcaactatcattagtgttagcgtattttgtgtggcccaagataattcttccattgtggcccagggaagctgaaaggttggatacccttgttgtaaagtgtctggccgagttcccttttgaagtgtggcgttatgatggaaatatccactccggttgtgtgttggacctttctgtaaacatggaggtgcagtttaaatgagtacctgtcatctcttctctaaagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaaggggtatgttgctcttattatttataattttctctcaaggtaagaaagcaaagtaaaaatgacaaataataaaataagataaaaattctccatcctccacagaagaaacacagaagtagggatcattcctttgttcaaccattggttgtagcgatattttggtttaaagatctcaaaagcagaaatgtccaacttgtaaa

SEQ ID NO: 15657 - DNA, 1780 bp, Homo sapiens
  ENST00000218432
aattgagatgcggctttcaggcatttgtttaggacatgcccatggcggggcttctaaaggggcttgtacggcaactggagcggttcagcgttcaacaacaagcttccaagatgccgcccaaaggaaaaagtggttctggaaaagcggggaaagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaaggggtatgttgctcttattatttataattttctctcaaggtaagaaagcaaagtaaaaatgacaaataataaaataagataaaaattctccatcctccacagaagaaacacagaagtagggatcattcctttgttcaaccattggttgtagcgatattttggtttaaagatctcaaaagcagaaatgtccaacttgtaaatagtagaataagggtcatctatgtcaaaacctatgcatgaccaaacttgcacggctaacttcaaagtccagcagtgttgagagtacttatgtgttcagtctagttagacttcttctacctatttgtccttattgagcctattcctgtattgctcttaggaatatacctcgtaaccttagcaaaatgttgggaaattctctcaagctacagtagaactgttccctcttctgggccacttgatatcacttatcttttgggtttttcagggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataaaatcatatgaaagactgaataagttttatacattttgtttctttaaaaggtattacatattcttttgagctggagctgcaaggaaatacaaaaatttttaaaaagaaaagatattggatgctccttgtattctgtgaaagctctaagtatgggtttgtaggtgtaagagagggtggggctaagtgaatgtcaactgtagtaggtattcagtcagtctttctcaaagagaagtcaagcagactccctttaacctgtattctctttcctcccagaactatatctgactctcagtctgtcccataaattaattcagaaaccatcttcaggggaagcagatatcaactcacactattcacacaactgaaaatattgggcatcaaatagattagtgtgtgagaatcataaaataagttcctagacaacatttgttttacatgttagtcaactctgatcttccaggacaggtggtattagctccactgtcttaacatagtacgtggcacgttatgcctttcagtgttaactcctttctttttaaataaatgtttattggaggaaaaaagcactcagttgttccatgagttgttttgtactagactaaccgagtgctggttaaagggagggatgtcagcataaaaatgtcattccctcatcttcagtgtatgggttacattaagactgtcctttccagggccaatgttctgtgcatctaaatttttaaaatttaaaatgccatatttatgacatataaaaaagtataaagattactaatataaatactatactgcttcaaaaataaaactttgccaac

SEQ ID NO: 15658 - DNA, 1321 bp, Homo sapiens
  ENST00000373669
tgagatgcggctttcaggcatttgtttaggacatgcccatggcggggcttctaaaggggcttgtacggcaactggagcggttcagcgttcaacaacaagcttccaagatgccgcccaaaggaaaaagtggttctggaaaagcggggaaagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataaaatcatatgaaagactgaataagttttatacattttgtttctttaaaaggtattacatattcttttgagctggagctgcaaggaaatacaaaaatttttaaaaagaaaagatattggatgctccttgtattctgtgaaagctctaagtatgggtttgtaggtgtaagagagggtggggctaagtgaatgtcaactgtagtaggtattcagtcagtctttctcaaagagaagtcaagcagactccctttaacctgtattctctttcctcccagaactatatctgactctcagtctgtcccataaattaattcagaaaccatcttcaggggaagcagatatcaactcacactattcacacaactgaaaatattgggcatcaaatagattagtgtgtgagaatcataaaataagttcctagacaacatttgttttacatgttagtcaactctgatcttccaggacaggtggtattagctccactgtcttaacatagtacgtggcacgttatgcctttcagtgttaactcctttctttttaaataaatgtttattggaggaaaaaagcactcagttgttccatgagttgttttgtactagactaaccgagtgctggttaaagggagggatgtcagcataaaaatgtcattccctcatcttcagtgtatgggttacattaagactgtcctttccagggccaatgttctgtgcatctaaatttttaaaatttaaaatgccatatttatgacatataaaaaagtataaagattactaatataaatactatactgcttcaaaaataaaactttgccaacacagcta

SEQ ID NO: 15659 - DNA, 678 bp, Homo sapiens
  ENST00000496835
gttcaacaacaagcttccaagatgccgcccaaaggaaaaagtggttctggaaaagcggggaaagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggattcccagcctgcagcaacatgctggtcaccatagagacctgagaagcaccctcatctcattggtatcatatttacaaaccaccccttaaagtggattattttgcagatggctgatctcatctattcaatgttgattctattagttccaatttcagaaggtgacattttctgactttgtccccttaagcacaaacaaaaactatggatttttgtttttgttttcagaaaagagaaagtacaaggtgtgcttggggaacagcaaggaaaccagacagatgtgggggcgggtttgtaggggaactgctggatgtacctcattaatttgttcatttgttcagcacccacagggtgccagtgaacgggctaggtgctggggatagagtggtgaacaagatgagccttatgcacctcacagtctc

SEQ ID NO: 15660 - DNA, 577 bp, Homo sapiens
  ENST00000439980
gttcaacaacaagcttccaagatgccgcccaaaggaaaaagtggttctggaaaagcggggaaagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaaggggccttcagactccgatgaattacaccactggcttgcctggttctccagcttgcagacagaagactgtgggacttctcagcctctataatcttctccttcccagctagccactcacaaccccgccatgggcctcagaattgctaaagggacatcagaccatactacacatcattagatctcaatgaagaacacctctagttggcccgtctctttgtgaggtgccacccttgacatcaagtgcaggcctcgacgttgttggcatttcagagccttggcagaagttggataaattggcgggaagtgatgctgccagctggag

SEQ ID NO: 15661 - DNA, 776 bp, Homo sapiens
  ENST00000446576
caaaggaaaaagtggttctggaaaagcggggaaaggtagagcggccagagcgatcaaggagaatgggggcgggtgaggagcgaagggagggaacagacagtccatctccggagtccgggacggacgcagcagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaaggggtatgttgctcttattatttataattttctctcaaggtaagaaagcaaagtaaaaatgacaaataataaaataagataaaaattctccatcctccacagaagaaacacagaagtagggatcattcctttgttcaaccattggttgtagcgatattttggtttaaagatctcaaaagcagaaatgtccaacttgtaaatagtagaataagggtcatctatgtcaaaacctatgcatgaccaaacttgcacggctaacttcaaagtccagcagtgttgagagtacttatgtgttcagtctagttagacttcttctacctatttgtccttattgagcctattcctgtattgctcttaggaatatacctcgtaaccttagcaaaatgttgggaaattctctcaagctacagtagaactgttccctcttctgggccacttgatatcacttatctt

SEQ ID NO: 15662 - DNA, 1605 bp, Homo sapiens
  ENST00000423432
aattgagatgcggctttcaggcatttgtttaggacatgcccatggcggggcttctaaaggggcttgtacggcaactggagcggttcagcgttcaacaacaagcttccaagatgccgcccaaaggaaaaagtggttctggaaaagcggggaaagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggattcccagcctgcagcaacatgctggtcaccatagagacctgagaagcaccctcatctcattggtatcatatttacaaaccaccccttaaagtggattattttgcagatggctgatctcatctattcaatgttgattctattagttccaatttcagaaggtgacattttctgactttgtccccttaagcacaaacaaaaactatggatttttgtttttgttttcagaaaagagaaagtacaaggtgtgcttggggaacagcaaggaaaccagacagatgtgggggcgggtttgtaggggaactgctggatgtacctcattaatttgttcatttgttcagcacccacagggtgccagtgaacgggctaggtgctggggatagagtggtgaacaagatgagccttatgcacctcacagtctcctgggggagacagccaaatagacaattttaatacaatgtggcaaattctatgatgggaagaagagagaaatggtgtgtgtgagtccctcaccttcccagaggtttcccaggggaagcaacgtttcagctgagacctgaaggatggatgacagtccaccagaaaaaagttagtggagcggggacaagcagggttgcagagtggaagaaaaatgttcctgtgagaagaaactgtccaaagagtctgaagagaaaagggaacagggtgaatttgaggccctacaagaaaaacaggagaccattcaacaggagacgcccagggagcaggtggctttgtgggcctgatgtccaagaaagaagtcgtggtggtaaacagagacttgggattgcaagctactgttgtctttctattgaaaaaatagctgagcaccacactagggaggccttgcaaggacagcccaaagaatttgaacttgattctacaggcagtgattttgaacaagaggttttgaagagaacgtgacacacgtcaagctgagctctagggagtgggcagcagcctgcagaagagggactaggctaggagcacagaaagtagcccacggcagaggtagcagaaggaatggaggagtgcccatgtgaggggtactgaggtggcacacttgccagaatcagggcagcctgcttggtctcataccagctggaaccagttcctaccagctcccaagggctaattgttaaactttcaggaattttctcagcattcattaaaaatgaaaaaaagtatcaatattaaaaatatttttgctggacatggtgtctcaggcctgtaatcccagct

SEQ ID NO: 15663 - DNA, 3802 bp, Homo sapiens
  ENST00000376573
gcggcgggcgcaggatacgggccggggcgcgagccgagcgcagtctgccgggccgagcgggcggagcgagccgagtggggctgagcgcgccggcggcggcgggcggagcggagcgcggcgcgccggggccgccgccggggggatgcggctgcctccccgggccggggtgtagagagggcgggtccccggcctcgggagcacggcggtggaggggacataggaggcggccatggcgacccccggcaacctagggtcctctgtcctggcgagcaagaccaagaccaagaagaagcacttcgtagcgcagaaagtgaagctgtttcgggccagcgacccgctgctcagcgtcctcatgtggggggtaaaccactcgatcaatgaactgagccatgttcaaatccctgttatgttgatgccagatgacttcaaagcctattcaaaaataaaggtggacaatcacctttttaacaaagaaaacatgccgagccatttcaagtttaaggaatactgcccgatggtcttccgtaacctgcgggagaggtttggaattgatgatcaagatttccagaattccctgaccaggagcgcacccctccccaacgactcccaggcccgcagtggagctcgttttcacacttcctacgacaaaagatacatcatcaagactattaccagtgaagacgtggccgaaatgcacaacatcctgaagaaataccaccagtacatagtggaatgtcatgggatcacccttcttccccagttcttgggcatgtaccggcttaatgttgatggagttgaaatatatgtgatagttacaagaaatgtattcagccaccgtttgtctgtgtataggaaatacgacttaaagggctctacagtggctagagaagctagtgacaaagaaaaggccaaagaactgccaactctgaaagataatgatttcattaatgagggccaaaagatttatattgatgacaacaacaagaaggtcttcctggaaaaactaaaaaaggatgttgagtttctggcccagctgaagctcatggactacagtctgctggtgggaattcatgatgtggagagagccgaacaggaggaagtggagtgtgaggagaacgatggggaggaggagggcgagagcgatggcacccacccggtgggaacccccccagatagccccgggaatacactgaacagctcaccacccctggctcccggggagttcgatccgaacatcgacgtctatggaattaagtgccatgaaaactcgcctaggaaggaggtgtacttcatggcaattattgacatccttactcattatgatgcaaaaaagaaagctgcccatgctgcaaaaactgttaaacatggcgctggcgcggagatctccaccgtgaacccagaacagtattcaaagcgctttttggactttattggccacatcttgacgtaacctcctgcgcagcctcggacagacatgaacattggatggacagaggtggcttcggtgtaggaaaaatgaaaaccaaactcagtgaagtactcatcttgcaggaagcaaacctccttgtttacatcttcaggccaagatgactgatttgggggctactcgctttacagctacctgattttcccagcatcgttctagctatttctgactttgtgtatatgtgtgtgtgtgtgtgttgggggggggtgagtgtgtgcgcgcgtgtgcattttaaaagtcataaattaattaaaacagatccacttcggtcagtatgtgtcccaacaaagaccctttgattccagctatggccgaatgaatgagtgagtgagtgagtgagtgaatgaacacacgtgtgggggaggggagaaggaagtgcatgatgtcaggcaccgtgttggcatcacacaacaaactgtggatcagttttttttttttttttttttttttggagttgaaagatgtgagacagtattcagaataatgaagataataatgatgattattataataatgatgatgattccaaggaaaaaacctacagcgaatgttccatttctaccccgcacgcagacactctccctaacactgataacctgagcccccagcactggacggaagaatgctggcgtctccgtgtgtactggttcagggttctggccccagccttgtcaggaccccctggtgtccagagcccccacccctcccgcaacaagcagctgatgccccagtgattctctatacatttttcacctcggccaatatgtccaggaaaactgcttacttctcttttcttgcctggagccttcattgttcacccttacgttgcaatataggaattaatgctacaaaataaaagtaaagcttacctgaaaagtgcatagtttggggcaatggtatctacatctcccactgtgggaaaaccagcaaagcatcaaaactctcaattctcctgttaccaaatgcagatctgaattataagatgtttatgtttgaccattgtttcaacaatgggattttgttacgaattatccctttaactgaaaccctcagttttactgtttacattattaggaaaacagggatatcttttgaatctaaaaatttgatgtacagcatgtgatttttgaagtttacatgtaaagtcacagtataggtgaaataacgtttgtcatattttgagacgtatcctgcagccatgtttttacgtgagtgttttagtcaaagtacatggtagacagtctttcacaataaaaggaaaaggatttttttttcctccaaatgtacatttatcaacctaatgattgatttttttaaaaagagatttcgccccagtctggtttatgaaagttcattgccctaaactgtgctgattgtttttaatcaagttataaatttccaacctagatcatgtatctaccaactctcctgcattttccaaaaggcattgagcttaaatattagtcttgcttagagtaggttatccacttacatgctgcgctaaagccatgcctttgaaactccttgtttaaaacatgatatgatttttgtgggcagtttcagaaaagaaaacaaacaaacaaaaatcgaccctttaattattacttgcaactcaacagatctccctgccgtactgccttttccaggaactttacttcagggctgtccagattgcagctgtgccccgtgtatgtggatctagttcacagagtctttggaagccagcagtcgtgccctccgtatactgtccactcattttatgtagatttggtatcctcagcagccagtgttaacaccactgtcacgtagtgtacagattcatcttttatgtatttaaagtaatccatactatgatttggtttttccctgcaccattaattctggcatcagatcagtttttgtgttgtgaagttctactgtggtttgacccaagaccacaaccatgagaccctgaagtaaagataaggtacacatacattatttgagtaactgtttccttgggggccaatctgtgtatgcttttagaagtttacagaatgcttttatttttgtctataacaaacagtctgtcatttatttctgttgataaaccatttggacagagtgaggacgtttgccctgttatctcctagtgctaacaatacactccagtcatgagccgggctttacaaataaagcacttttgatgactcacaagatgaatccttttttcctctgtcccaattgtgtgtctctgttccaaacacattttaaatactcggtcctgacagtgtctttagctaatccttgaagaaatgaaagtggaattgaatcttt

SEQ ID NO: 15664 - DNA, 1319 bp, Homo sapiens
  ENST00000323883
ttcctacgacaaaagatacatcatcaagactattaccagtgaagacgtggccgaaatgcacaacatcctgaagaaataccaccagtacatagtggaatgtcatgggatcacccttcttccccagttcttgggcatgtaccggcttaatgttgatggagttgaaatatatgtgatagttacaagaaatgtattcagccaccgtttgtctgtgtataggaaatacgacttaaagatggccaatctaaaagccactttcacttttcccaagccaactggctctacagtggctagagaagctagtgacaaagaaaaggccaaagaactgccaactctgaaagataatgatttcattaatgagggccaaaagatttatattgatgacaacaacaagaaggtcttcctggaaaaactaaaaaaggatgttgagtttctggcccagctgaagctcatggactacagtctgctggtgggaattcatgatgtggagagagccgaacaggaggaagtggagtgtgaggagaacgatggggaggaggagggcgagagcgatggcacccacccggtgggaacccccccagatagccccgggaatacactgaacagctcaccacccctggctcccggggagttcgatccgaacatcgacgtctatggaattaagtgccatgaaaactcgcctaggaaggaggtgtacttcatggcaattattgacatccttactcattatgatgcaaaaaagaaagctgcccatgctgcaaaaactgttaaacatggcgctggcgcggagatctccaccgtgaacccagaacagtattcaaagcgctttttggactttattggccacatcttgacgtaacctcctgcgcagcctcggacagacatgaacattggatggacagaggtggcttcggtgtaggaaaaatgaaaaccaaactcagtgaagtactcatcttgcaggaagcaaacctccttgtttacatcttcaggccaagatgactgatttgggggctactcgctttacagctacctgattttcccagcatcgttctagctatttctgactttgtgtatatgtgtgtgtgtgtgtgttgggggggggtgagtgtgtgcgcgcgtgtgcattttaaaagtcataaattaattaaaacagatccacttcggtcagtatgtgtcccaacaaagaccctttgattccagctatggccgaatgaatgagtgagtgagtgagtgagtgaatgaacacacgtgtgggggaggggagaaggaagtgcatgatgtcaggcaccgtgttggcatcacacaacaaactgtggatcagt

SEQ ID NO: 15665 - DNA, 559 bp, Homo sapiens
  ENST00000474335
gcgcatcactaggatgttacacaaattcttttttgtttgaaaaatgttccagagataaaagtgcaaaagaagataatgaagtgttctaatatgaaatattcaaaactgaagcatgattgtctgcttaagacacttcccaagtatacaggattaatatttcttttctcacagctggcgcggagatctccaccgtgaacccagaacagtattcaaagcgctttttggactttattggccacatcttgacgtaacctcctgcgcagcctcggacagacatgaacattggatggacagaggtggcttcggtgtaggaaaaatgaaaaccaaactcagtgaagtactcatcttgcaggaagcaaacctccttgtttacatcttcaggccaagatgactgatttgggggctactcgctttacagctacctgattttcccagcatcgttctagctatttctgactttgtgtatatgtgtgtgtgtgtgtgttgggggggggtgagtgtgtgcgcgcgtgtgcattttaaaagtcataaattaattaaaacagatccacttcggtca

SEQ ID NO: 15666 - DNA, 1436 bp, Homo sapiens
  ENST00000545335
gcagctgctgcggggcggggagccggagtcagccctggacctccggctgctcgcccgcctcgaagcccccagccccgcggcgcgtgcccccagccctctgggccgcccaggcaccaccacttgcgtcccctttagatctatggcccggtgcgggtcgggggtcccgtgtgcatatcaatgaactgagccatgttcaaatccctgttatgttgatgccagatgacttcaaagcctattcaaaaataaaggtggacaatcacctttttaacaaagaaaacatgccgagccatttcaagtttaaggaatactgcccgatggtcttccgtaacctgcgggagaggtttggaattgatgatcaagatttccagaattccctgaccaggagcgcacccctccccaacgactcccaggcccgcagtggagctcgttttcacacttcctacgacaaaagatacatcatcaagactattaccagtgaagacgtggccgaaatgcacaacatcctgaagaaataccaccagtacatagtggaatgtcatgggatcacccttcttccccagttcttgggcatgtaccggcttaatgttgatggagttgaaatatatgtgatagttacaagaaatgtattcagccaccgtttgtctgtgtataggaaatacgacttaaagggctctacagtggctagagaagctagtgacaaagaaaaggccaaagaactgccaactctgaaagataatgatttcattaatgagggccaaaagatttatattgatgacaacaacaagaaggtcttcctggaaaaactaaaaaaggatgttgagtttctggcccagctgaagctcatggactacagtctgctggtgggaattcatgatgtggagagagccgaacaggaggaagtggagtgtgaggagaacgatggggaggaggagggcgagagcgatggcacccacccggtgggaacccccccagatagccccgggaatacactgaacagctcaccacccctggctcccggggagttcgatccgaacatcgacgtctatggaattaagtgccatgaaaactcgcctaggaaggaggtgtacttcatggcaattattgacatccttactcattatgatgcaaaaaagaaagctgcccatgctgcaaaaactgttaaacatggcgctggcgcggagatctccaccgtgaacccagaacagtattcaaagcgctttttggactttattggccacatcttgacgtaacctcctgcgcagcctcggacagacatgaacattggatggacagaggtggcttcggtgtaggaaaaatgaaaaccaaactcagtgaagtactcatcttgcaggaagcaaacctccttgtttacatcttcaggccaagatgactgatttgggggctactcgctttacagctacctgattttcccagca

SEQ ID NO: 15667 - DNA, 443 bp, Homo sapiens
  ENST00000604912
gtgaagacgtggccgaaatgcacaacatcctgaagaaataccaccagtacatagtggaatgtcatgggatcacccttcttccccagttcttgggcatgtaccggcttaatgttgatggagttgaaatatatgtgatagttacaagaaatgtattcagccaccgtttgtctgtgtataggaaatacgacttaaagggctctacagtggctagagaagctagtgacaaagaaaaggccaaagaactgccaactctgaaagataatgatttcattaatgagggccaaaagatttatattgatgacaacaacaagaaggtcttcctggaaaaactaaaaaaggatgttgagtttctggcccagctgaagctcatggactacagtctgctggtgggaattcatgatgtggagagagccgaacaggaggaagtggagtgtgaggagaac

SEQ ID NO: 15668 - DNA, 768 bp, Homo sapiens
  ENST00000422321
atcaatgaactgagccatgttcaaatccctgttatgttgatgccagatgacttcaaagcctattcaaaaataaaggtggacaatcacctttttaacaaagaaaacatgccgagccatttcaagtttaaggaatactgcccgatggtcttccgtaacctgcgggagaggtttggaattgatgatcaagatttccagaattccctgaccaggagcgcacccctccccaacgactcccaggcccgcagtggagctcgttttcacacttcctacgacaaaagatacatcatcaagactattaccagtgaagacgtggccgaaatgcacaacatcctgaagaaataccaccagtacatagtggaatgtcatgggatcacccttcttccccagttcttgggcatgtaccggcttaatgttgatggagttgaaatatatgtgatagttacaagaaatgtattcagccaccgtttgtctgtgtataggaaatacgacttaaagggctctacagtggctagagaagctagtgacaaagaaaagtctcccacccctgctattgtggttcttcctgttccccattctgctgccaccagcgagaaacactgtattgacccgatgagagttctacttcatttctcttcatcaaattgttgaatagtgaaacagttatttgttgcaagcatggttggaaggaacattccacatgcaacttgctcttgaaaaacacagccacctgtgcagtaaacctataatcgaaaatggcactgacagctg

SEQ ID NO: 15669 - DNA, 304 bp, Homo sapiens
  ENST00000432610
atcaatgaactgagccatgttcaaatccctgttatgttgatgccagatgacttcaaagcctattcaaaaataaaggtggacaatcacctttttaacaaagaaaacatgccgagccatttcaagtttaaggaatactgcccgatggtcttccgtaacctgcgggagaggtttggaattgatgatcaagatttccaggtgagttgcgtttgtaacatttgcttccagtaggaaatgggttttgccatgacttttgctgtgtcaattgggatctgtatttttgtcaataaaagtattatataatagt

SEQ ID NO: 15670 - DNA, 558 bp, Homo sapiens
  ENST00000605011
ttgattaactatgagaaacatatttttaagaaggcttatttttgggaagttagagttgtgttgtttgaggtgtgctcctgaaagctgtttactcaaacctttatgggtcaagttttgtgctgggagcagggtttcccttgtagtgaggagcttacacctggaaacatagcaaatgacgcaatgggagagccacctcactgtggaatcagcctcttctctctggtccttcatcctagaatttgcatccggtgtttctaacttctgctcagaaaccgtgaaaataatatattcatttaccgattgattcatccaaacaataattgggtacacactacataccaggttcaagcgattctcctgcctcagcctcccgagtagctgggattacaggcgcctgccaccatgccctgcccccattagcatcttgggggaatcaaaccaagaatctaccaacccttaagagccaactttagggacaagcaatgtcttcatcgagaggcacatcacatccccaaaggccaaattttggtgaacagtgactgtgtccattctttatat

SEQ ID NO: 15671 - DNA, 5080 bp, Homo sapiens
  ENST00000335312
ctcccttggccggcggcgcttgttgttcggcggcggcggtcgcagctcgggtccccctcgggcgcccccgccgccgtccgcgcgcggccatggagctggaggtaccggacgaggcggagagcgctgaggcgggggccgtgccctcggaggcggcgtgggcggcagagagcggggcggcggcaggtttggctcagaagaaggcggccccaacagaggttctgtccatgacggcacagccgggccctggccatgggaagaagttgggccatcgaggtgtggacgcatccggcgaaaccacctacaagaagaccacctcctccaccctgaagggtgccatccagctgggcatcggctacaccgtgggccacctgagctccaagcccgaacgcgacgtgctcatgcaggacttctacgtggtggagagcatcttcttccccagcgaaggcagcaacctcacccccgcccaccacttccaggacttccgcttcaagacctatgcacctgtcgccttccgctacttccgggagctctttgggatccggccagatgattacttgtactccctgtgcaatgagccgctgatcgagctgtccaacccgggcgccagtggctccctcttctacgtcaccagcgacgacgagttcatcatcaagaccgtcatgcacaaggaggccgagttcctgcagaagctgctccctggctactacatgaacctcaaccagaacccgcggacgctgctgcccaagttctatgggctgtactgcgtgcagtcggggggcaagaacatccgcgtcgtggtcatgaacaacatcctgccccgcgtggtcaagatgcacctcaagttcgacctcaagggctccacctacaagcggcgcgccagcaagaaggagaaggagaagagcttccccacctacaaggacctggacttcatgcaggacatgcccgaggggctcctgctggacgccgacaccttcagcgccctggtcaagacgctgcagcgggactgcctggtcctggaaagtttcaagatcatggactacagcctgctgctgggcgtgcacaacatcgaccagcacgagcgcgagcggcaggcgcagggcgcccagagcacctcagatgagaagcggcctgtgggccagaaggcgctctactccacggccatggagtccatccagggtggcgccgcgcgcggggaggccatcgaatcggatgacacgatgggcgggatccccgctgtgaacggccgcggggagcggctgctgctgcacattggcatcatcgacatcctgcagtcctacaggttcatcaagaaactggagcacacctggaaggccctcgtccacgatggggacacggtgtccgtccaccgccccagcttctatgccgagcgctttttcaagttcatgagcaacacggtctttcggaagaactcctccctgaagtcctcgccctccaagaaggggcgcggcggagccttgctagctgtgaaaccgctggggcccaccgctgccttctcggccagccagatccctagcgagcgggaggaggcccagtacgacctgcggggggcccgcagctaccccacgctggaggacgaaggccggcccgacctcctgccctgcacgccaccttctttcgaagaagccactacagcctccattgccacgactctgtcatccacatccctctccattcctgagcggtccccctcggagacgtcggagcagccgcggtacaggcggcgcacacagtcgtctggacaggatggcaggccgcaggaggagccacccgcggaagaggatctgcagcagattacagtgcaggtggagcctgcgtgcagcgtggagattgtggtccccaaagaggaggacgcaggggtggaggcttccccggccggtgcctctgctgctgttgaagtagaaactgccagccaggcctcagacgaggagggcgcacctgccagccaggcctcggacgaggaggacgcgcccgccaccgacatctactttcccaccgatgagaggagctgggtgtactccccgctccactatagcgcccaggcccccccggcctccgacggcgagagcgacacataatttctatgcagcccccgacccagagccgagctccacttctgctccggctgcccccgaaggcgctgcccaccccgctgaggcccagagctcgggagatgcccgcctcgccgccccaccggacctcgtcctccccctgcacggatgccgacggccgggcccctccccgacaagcctcccagggccccggcaccccggtcggcagcctgcccctgtgagacccaccctcccgagcggccaatcgcatttgagtccttatttggcacagagacggaagcacgtgtgtgccgttttaggaaaagaacaaaaaagacacaaacaaaccaaccagagggagaagagcccctgcccactgcactctttggttctctgctgtgcctgcctgtgtcctgaggaagaagccaggctgttcgcggtggcctctggggacctgagccccgggggccccatcggcctgcagaggggacggctggggtcccgagcaactctgcctccatccacgtgggaagcggaccctcctgccctcagcttgggtttgggggcctcagtgcaggacatctggcctgaacatcgactgtggggacagccctcgccctgccaagcactgcggccactcagcagctatgttcccgccgcagtggggccctgacgcccacctcccaggtgcccctcgagcaaaaacctctggcgcctccaatccagacccaccacagctggagggccaggcctcctcttccccaggctgccacccacgctggcggagctcagggctggggacttgtccttctcttccaacgtaggccactcagcaactggcatggagggcccaggcaacggagacgttttctccatggcaggacagagcgggaggccgggccttgggccacaggagaccagctcagggcggaaggtcaggctccccgccccctccacgtggagacatggcctagggggccaggcccggctccacaggagtctccttcaggactggtgtggatgtccgccgcctctttcttgtttaagtgatgtgatgtctccgaggaggggagagaagactttgtttccgactcatcaccctccaagagggcagcgctcccagtggtgggactcagcccagactgccctggggcagcttcctgggcccgctgcgctcagagggtgctggttggaggccagagctcggcagagtcacccaccctgcccttccccaggacccctgagaggggcttattggtgatggctgtgggaatcccccacttccaagatgtgcccaggatgtgaggagctggagtggaagctgcacctttgggaagaattcctctccagacctggcagagcctggtgtggggtctgagacggccggagaacctcccaggcagggctctgtgttttgtctgttacaacctccgtatgacgccacgccacccgctgttcacgtcccgtcggcctcctgcacagcccacacgctgcgcccggaaggcccctgctgtggagaagccggacccatccccgaggtccccagcgaggacacacactccacgagagcagcccctccactctgcccaggagaggggccgaccctcctcgggaaccggccagccgcgtggctcccagcatccatcaggacaagcccacgtggggtcctccctgcgtgctcagagggtctgtccagccctgggaagcgaccttggcctcagttcacagcctggtgctcatctgctggcaccgggcatccacccatcagcccccgccctgtccctccgaaggacacccagcaggcaccccccggggaggcaggggcagaggtcagaaggggtgtctgggacctggatggccagcagggacaggggcattgtcatctcaaaggcccaacccccagaggccacaccagtcctcccagggagtcctcgagtcgccctgcccagagccctggcaccagagacgccaagagcctgtggggtgactcggagcagcaggtgtggccccgggcgggcggcaccgcgtccagggcagcctccctccgctgagtgacacgggacaccagtgcccggccgacgcgcctttgcaggagaaatgtgcaaacctctgtggataccatttcatttccattcttgtgttgtctccaaggcccttttggagatatacttggtgttggttgtgttttttggttccttttcagagaactgtaaaccgaggctgacgtgctccactgactgtgccgaggggcgggggcaggaggacggcaagacctatttataatatttagcgaactcggtctccctcagatcccccgcgagggaggctgctggacccaccccgctgtcccccatgatagaagtctgtaaataccttggtgaccaatgcccacttcccctcctgggtcacctctgatggctgctgtccactgagaacgtgggcagtgtccaaattcctgtactgtaaagactaaaaggcgtttgctctgagactgacaaggcggaaacttccatgtgtctcctgccaggctctgtccccctacgccatcccgacacgtccccgttcccccgaaacctggctcagtgcaatactcccattgccatggggtccttcaccatggtactgtctccacagccctcagtccccaccccaggagaggcgcctgccacctcctcctcatctccggtggttcaatcgctccgcctgtccccaacccagtcccatttttatggccaaactgattctgaaacaaaatgaaactgcaaacctcgtgtgtcttaactccccccagggatgccactccattcctccgccccgtggtctggtgcgtgacaatccaaagcgccgagacgagggtgctgtgtccctcaaacccagagtggtgggcgcctctgaaaccatacagccactcctggccccaaacactggtttgcatcccaggttcctcgcccacctacccccgccacaccccgtctttttagagatctctctaataaatcgggtaataagca

SEQ ID NO: 15672 - DNA, 2289 bp, Homo sapiens
  ENST00000539785
ggcgcttgttgttcggcggcggcggtcgcagctcgggtccccctcgggcgcccccgccgccgtccgcgcgcggccatggagctggaggtaccggacgaggcggagagcgctgaggcgggggccgtgccctcggaggcggcgtgggcggcagagagcggggcggcggcaggtttggctcagaagaaggcggccccaacagaggttctgtccatgacggcacagccgggccctggccatgggaagaagttgggccatcgaggtgtggacgcatccggcgaaaccacctacaagaagaccacctcctccaccctgaagggtgccatccagctgggcatcggctacaccgtgggccacctgagctccaagcccgaacgcgacgtgctcatgcaggacttctacgtggtggagagcatcttcttccccagcgaaggcagcaacctcacccccgcccaccacttccaggacttccgcttcaagacctatgcacctgtcgccttccgctacttccgggagctctttgggatccggccagatgattacttgtactccctgtgcaatgagccgctgatcgagctgtccaacccgggcgccagtggctccctcttctacgtcaccagcgacgacgagttcatcatcaagaccgtcatgcacaaggaggccgagttcctgcagaagctgctccctggctactacatgaacctcaaccagaacccgcggacgctgctgcccaagttctatgggctgtactgcgtgcagtcggggggcaagaacatccgcgtcgtggtcatgaacaacatcctgccccgcgtggtcaagatgcacctcaagttcgacctcaagggctccacctacaagcggcgcgccagcaagaaggagaaggagaagagcttccccacctacaaggacctggacttcatgcaggacatgcccgaggggctcctgctggacgccgacaccttcagcgccctggtcaagacgctgcagcgggactgcctggtcctggaaagtttcaagatcatggactacagcctgctgctgggcgtgcacaacatcgaccagcacgagcgcgagcggcaggcgcagggcgcccagagcacctcagatgagaagcggcctgtgggccagaaggcgctctactccacggccatggagtccatccagggtggcgccgcgcgcggggaggccatcgaatcggatgacacgatgggcgggatccccgctgtgaacggccgcggggagcggctgctgctgcacattggcatcatcgacatcctgcagtcctacaggttcatcaagaaactggagcacacctggaaggccctcgtccacgatggggacacggtgtccgtccaccgccccagcttctatgccgagcgctttttcaagttcatgagcaacacggtctttcggaagaactcctccctgaagtcctcgccctccaagaaggggcgcggcggagccttgctagctgtgaaaccgctggggcccaccgctgccttctcggccagccagatccctagcgagcgggaggaggcccagtacgacctgcggggggcccgcagctaccccacgctggaggacgaaggccggcccgacctcctgccctgcacgccaccttctttcgaagaagccactacagcctccattgccacgactctgtcatccacatccctctccattcctgagcggtccccctcggagacgtcggagcagccgcggtacaggcggcgcacacagtcgtctggacaggatggcaggccgcaggaggagccacccgcggaagaggatctgcagcagattacagtgcaggtggagcctgcgtgcagcgtggagattgtggtccccaaagaggaggacgcaggggtggaggcttccccggccggtgcctctgctgctgttgaagtagaaactgccagccaggcctcagacgaggagggcgcacctgccagccaggcctcggacgaggaggacgcgcccgccaccgacatctacttttaatttctatgcagcccccgacccagagccgagctccacttctgctccggctgcccccgaaggcgctgcccaccccgctgaggcccagagctcgggagatgcccgcctcgccgccccaccggacctcgtcctccccctgcacggatgccgacggccgggcccctccccgacaagcctcccagggccccggcaccccggtcggcagcctgcccctgtgagacccaccctcccgagcggccaatcgcatttgagtccttatttggcacagagacggaagcacgtgtgtgccgtttt

SEQ ID NO: 15673 - DNA, 2933 bp, Homo sapiens
  ENST00000589578
atggagctggaggtaccggacgaggcggagagcgctgaggcgggggccgtgccctcggaggcggcgtgggcggcagagagcggggcggcggcaggtttggctcagaagaaggcggccccaacagaggttctgtccatgacggcacagccgggccctggccatgggaagaagttgggccatcgaggtgtggacgcatccggcgaaaccacctacaagaagaccacctcctccaccctgaagggtgccatccagctgggcatcggctacaccgtgggccacctgagctccaagcccgaacgcgacgtgctcatgcaggacttctacgtggtggagagcatcttcttccccagcgaaggcagcaacctcacccccgcccaccacttccaggacttccgcttcaagacctatgcacctgtcgccttccgctacttccgggagctctttgggatccggccagatgattacttgtactccctgtgcaatgagccgctgatcgagctgtccaacccgggcgccagtggctccctcttctacgtcaccagcgacgacgagttcatcatcaagaccgtcatgcacaaggaggccgagttcctgcagaagctgctccctggctactacatgaacctcaaccagaacccgcggacgctgctgcccaagttctatgggctgtactgcgtgcagtcggggggcaagaacatccgcgtcgtggtcatgaacaacatcctgccccgcgtggtcaagatgcacctcaagttcgacctcaagggctccacctacaagcggcgcgccagcaagaaggagaaggagaagagcttccccacctacaaggacctggacttcatgcaggacatgcccgaggggctcctgctggacgccgacaccttcagcgccctggtcaagacgctgcagcgggactgcctggtcctggaaagtttcaagatcatggactacagcctgctgctgggcgtgcacaacatcgaccagcacgagcgcgagcggcaggcgcagggcgcccagagcacctcagatgagaagcggcctgtgggccagaaggcgctctactccacggccatggagtccatccagggtggcgccgcgcgcggggaggccatcgaatcggatgacacgatgggcgggatccccgctgtgaacggccgcggggagcggctgctgctgcacattggcatcatcgacatcctgcagtcctacaggttcatcaagaaactggagcacacctggaaggccctcgtccacgatggggacacggtgtccgtccaccgccccagcttctatgccgagcgctttttcaagttcatgagcaacacggtctttcggaagaactcctccctgaagtcctcgccctccaagaaggggcgcggcggagccttgctagctgtgaaaccgctggggcccaccgctgccttctcggccagccagatccctagcgagcgggaggaggcccagtacgacctgcggggggcccgcagctaccccacgctggaggacgaaggccggcccgacctcctgccctgcacgccaccttctttcgaagaagccactacagcctccattgccacgactctgtcatccacatccctctccattcctgagcggtccccctcggagacgtcggagcagccgcggtacaggcggcgcacacagtcgtctggacaggatggcaggccgcaggaggagccacccgcggaagaggatctgcagcagattacagtgcaggtggagcctgcgtgcagcgtggagattgtggtccccaaagaggaggacgcaggggtggaggcttccccggccggtgcctctgctgctgttgaagtagaaactgccagccaggcctcagacgaggagggcgcacctgccagccaggcctcggacgaggaggacgcgcccgccaccgacatctactttttcacggatgggaggtactggatttactctccccgccatcgccgactgcgggccgtgacgctgagcgcctcggggactgtaagtgaccgcagccggccaccctggggagaaggggcagtgcccctcgggcagcagggagccgcaggtccccggccggaagctcagtgtctgacgtcagttgttttccagaagggctttgggtaaatcacggctgcaattgaggtcagccacgctggccccggaccaggcgctgggctgcatgcgtcactgggaatgtcattcggtcccacgtcgaaccgggcgctccatagggcagcaccatcaccaggtgcacagctgaggcccagggtctgcttcggaccccggccagaccccagcgagcccctctctgcccctggacccagccctctcgtgtcagggtgtcttgggtggacgcttctcactcgtgcagacctggctgcccgtggccccgctggctgcacaggggaggttgcacaggtcagcagagtggctgcagggccgggctctgaaccgcagggccatggagacggggaggagatggtctctccacacccacctcacagatggaggcgctgaggcctcggctcccctgggagcctgggagaccacacggtttagtcaaaatccagatccccaagctctcaaggaggtccccctgggacgccacatgggccccacgtagctgtgagatcctcagggcctgctgttgtcattatgaccaataagcaaggggcccagagagcctaagagacctgcccagcaccgcacagccagaacggggcgcagacccaaagcaggagtgtcccctcgagacaaagcctccgccgaggccgccgtgactccccgcccatcagcaaacctctccgagcacctctgtgtgccaggcactgtggagtgaccccaagaggtggagaccacttccccggctgctctaggcagctccgtcccacggagccagcgggaagccagccaccgcgaagccgtgccccgga

SEQ ID NO: 15674 - DNA, 3326 bp, Homo sapiens
  ENST00000537021
atggagctggaggtaccggacgaggcggagagcgctgaggcgggggccgtgccctcggaggcggcgtgggcggcagagagcggggcggcggcaggtttggctcagaagaaggcggccccaacagaggttctgtccatgacggcacagccgggccctggccatgggaagaagttgggccatcgaggtgtggacgcatccggcgaaaccacctacaagaagaccacctcctccaccctgaagggtgccatccagctgggcatcggctacaccgtgggccacctgagctccaagcccgaacgcgacgtgctcatgcaggacttctacgtggtggagagcatcttcttccccagcgaaggcagcaacctcacccccgcccaccacttccaggacttccgcttcaagacctatgcacctgtcgccttccgctacttccgggagctctttgggatccggccagatgattacttgtactccctgtgcaatgagccgctgatcgagctgtccaacccgggcgccagtggctccctcttctacgtcaccagcgacgacgagttcatcatcaagaccgtcatgcacaaggaggccgagttcctgcagaagctgctccctggctactacatgaacctcaaccagaacccgcggacgctgctgcccaagttctatgggctgtactgcgtgcagtcggggggcaagaacatccgcgtcgtggtcatgaacaacatcctgccccgcgtggtcaagatgcacctcaagttcgacctcaagggctccacctacaagcggcgcgccagcaagaaggagaaggagaagagcttccccacctacaaggacctggacttcatgcaggacatgcccgaggggctcctgctggacgccgacaccttcagcgccctggtcaagacgctgcagcgggactgcctggtcctggaaagtttcaagatcatggactacagcctgctgctgggcgtgcacaacatcgaccagcacgagcgcgagcggcaggcgcagggcgcccagagcacctcagatgagaagcggcctgtgggccagaaggcgctctactccacggccatggagtccatccagggtggcgccgcgcgcggggaggccatcgaatcggatgacacgatgggcgggatccccgctgtgaacggccgcggggagcggctgctgctgcacattggcatcatcgacatcctgcagtcctacaggttcatcaagaaactggagcacacctggaaggccctcgtccacgatggggacacggtgtccgtccaccgccccagcttctatgccgagcgctttttcaagttcatgagcaacacggtctttcggaagaactcctccctgaagtcctcgccctccaagaaggggcgcggcggagccttgctagctgtgaaaccgctggggcccaccgctgccttctcggccagccagatccctagcgagcgggaggaggcccagtacgacctgcggggggcccgcagctaccccacgctggaggacgaaggccggcccgacctcctgccctgcacgccaccttctttcgaagaagccactacagcctccattgccacgactctgtcatccacatccctctccattcctgagcggtccccctcggagacgtcggagcagccgcggtacaggcggcgcacacagtcgtctggacaggatggcaggccgcaggaggagccacccgcggaagaggatctgcagcagattacagtgcaggtggagcctgcgtgcagcgtggagattgtggtccccaaagaggaggacgcaggggtggaggcttccccggccggtgcctctgctgctgttgaagtagaaactgccagccaggcctcagacgaggagggcgcacctgccagccaggcctcggacgaggaggacgcgcccgccaccgacatctacttttggcgcctctggggtccccatgcacccacctggccctggagaagggagggacgggccgcgtgcctgtgcccctacccaccgcacgtcgtcaccccttttcctgggactggtttgtgcgcgtcctggtctccggatggtacggggggcctgggggccatgtcgtgctgtgtgtctgtgtcctgatgccctgccaggtgggcagcagagaagggagaagggtcctcggtcctgcccctgccccggcaccccccaccttctgcttggcagtcagctgtccccacctgctccccgccacctccctccgcctctcccacccgaccacgggggtggccgcctcatccgctgtcctctgttttccttcctcctccggcccacccggcccgccccgtccagttcacggatgggaggtactggatttactctccccgccatcgccgactgcgggccgtgacgctgagcgcctcggggactgtaagtgaccgcagccggccaccctggggagaaggggcagtgcccctcgggcagcagggagccgcaggtccccggccggaagctcagtgtctgacgtcagttgttttccagaagggctttgggtaaatcacggctgcaattgaggtcagccacgctggccccggaccaggcgctgggctgcatgcgtcactgggaatgtcattcggtcccacgtcgaaccgggcgctccatagggcagcaccatcaccaggtgcacagctgaggcccagggtctgcttcggaccccggccagaccccagcgagcccctctctgcccctggacccagccctctcgtgtcagggtgtcttgggtggacgcttctcactcgtgcagacctggctgcccgtggccccgctggctgcacaggggaggttgcacaggtcagcagagtggctgcagggccgggctctgaaccgcagggccatggagacggggaggagatggtctctccacacccacctcacagatggaggcgctgaggcctcggctcccctgggagcctgggagaccacacggtttagtcaaaatccagatccccaagctctcaaggaggtccccctgggacgccacatgggccccacgtagctgtgagatcctcagggcctgctgttgtcattatgaccaataagcaaggggcccagagagcctaagagacctgcccagcaccgcacagccagaacggggcgcagacccaaagcaggagtgtcccctcgagacaaagcctccgccgaggccgccgtgactccccgcccatcagcaaacctctccgagcacctctgtgtgccaggcactgtggagtgaccccaagaggtggagaccacttccccggctgctctaggcagctccgtcccacggagccagcgggaagccagccaccgcgaagccgtgccccgga

SEQ ID NO: 15675 - DNA, 456 bp, Homo sapiens
  ENST00000592530
aggggacgtgtgggcacggtgccgggtgacagttaactcccgcgctgggcaggggacgtgtgggcacggtgccgggatgggcgggatccccgctgtgaacggccgcggggagcggctgctgctgcacattggcatcatcgacatcctgcagtcctacaggttcatcaagaaactggagcacacctggaaggccctcgtccacgatggggacacggtgtccgtccaccgccccagcttctatgccgagcgctttttcaagttcatgagcaacacggtctttcggaagaactcctccctgaagtcctcgccctccaagaaggggcgcggcggagccttgctagctgtgaaaccgctggggcccaccgctgccttctcggccagccagatccctagcgagcgggaggaggcccagtacgacctgcggggggcccgcagctaccccacgctggaggacga

SEQ ID NO: 15676 - DNA, 1311 bp, Homo sapiens
  ENST00000587482
gtcgcagctcgggtccccctcgggcgcccccgccgccgtccgcgcgcggccatggagctggaggtaccggacgaggcggagagcgctgaggcgggggccgtgccctcggaggcggcgtgggcggcagagagcggggcggcggcaggtttggctcagaagaaggcggccccaacagaggttctgtccatgacggcacagccgggccctggccatgggaagaagttgggccatcgaggtgtggacgcatccggcgaaaccacctacaagaagaccacctcctccaccctgaagggtgccatccagctgggcatcggctacaccgtgggccacctgagctccaagcccgaacgcgacgtgctcatgcaggacttctacgtggtggagagcatcttcttccccagcgaaggcagcaacctcacccccgcccaccacttccaggacttccgcttcaagacctatgcacctgtcgccttccgctacttccgggagctctttgggatccggccagatgattacttgtactccctgtgcaatgagccgctgatcgagctgtccaacccgggcgccagtggctccctcttctacgtcaccagcgacgacgagttcatcatcaagaccgtcatgcacaaggaggccgagttcctgcagaagctgctccctggctactacatgaacctcaaccagaacccgcggacgctgctgcccaagttctatgggctgtactgcgtgcagtcggggggcaagaacatccgcgtcgtggtcatgaacaacatcctgccccgcgtggtcaagatgcacctcaagttcgacctcaagggctccacctacaagcggcgcgccagcaagaaggagaaggagaagagcttccccacctacaaggacctggacttcatgcaggacatgcccgaggggctcctgctggacgccgacaccttcagcgccctggtcaagacgctgcagcgggactgcctggtcctggaaagtttcaagatcatggactacagcctgctgctgggcgtgcacaacatcgaccagcacgagcgcgagcggcaggcgcagggcgcccagagcacctcagatgagaagcggcctgtgggccagaaggcgctctactccacggccatggagtccatccagggtggcgccgcgcgcggggaggccatcgaatcggatgacacggtcttcgctggcctggcgggggagcaggtgagcgtaccagcctgtggcgtgagcagagcgtgcagggcgccagcccagcgggtctgggtcccagtggcttcaggatgactgctgcacgtgtggcctcactaa

SEQ ID NO: 15677 - DNA, 153 bp, Homo sapiens
  ENST00000636612
agaagaaggcggccccaacagaggttctgtccatgacggcacagccgggccctggccatgggaagaagttgggccatcgagaccacctcctccaccctgaagggtgccatccagctgggcatcggctacaccgtgggccacctgagctccaag

SEQ ID NO: 15678 - DNA, 435 bp, Homo sapiens
  ENST00000637724
gcttgttgttcggcggcggcggtcgcagctcgggtccccctcgggcgcccccgccgccgtccgcgcgcggccatggagctggaggtaccggacgaggcggagagcgctgaggcgggggccgtgccctcggaggcggcgtgggcggcagagagcggggcggcggcagttctgacccggcagcagagcaaagctatgggctgctccaccaagtcgcattcagttgccttcagtgcccgcggtggacgtgttttcagacggcagggcggtcaccggggtgcagcctctggatgggacacacgtgggtctcccgtgcacccaccgagagcagcacagtgcccatgggggccgaggggcgctggcagggctgatagggtggggcatcgccgacccaggcccagccacagcgcagcctcttccagtctctgtctgactcac

SEQ ID NO: 15679 - DNA, 1772 bp, Homo sapiens
  ENST00000580241
ttgccacttccttgtatggacagtgggggactccaaagacccgctcgggagaggcccaaagcccggtacccggacgtgctgggggaagcacaaaggggccaacaagaagggggtggggaggcctgccggtgcaacgagatggagtgggctggcgcctcgggagagcgaatcgagggcggcggggcccagctgtgctgctgtgttaacctggaggcattatggaacagagctggaatcttgctccattgcccaggctggagtacaatggtgtgattatagctcactgcagcctcaaactcctgggctcaagtgaccctcctgcctcagcctcccaattctttctaccacactcccgaggaagctcccatggacaaagccggataatccgaaaggcgtacctggaagacttttacacccggatgatgcatgagtgctatcagatatgggcccagctggagcacgaggctggaacccaattgcacaggcagactggattactgctgctgggaatgaaagagaatcaagaattaaagacaatccaggccaatctgtcgaggcagagggtagaacaccagtgtctttcatctgaggaactgaagcaacgtttcccaaatattcggttgcccaggggagaagtggggctcttggacaattccggaggagttatctatgcatataaggccctcagagccctgcaggatgcaattcgacagctaggaggcatagtgcgtgacggagagaaggtggtggagataaacccagggctactggtcacggtgaaaaccacctccaggagctaccaagctaagagcttggtcatcacagcaggtccttggaccaaccagctcctccgtcccctgggcattgagatgcctctccagaccctgcggatcaacgtgtgttactggcgagagatggttcctgggagctatggtgtgtcccaggcctttccgtgcttcctgtggctgggcttgtgtccccaccacatctacggactgcccacaggagagtacccagggctgatgaaggtcagctatcaccacggcaaccacgcagaccctgaggagcgggactgccccacagcacgcacagacatcggagacgtccagatcctgagcagctttgtcagagatcacttacctgatctgaagcccgagcctgctgtcattgagagctgcatgtacacgaatacccctgatgagcagttcattctcgatcgccacccaaagtatgacaacattgtcattggtgctggattctctgggcacgggttcaagctggcccctgtggtggggaagatcctgtatgaattaagcatgaaattaacaccatcttatgacttggcaccttttcgaatcagccgtttcccaagcctgggcaaagcccacctttgacctctggccagaagcctcccttctgtgcacaggagccagtttcacagatggagaagatgtctcagatgaagggagtgtccctgagatatcatccttttcttctgcctcgcctgaatcccccataaacaccagatgattgagtctaccttctttccttggcccgctccctttttcttctgcctcacttgaatcccccgtaaacaccagacgattgagtctaccttcttttcttggccacctccccattcacaactactttctcgctcccagaaggttgatcagatattctacaatcacagagtagcaaggacgtttgagatgggtatatcagtaagaagagggcacaagaactggctctggagaccaaagcagttgtta

SEQ ID NO: 15680 - DNA, 580 bp, Homo sapiens
  ENST00000580383
agggggtggggaggcctgccggtgcaacgagatggagtgggctggcgcctcgggagagcgaatcgagggcggcggagctggaatcttgctccattgcccaggctggagtacaatggtgtgattatagctcactgcagcctcaaactcctgggctcaagtgaccctcctgcctcagcctcccaattctttctaccacactcccgaggaagctcccatggacaaagccggataatccgaaaggcgtacctggaagacttttacacccggatgatgcatgagtgctatcagatatgggcccagctggagcacgaggctggaacccaattgcacaggcagactggattactgctgctgggaatgaaagagaatcaagaattaaagacaatccaggccaatctgtcgaggcagagggtagaacaccagtgtctttcatctgaggaactgaagcaacgtttcccaaatattcggttgcccaggggagaagtggggctcttggacaattccggaggagttatctatgcatataaggccctcagagccctgcaggatgcaattcgacagctaggaggcatagtgcgtg

SEQ ID NO: 15681 - DNA, 1829 bp, Homo sapiens
  ENST00000583215
gcaacgagatggagtgggctggcgcctcgggagagcgaatcgagggcggcggggcccagctgtgctgctgtgttaacctggaggcattatggaacaggaggccctgagtacctgcggtggggtgaggccagagtgagctccagctcagatgatcagggagaaggctgcaccagtctcattggattcttcacaccagctggtgctgaaggttcaggggttgaagttgaaagaagcccgtggggtcctccataaaggactcaaggtgctggccttccaacagcctgagctggaatcttgctccattgcccaggctggagtacaatggtgtgattatagctcactgcagcctcaaactcctgggctcaagtgaccctcctgcctcagcctcccaattctttctaccacactcccgaggaagctcccatggacaaagccggataatccgaaaggcgtacctggaagacttttacacccggatgatgcatgagtgctatcagatatgggcccagctggagcacgaggctggaacccaattgcacaggcagactggattactgctgctgggaatgaaagagaatcaagaattaaagacaatccaggccaatctgtcgaggcagagggtagaacaccagtgtctttcatctgaggaactgaagcaacgtttcccaaatattcggttgcccaggggagaagtggggctcttggacaattccggaggagttatctatgcatataaggccctcagagccctgcaggatgcaattcgacagctaggaggcatagtgcgtgacggagagaaggtggtggagataaacccagggctactggtcacggtgaaaaccacctccaggagctaccaagctaagagcttggtcatcacagcaggtccttggaccaaccagctcctccgtcccctgggcattgagatgcctctccagaccctgcggatcaacgtgtgttactggcgagagatggttcctgggagctatggtgtgtcccaggcctttccgtgcttcctgtggctgggcttgtgtccccaccacatctacggactgcccacaggagagtacccagggctgatgaaggtcagctatcaccacggcaaccacgcagaccctgaggagcgggactgccccacagcacgcacagacatcggagacgtccagatcctgagcagctttgtcagagatcacttacctgatctgaagcccgagcctgctgtcattgagagctgcatgtacacgaatacccctgatgagcagttcattctcgatcgccacccaaagtatgacaacattgtcattggtgctggattctctgggcacgggttcaagctggcccctgtggtggggaagatcctgtatgaattaagcatgaaattaacaccatcttatgacttggcaccttttcgaatcagccgtttcccaagcctgggcaaagcccacctttgacctctggccagaagcctcccttctgtgcacaggagccagtttcacagatggagaagatgtctcagatgaagggagtgtccctgagatatcatccttttcttctgcctcgcctgaatcccccataaacaccagatgattgagtctaccttctttccttggcccgctccctttttcttctgcctcacttgaatcccccgtaaacaccagacgattgagtctaccttcttttcttggccacctccccattcacaactactttctcgctcccagaaggttgatcagatattctacaatcacagagtagcaaggacgtttgagatgggtatatcagtaagaagagggcacaagaactggctctggagaccaaagcagttgtta

SEQ ID NO: 15682 - DNA, 790 bp, Homo sapiens
  ENST00000578748
caggccctcacaagaaagctgctcctttcgccattttggtaatgggatatgggctatcatgcccttggagtcctcaggcatgaacagaaaggagcaaggtgtggtgttggatggagctggtcgcctgtcggtgacagcagtattcctagggatgttgtacttgaccgtttggttctaccatcgggtgtggctggaccaggccaccatattggtaaagagaaaagccatttgagacagaaaatgacgcttttggaggcgtgtgggatgactgtggttcctaattctctcccgctcctgacagataattttatcagttaattgtatcctcagcatccctgccttgcgtggtggtggcactggagagttccgcctgcccgttaccaccctctcttcaccactgtccctgagatctgctcttcaagaggaagcctaaagtggagagtttgtaatcctgacaacgcccagctacctgcgtaccccggactccaactcccagtttgcaacgccaaagggtctaaagggcgaacgggggcgcattgcatcctgggagcaagaatcgcgataggtctgatggattgtgggaactgtagttccatggcccagctgtgctgctgtgttaacctggaggcattatggaacagttctttctaccacactcccgaggaagctcccatggacaaagccggataatccgaaaggcgtacctggaagacttttacacccggatgatgcatgagtgctatcagatatgggcccagctggagcacgaggctggaacccaattgcacag

SEQ ID NO: 15683 - DNA, 633 bp, Homo sapiens
  ENST00000577182
gggaactgtagttccatgtgcgtgcgatgcactctatgggcccagctgtgctgctgtgttaacctggaggcattatggaacaggaggccctgagtacctgcggtggggtgaggccagagtgagctccagctcagatgatcagggagaaggctgcaccagtctcattggattcttcacaccagctggtgctgaaggttcaggggttgaagttgaaagaagcccgtggggtcctccataaaggactcaaggtgctggccttccaacagcctgttctttctaccacactcccgaggaagctcccatggacaaagccggataatccgaaaggcgtacctggaagacttttacacccggatgatgcatgagtgctatcagatatgggcccagctggagcacgaggctggaacccaattgcacaggcagactggattactgctgctgggaatgaaagagaatcaagaattaaagacaatccaggccaatctgtcgaggcagagggtagaacaccagtgtctttcatctgaggaactgaagcaacgtttcccaaatattcggttgcccaggggagaagtggggctcttggacaattccggaggagttatctatgcatataaggccctcagagccctgcag

SEQ ID NO: 15684 - DNA, 2414 bp, Homo sapiens
  ENST00000323372
gagacaggaaggtggcaaaggaaggagcccatttgcatgacaataattgagccaagaatagaaagccacagggatgcaagggtgaggctggcggctgagctgggctaaacctcacaaatcagactacccagctctgctccgcaggggaagggagactgagccctgggccaggcttggcagagagggaagcgggaggacacgaccccagggcattgtgggaacactggccaggctggactttgccttcctcctcgtcctttagccgggagcctgtctttgcttgcctttgcctttgaggctctgtggctgtggggctgagtggcatcatggcggctcagaaagatctctgggacgccattgtgattggggcggggatccagggctgcttcactgcataccacctggccaaacacaggaagaggatcctcctgctggagcagttctttctaccacactcccgaggaagctcccatggacaaagccggataatccgaaaggcgtacctggaagacttttacacccggatgatgcatgagtgctatcagatatgggcccagctggagcacgaggctggaacccaattgcacaggcagactggattactgctgctgggaatgaaagagaatcaagaattaaagacaatccaggccaatctgtcgaggcagagggtagaacaccagtgtctttcatctgaggaactgaagcaacgtttcccaaatattcggttgcccaggggagaagtggggctcttggacaattccggaggagttatctatgcatataaggccctcagagccctgcaggatgcaattcgacagctaggaggcatagtgcgtgacggagagaaggtggtggagataaacccagggctactggtcacggtgaaaaccacctccaggagctaccaagctaagagcttggtcatcacagcaggtccttggaccaaccagctcctccgtcccctgggcattgagatgcctctccagaccctgcggatcaacgtgtgttactggcgagagatggttcctgggagctatggtgtgtcccaggcctttccgtgcttcctgtggctgggcttgtgtccccaccacatctacggactgcccacaggagagtacccagggctgatgaaggtcagctatcaccacggcaaccacgcagaccctgaggagcgggactgccccacagcacgcacagacatcggagacgtccagatcctgagcagctttgtcagagatcacttacctgatctgaagcccgagcctgctgtcattgagagctgcatgtacacgaatacccctgatgagcagttcattctcgatcgccacccaaagtatgacaacattgtcattggtgctggattctctgggcacgggttcaagctggcccctgtggtggggaagatcctgtatgaattaagcatgaaattaacaccatcttatgacttggcaccttttcgaatcagccgtttcccaagcctgggcaaagcccacctttgacctctggccagaagcctcccttctgtgcacaggagccagtttcacagatggagaagatgtctcagatgaagggagtgtccctgagatatcatccttttcttctgcctcgcctgaatcccccataaacaccagatgattgagtctaccttctttccttggcccgctccctttttcttctgcctcacttgaatcccccgtaaacaccagacgattgagtctaccttcttttcttggccacctccccattcacaactactttctcgctcccagaaggttgatcagatattctacaatcacagagtagcaaggacgtttgagatgggtatatcagtaagaagagggcacaagaactggctctggagaccaaagcagttgttaaaaattctctttgctgggggccgggtgtggtggctcacacctgtaatctcggcactttggggggctgagacaggcggatcacctgaggccaggaattcaagaccagcctggccaacatggtgaaaccctatctccactaaaaatacaaaattagctgggtgtggtggcgcatgcctgtaatcccagctacttgggagactgaggcaagagaatcacttgaacccgggaggtggaggtggcagtgagccgagattgcgccattgcactccagcctgggcaaaaagagtgagactctgtctcaaaaaaaaaacaaaacaaaaaaaacctctttgctggtatatttgaagagcttgggatggatttgactaaatctgccccgaggagggtgaacaaggtgatctcagagatcactactgctcttggagttccttctcctaaagctaaggccagcctccatcacaaatgcccataaaatctggctcgtctttgatgaacaataaatatttgttgaacaaataaataactgccctgcattaa

SEQ ID NO: 15685 - DNA, 720 bp, Homo sapiens
  ENST00000466889
gtcagcatcagtttccttgttcataaaatgaaggggctggagtagttgaactggaaggttttttctaattttgcttctttgtgaatctaagtgaggtgagattgcagcaggatggttgaagactagctaacaaaagaacttctggatgtgaacaacgttagcaaaaaggaagcctaattctttctaccacactcccgaggaagctcccatggacaaagccggataatccgaaaggcgtacctggaagacttttacacccggatgatgcatgagtgctatcagatatgggcccagctggagcacgaggctggaacccaattgcacaggcagactggattactgctgctgggaatgaaagagaatcaagaattaaagacaatccaggccaatctgtcgaggcagagggtagaacaccagtgtctttcatctgaggaactgaagcaacgtttcccaaatattcggttgcccaggggagaagtggggctcttggacaattccggaggagttatctatgcatataaggccctcagagccctgcaggatgcaattcgacagctaggaggcatagtgcgtgacggagagaaggtggtggagataaacccagggctactggtcacggtgaaaaccacctccaggagctaccaagctaagagcttggtcatcacagcaggtccttggaccaaccagctcctccgtcccctgggcattgagatgcctctc

SEQ ID NO: 15686 - DNA, 760 bp, Homo sapiens
  ENST00000469082
gggctggagtagttgaactggaaggttttttctaattttgcttctttgtgaatctaagtgagttctttctaccacactcccgaggaagctcccatggacaaagccggataatccgaaaggcgtacctggaagacttttacacccggatgatgcatgagtgctatcagatatgggcccagctggagcacgaggctggaacccaattgcacaggcagactggattactgctgctgggaatgaaagagaatcaagaattaaagacaatccaggccaatctgtcgaggcagagggtagaacaccagtgtctttcatctgaggaactgaagcaacgtttcccaaatattcggttgcccaggggagaagtggggctcttggacaattccggaggagttatctatgcatataaggccctcagagccctgcaggatgcaattcgacagctaggaggcatagtgcgtgacggagagaaggtggtggagataaacccagggctactggtcacggtgaaaaccacctccaggagctaccaagctaagagcttggtcatcacagcaggtccttggaccaaccagctcctccgtcccctgggcattgagatgcctctccagaccctgcggatcaacgtgtgttactggcgagagatggttcctgggagctatggtgtgtcccaggcctttccgtgcttcctgtggctgggcttgtgtccccaccacatctacggactgcccacaggagagtacccagggctgatgaaggtcag

SEQ ID NO: 15687 - DNA, 1038 bp, Homo sapiens
  ENST00000484308
cagatgggtgcaacaaccacagataccaaggggagtggcagcaggaaagagggagagggatccttgggtaggagactctcagaagcgcacaatcctcctctttgccaggaggacaggaatttggacgggctttggaactggacctggctctaaatctcagctctgacacgctcagctgtgtggtttggaacgagctgttgaacctctggcagactggattactgctgctgggaatgaaagagaatcaagaattaaagacaatccaggccaatctgtcgaggcagagggtagaacaccagtgtctttcatctgaggaactgaagcaacgtttcccaaatattcggttgcccaggggagaagtggggctcttggacaattccggaggagttatctatgcatataaggccctcagagccctgcaggatgcaattcgacagctaggaggcatagtgcgtgacggagagaaggtggtggagataaacccagggctactggtcacggtgaaaaccacctccaggagctaccaagctaagagcttggtcatcacagcaggtccttggaccaaccagctcctccgtcccctgggcattgagatgcctctccagaccctgcggatcaacgtgtgttactggcgagagatggttcctgggagctatggtgtgtcccaggcctttccgtgcttcctgtggctgggcttgtgtccccaccacatctacggactgcccacaggagagtacccagggctgatgaaggtcagctatcaccacggcaaccacgcagaccctgaggagcgggactgccccacagcacgcacagacatcggagacgtccagatcctgagcagctttgtcagagatcacttacctgatctgaagcccgagcctgctgtcattgagagctgcatgtacacgaatacccctgatgagcagttcattctcgatcgccacccaaagtatgacaacattgtcattggtgctggattctctgggcacgggttcaagctggcccctgtggtggggaagatcctgtatgaattaa

SEQ ID NO: 15688 - DNA, 518 bp, Homo sapiens
  ENST00000419875
ggaaccatcagttgttcaacaggcacgttacagaggaggaatctgggcccagagaggcagactggattactgctgctgggaatgaaagagaatcaagaattaaagacaatccaggccaatctgtcgaggcagagggtagaacaccagtgtctttcatctgaggaactgaagcaacgtttcccaaatattcggttgcccaggggagaagtggggctcttggacaattccggaggagttatctatgcatataaggccctcagagccctgcaggatgcaattcgacagctaggaggcatagtgcgtgacggagagaaggtggtggagataaacccagggctactggtcacggtgaaaaccacctccaggagctaccaagctaagagcttggtcatcacagcaggtccttggaccaaccagctcctccgtcccctgggcattgagatgcctctccaggtaagaggagctggaagcccgagagttggtgctcaagagaagccttggaaccagatggagtcaaa

SEQ ID NO: 15689 - DNA, 6945 bp, Homo sapiens
  ENST00000421306
gcccgggaagcgcgaggagcgcgcgtagcgccgccggagcccgccgcccgggacatggccaaggcgggccgtgcaggtggtcctcccccgggcggcggtgccccctggcaccttcgaaatgtcctcagtgactctgtggagagctcagatgatgaattctttgatgccagaggagaagggaccgcgccgtgcacatccagcatcctccaggagaagcagcgagaactgtaccgggtttccttgagaagacagaggttcccagcccagggaagcatcgagatccacgaagacagcgaggaaggctgcccgcagcgctcctgcaagacacatgtcctcctgctggtcctgcatgggggaaacatcctggacacgggtgccggggacccgtcctgcaaggcagccgacatccacaccttcagctccgtgctggagaaggtcacacgagcccatttccctgctgccctgggccacatcctcatcaagttcgtcccctgtcctgccatctgctctgaggctttctcgcttgtctctcacctgaacccctacagccacgatgagggctgcctcagcagcagccaggaccacgtccctctggccgcccttcccctgttggccatctcctccccgcagtaccaggatgctgtcgccaccgtcatcgagcgagccaaccaggtctacagagagttcctgaagtcctctgatgggattggcttcagtgggcaggtgtgtctcatcggggactgtgtggggggcctcctggccttcgatgccatctgctacagtgcggggccctcaggggacagccctgccagcagcagccggaaggggagcatcagcagcacccaggacaccccagtcgcggtggaggaagattgcagcctggccagcagcaagcgtctcagcaaaagcaacattgacatctccagtgggttggaggatgaggagcccaagaggccgttgccgcggaaacagagcgactcctccacctatgactgcgaggccatcacccagcaccatgccttcctctcaagcatccactccagcgtgctaaaggatgagtctgagaccccggcggctggggggccgcagctccctgaggtcagcctgggccgctttgacttcgatgtgtccgacttcttcctcttcggctcgccactgggcctggtcctggccatgcggaggacggtgctgcctgggctggacggcttccaggtgcgtcctgcctgcagccaggtctacagcttcttccattgcgcagacccctctgcctcacggctcgagccactgctggagcccaagttccacctggtgccgcctgtcagcgtgcctcgctaccagaggttcccactgggcgatgggcagtccctcctcctcgctgatgccctacacacccacagccccctcttcctggagggcagctcccgggacagcccgccacttctggatgcccctgcctcgccccctcaggcctcgaggttccagcgcccaggacggaggatgagcgaggggagctcccacagcgagagctcggagtcctcggacagcatggcacccgtgggtgcctcccgcatcacagccaagtggtggggaagcaagaggatcgactatgccctgtactgccctgatgtcctcacggccttccccaccgtggccctgccccacctcttccacgccagttactgggagtccacagacgtggtggccttcatcctgagacaggtaatgcgctatgagagcgtgaacatcaaggaaagcgcccgcctggaccctgcagcactgagtcctgccaacccccgggagaagtggcttcgtaagcggactcaggtcaagctgaggaatgtcacggctaatcaccgggccaatgatgtgattgctgctgaagatggcccccaggtcctggtggggcggttcatgtacgggcccctcgacatggtggctctgactggagagaaggtggacatcctagtaatggcagagccatcctcaggccgctgggtacacctggacacagagatcaccaacagcagtggtcgcatcacatacaatgtgccgcggccccggcgcctgggggttggtgtctatcctgtgaagatggtcgtcaggggcgaccagacctgtgccatgagctacctcacggtgttgcccaggggcatggagtgtgtagtgttcagcattgatgggtccttcgcggccagcgtgtctatcatgggaagcgaccccaaggtccggccgggtgcagtggatgttgtccggcactggcaggacttgggctacatgatcctttacatcacgggacggccggacatgcagaagcagcgggtggtgtcgtggctgtcccagcacaacttcccacagggcatgatcttcttctccgatgggctggtgcatgacccgctgcggcagaaggccatcttcctgcgcaacctcatgcaggagtgcttcatcaaaatcagtgcggcctatggctccacgaaggacatctctgtctacagcgtgctgggcctgcctgcctcccagatcttcattgtgggccggcccaccaagaagtaccaaacccagtgccagttcctgagcgagggctacgccgcacacctggccgcgctggaggccagccaccgctcacgcccaaagaagaacaactcgcgcatgatcctgcgcaagggcagcttcgggctgcacgcgcagccagagttcctgcggaagcgcaaccacctgcgcagaaccatgtcagtgcagcagcccgacccgcccgccgccaaccccaagcccgagcgggcccagagccagcccgagtcggacaaagaccacgagcggccgctgccggcgctcagctgggcgcgtgggccccccaagttcgagtcggtgccctgaggggtgggctgtgctcagagcagggagcggggggcccaatcaggctgcctgcggggacgggagggggctgccctctccccgacacaggcgttttcctgctttttccctcccgtgtctgtccagcagtgtccgaccagagcggggagggatcctgcccgagcccggggggctccctgagctgcgacggggtgaggtccggggatctcggtgcagccactgctgcctcccacgggcctgcgaccgcaagcccaagtcagggttcatgtttgtgtcatcctgggggcaggcttgcccggggctgaagcgtttgggcaaagtcgaccaccctcctgcgtccccaggcttcacagcgagctaggcaggccctcaagggggcagccccagcctcggcaccaagcgccgctggcaggcacagcctctgggctgtcttgtggaggtgtgagtggcatttgtgcccgcccttcctgtggtttgggtcaccattttggggttggcgctcttatggcaagatggccactttctgggagtgagagcacatccccgggctcatgttacgccgtctctgtccacagccctcgggggtggggtctggtgctgacggtctgtcctgcagctgtccattgtccccaacccccgttgtcctcagtgtcctcaccatttccctgtggccctggaggccagggcttcctcttcccggagccctgcctcatgccctcccttgggaggctgcagccttgggctctggctcagctgggctggctgtgagcccctgagctggttgcttgccctctctgggctccgtcttccttctgttattggaggggtccccctagctgagattggtgtgagtctttgactcccaagatgtcctgcagtttggcccattgaggctcttcaggcctaagggtccctccgagtgtcctgtgacccacacctttcacacagcctgggagagggggtctgggtgggctggaaaggaggggctcttaaaggagcctctctgggtgggctgggaagggatccctactccacggagaggtgcagctggtttgccttgcactgcgtgtcccagggacaacccactcaaactgggtgtcctagggacaacccacctccctctcctgccaaaaggttactgattgggctccccataaccccagctctgccaggacccttttatcctttttggctcccagaggcatagagctgagattccagggttctaggggttcctggaagtttggctccaactgttgtattctcttccctttcccctgctgctcagtttgtgcccataacctcctcctgggtagtcccctgaggttggcaggacttggcccttctggggcccctaaagcctgctcaggccctcctgctgctgaaccttggcctgggcactgctttcctgcatcctggaaaaccccgactccctggcccaggcccacacctgctgtgtggggctgcccacgtggccactgagcccccataggctgccatcaaggccggtcccagcaatttcagccaggctgccccagggcccagacgtctgtatacacagcaggcacctgtgtcagctcagtgtcgcttctgctcaatgtctacctctcgcggctcccatgcagccagtgacgctgctggtgggggcggctggcaccgccgttgtgaattgcctggcaaattgggtgccctcctggggctggaggggtctgggctcctaacccccatccctgctctccccactagaaatgtgtcttcagtctgccagctcttctgctctacttccagtgctgcatcctgcactcaagcccagggctgctggcgagtctatggggaggagtgcggatcaggctcagcctcagcctcagcctcagcctcctctatggtcctgtctcctggcggttcacaggtgcccatcccccctttaacatttcacagttcttggctttccaaaggcaccagctcatatggcatagccaccccaaccctaatccttcccccaaatatcctgatttaaacttgggcagacttagtctgattcttgaaaactctaccatctccttcttgcagaaggcactggttacactaaaatgataaaataattagtatggggtactttgctcccagttacattccctcttccctgagaaccccaggctaggcgagagagggagagggagagagaaagagagagagggagagagagagagagagagggagagagaaagagagagagaaagaaaggaagacagaggaaagaaaggaagacagagagaggaaggcagagagagagagggagaaagaaagacaggaaggcagagagagagagagagagagaaaggaagacagagagagagagagaggaagagagagagagagaggaagagagagagagagctcatgagccaggatccctggggaatttgaagtcagtgtgaccagggttctgtggctctggggtcagagctgggacacaggacccagcaggagggccaccaccccttccttttggaaacagctctggttccaagcagcaatcaggtaggaggatcggggctttggctgatgatgcacacacaagatgctgatggtgtacggtgagatattgtgaacgcaacaactggagctgtagttggcgtgtgtgagtgtgtacctgcggttctgtttagtggcgagacaaggtatgtttcagtactgctttcacggcaactgtgtaatgcatatgctctttctacactagcggtttgctcagttttgtctgtccggttaagttggagaaagaaccaagttgtgttgttctctggagggggtgctgctgcctctccttgagtagttctgtgacccccaatccagctgttttgtagagaatccttctagcttctggtatgcctgctctccagcagctggaaacagatcttcctgcctgaccaaagctccttgtttcttgcgtggcatgtttgttcttcccgatccggtggctgtcgtagccgagggcctgcctgccaccttcctttatcatttgccctgttggggttcagggtgcatccttagcccaggacctgctcttccagcatcatgggttttttcctaaagatctcaacggctcccttgggctccataaaatatttcttttttaaaaaagcagactcctttcatgcattgggatgaacggccctcttgtctgggtgctgggctacagcaaacaaatgtgtttgaatcccagtattccagagattcctggcggtgggctgtctagaagaggcgaggctggatctcacggtttttaaactgtatttttacccctttgggacccatacctgtgccctggagtctttcatgaggcacgtgggtcctctgcatcctcactctcccccctagcccaggtgcagccccgggaggggtgccctgaccccgccttaaacaaccaactttcccaccgaatcccatcggcgggcggggggggggggtttgggtgccaagtgccctggaaacctattgtcttttggctcagccaaaagaaacattccctccttcctttccttccgggcttgggggaaaccttcgtaaaaatcatagttagggttaagtccaagcagtgaggcctgacctgggctctgctctccttgttgagacactaacaggcagttgggaggaaaatctgcatttgactccaccctctttggggcaaaggagaaacaggtgacccgagggggggcaggccagaggagggcgactcgtgcacagggacccccacccttggaccccgctgtccttttctagttgtttacttggtggtggcagccagtctgaccttgtctgtggtctgactgttcctaagtgtgtaactttcagtattatctgtgacagatggttctgtggtgaaaaaggtttattatattccttatggctgccttgtacaaaatccgttagaaacgctaatgtaagatatcagatttctaacaagacaaaaacagcattatggagttaaaagatttttacaactgggtcttgattttgatgtgagctggtttttagctctcaaatgttgtcacttaaataaaaaccttctttgccttt

SEQ ID NO: 15690 - DNA, 7086 bp, Homo sapiens
  ENST00000262483
gagtccgttcggggccggaggcggtcggggccgggcccgggaagcgcgaggagcgcgcgtagcgccgccggagcccgccgcccgggacatggccaaggcgggccgtgcaggtggtcctcccccgggcggcggtgccccctggcaccttcgaaatgtcctcagtgactctgtggagagctcagatgatgaattctttgatgccagagaggagatggctgaagggaagaatgccatcctcattgggatgagccagtggaactccaatgacctcgtggagcagatcgagaccatggggaaactggacgagcatcaaggagaagggaccgcgccgtgcacatccagcatcctccaggagaagcagcgagaactgtaccgggtttccttgagaagacagaggttcccagcccagggaagcatcgagatccacgaagacagcgaggaaggctgcccgcagcgctcctgcaagacacatgtcctcctgctggtcctgcatgggggaaacatcctggacacgggtgccggggacccgtcctgcaaggcagccgacatccacaccttcagctccgtgctggagaaggtcacacgagcccatttccctgctgccctgggccacatcctcatcaagttcgtcccctgtcctgccatctgctctgaggctttctcgcttgtctctcacctgaacccctacagccacgatgagggctgcctcagcagcagccaggaccacgtccctctggccgcccttcccctgttggccatctcctccccgcagtaccaggatgctgtcgccaccgtcatcgagcgagccaaccaggtctacagagagttcctgaagtcctctgatgggattggcttcagtgggcaggtgtgtctcatcggggactgtgtggggggcctcctggccttcgatgccatctgctacagtgcggggccctcaggggacagccctgccagcagcagccggaaggggagcatcagcagcacccaggacaccccagtcgcggtggaggaagattgcagcctggccagcagcaagcgtctcagcaaaagcaacattgacatctccagtgggttggaggatgaggagcccaagaggccgttgccgcggaaacagagcgactcctccacctatgactgcgaggccatcacccagcaccatgccttcctctcaagcatccactccagcgtgctaaaggatgagtctgagaccccggcggctggggggccgcagctccctgaggtcagcctgggccgctttgacttcgatgtgtccgacttcttcctcttcggctcgccactgggcctggtcctggccatgcggaggacggtgctgcctgggctggacggcttccaggtgcgtcctgcctgcagccaggtctacagcttcttccattgcgcagacccctctgcctcacggctcgagccactgctggagcccaagttccacctggtgccgcctgtcagcgtgcctcgctaccagaggttcccactgggcgatgggcagtccctcctcctcgctgatgccctacacacccacagccccctcttcctggagggcagctcccgggacagcccgccacttctggatgcccctgcctcgccccctcaggcctcgaggttccagcgcccaggacggaggatgagcgaggggagctcccacagcgagagctcggagtcctcggacagcatggcacccgtgggtgcctcccgcatcacagccaagtggtggggaagcaagaggatcgactatgccctgtactgccctgatgtcctcacggccttccccaccgtggccctgccccacctcttccacgccagttactgggagtccacagacgtggtggccttcatcctgagacaggtaatgcgctatgagagcgtgaacatcaaggaaagcgcccgcctggaccctgcagcactgagtcctgccaacccccgggagaagtggcttcgtaagcggactcaggtcaagctgaggaatgtcacggctaatcaccgggccaatgatgtgattgctgctgaagatggcccccaggtcctggtggggcggttcatgtacgggcccctcgacatggtggctctgactggagagaaggtggacatcctagtaatggcagagccatcctcaggccgctgggtacacctggacacagagatcaccaacagcagtggtcgcatcacatacaatgtgccgcggccccggcgcctgggggttggtgtctatcctgtgaagatggtcgtcaggggcgaccagacctgtgccatgagctacctcacggtgttgcccaggggcatggagtgtgtagtgttcagcattgatgggtccttcgcggccagcgtgtctatcatgggaagcgaccccaaggtccggccgggtgcagtggatgttgtccggcactggcaggacttgggctacatgatcctttacatcacgggacggccggacatgcagaagcagcgggtggtgtcgtggctgtcccagcacaacttcccacagggcatgatcttcttctccgatgggctggtgcatgacccgctgcggcagaaggccatcttcctgcgcaacctcatgcaggagtgcttcatcaaaatcagtgcggcctatggctccacgaaggacatctctgtctacagcgtgctgggcctgcctgcctcccagatcttcattgtgggccggcccaccaagaagtaccaaacccagtgccagttcctgagcgagggctacgccgcacacctggccgcgctggaggccagccaccgctcacgcccaaagaagaacaactcgcgcatgatcctgcgcaagggcagcttcgggctgcacgcgcagccagagttcctgcggaagcgcaaccacctgcgcagaaccatgtcagtgcagcagcccgacccgcccgccgccaaccccaagcccgagcgggcccagagccagcccgagtcggacaaagaccacgagcggccgctgccggcgctcagctgggcgcgtgggccccccaagttcgagtcggtgccctgaggggtgggctgtgctcagagcagggagcggggggcccaatcaggctgcctgcggggacgggagggggctgccctctccccgacacaggcgttttcctgctttttccctcccgtgtctgtccagcagtgtccgaccagagcggggagggatcctgcccgagcccggggggctccctgagctgcgacggggtgaggtccggggatctcggtgcagccactgctgcctcccacgggcctgcgaccgcaagcccaagtcagggttcatgtttgtgtcatcctgggggcaggcttgcccggggctgaagcgtttgggcaaagtcgaccaccctcctgcgtccccaggcttcacagcgagctaggcaggccctcaagggggcagccccagcctcggcaccaagcgccgctggcaggcacagcctctgggctgtcttgtggaggtgtgagtggcatttgtgcccgcccttcctgtggtttgggtcaccattttggggttggcgctcttatggcaagatggccactttctgggagtgagagcacatccccgggctcatgttacgccgtctctgtccacagccctcgggggtggggtctggtgctgacggtctgtcctgcagctgtccattgtccccaacccccgttgtcctcagtgtcctcaccatttccctgtggccctggaggccagggcttcctcttcccggagccctgcctcatgccctcccttgggaggctgcagccttgggctctggctcagctgggctggctgtgagcccctgagctggttgcttgccctctctgggctccgtcttccttctgttattggaggggtccccctagctgagattggtgtgagtctttgactcccaagatgtcctgcagtttggcccattgaggctcttcaggcctaagggtccctccgagtgtcctgtgacccacacctttcacacagcctgggagagggggtctgggtgggctggaaaggaggggctcttaaaggagcctctctgggtgggctgggaagggatccctactccacggagaggtgcagctggtttgccttgcactgcgtgtcccagggacaacccactcaaactgggtgtcctagggacaacccacctccctctcctgccaaaaggttactgattgggctccccataaccccagctctgccaggacccttttatcctttttggctcccagaggcatagagctgagattccagggttctaggggttcctggaagtttggctccaactgttgtattctcttccctttcccctgctgctcagtttgtgcccataacctcctcctgggtagtcccctgaggttggcaggacttggcccttctggggcccctaaagcctgctcaggccctcctgctgctgaaccttggcctgggcactgctttcctgcatcctggaaaaccccgactccctggcccaggcccacacctgctgtgtggggctgcccacgtggccactgagcccccataggctgccatcaaggccggtcccagcaatttcagccaggctgccccagggcccagacgtctgtatacacagcaggcacctgtgtcagctcagtgtcgcttctgctcaatgtctacctctcgcggctcccatgcagccagtgacgctgctggtgggggcggctggcaccgccgttgtgaattgcctggcaaattgggtgccctcctggggctggaggggtctgggctcctaacccccatccctgctctccccactagaaatgtgtcttcagtctgccagctcttctgctctacttccagtgctgcatcctgcactcaagcccagggctgctggcgagtctatggggaggagtgcggatcaggctcagcctcagcctcagcctcagcctcctctatggtcctgtctcctggcggttcacaggtgcccatcccccctttaacatttcacagttcttggctttccaaaggcaccagctcatatggcatagccaccccaaccctaatccttcccccaaatatcctgatttaaacttgggcagacttagtctgattcttgaaaactctaccatctccttcttgcagaaggcactggttacactaaaatgataaaataattagtatggggtactttgctcccagttacattccctcttccctgagaaccccaggctaggcgagagagggagagggagagagaaagagagagagggagagagagagagagagagggagagagaaagagagagagaaagaaaggaagacagaggaaagaaaggaagacagagagaggaaggcagagagagagagggagaaagaaagacaggaaggcagagagagagagagagagagaaaggaagacagagagagagagagaggaagagagagagagagaggaagagagagagagagctcatgagccaggatccctggggaatttgaagtcagtgtgaccagggttctgtggctctggggtcagagctgggacacaggacccagcaggagggccaccaccccttccttttggaaacagctctggttccaagcagcaatcaggtaggaggatcggggctttggctgatgatgcacacacaagatgctgatggtgtacggtgagatattgtgaacgcaacaactggagctgtagttggcgtgtgtgagtgtgtacctgcggttctgtttagtggcgagacaaggtatgtttcagtactgctttcacggcaactgtgtaatgcatatgctctttctacactagcggtttgctcagttttgtctgtccggttaagttggagaaagaaccaagttgtgttgttctctggagggggtgctgctgcctctccttgagtagttctgtgacccccaatccagctgttttgtagagaatccttctagcttctggtatgcctgctctccagcagctggaaacagatcttcctgcctgaccaaagctccttgtttcttgcgtggcatgtttgttcttcccgatccggtggctgtcgtagccgagggcctgcctgccaccttcctttatcatttgccctgttggggttcagggtgcatccttagcccaggacctgctcttccagcatcatgggttttttcctaaagatctcaacggctcccttgggctccataaaatatttcttttttaaaaaagcagactcctttcatgcattgggatgaacggccctcttgtctgggtgctgggctacagcaaacaaatgtgtttgaatcccagtattccagagattcctggcggtgggctgtctagaagaggcgaggctggatctcacggtttttaaactgtatttttacccctttgggacccatacctgtgccctggagtctttcatgaggcacgtgggtcctctgcatcctcactctcccccctagcccaggtgcagccccgggaggggtgccctgaccccgccttaaacaaccaactttcccaccgaatcccatcggcgggcggggggggggggtttgggtgccaagtgccctggaaacctattgtcttttggctcagccaaaagaaacattccctccttcctttccttccgggcttgggggaaaccttcgtaaaaatcatagttagggttaagtccaagcagtgaggcctgacctgggctctgctctccttgttgagacactaacaggcagttgggaggaaaatctgcatttgactccaccctctttggggcaaaggagaaacaggtgacccgagggggggcaggccagaggagggcgactcgtgcacagggacccccacccttggaccccgctgtccttttctagttgtttacttggtggtggcagccagtctgaccttgtctgtggtctgactgttcctaagtgtgtaactttcagtattatctgtgacagatggttctgtggtgaaaaaggtttattatattccttatggctgccttgtacaaaatccgttagaaacgctaatgtaagatatcagatttctaacaagacaaaaacagcattatggagttaaaagatttttacaactgggtcttgattttgatgtgagctggtttttagctctcaaatgttgtcacttaaataaaaaccttctttgcctt

SEQ ID NO: 15691 - DNA, 1621 bp, Homo sapiens
  ENST00000576664
gcctgaaggaacctgggttggcttcctaggcttccaggtgcgtcctgcctgcagccaggtctacagcttcttccattgcgcagacccctctgcctcacggctcgagccactgctggagcccaagttccacctggtgccgcctgtcagcgtgcctcgctaccagaggttcccactgggcgatgggcagtccctcctcctcgccccctcttcctggagggcagctcccgggacagcccgccacttctggatgcccctgcctcgccccctcaggcctcgaggttccagcgcccaggacggaggatgagcgaggggagctcccacagcgagagctcggagtcctcggacagcatggcacccgtgggtgcctcccgcatcacagccaagtggtggggaagcaagaggatcgactatgccctgtactgccctgatgtcctcacggccttccccaccgtggccctgccccacctcttccacgccagttactgggagtccacagacgtggtggccttcatcctgagacaggtaatgcgctatgagagcgtgaacatcaaggaaagcgcccgcctggaccctgcagcactgagtcctgccaacccccgggagaagtggcttcgtaagcggactcaggtcaagctgaggaatgtcacggctaatcaccgggccaatgatgtgattgctgctgaagatggcccccaggtcctggtggggcggttcatgtacgggcccctcgacatggtggctctgactggagagaaggtggacatcctagtaatggcagagccatcctcaggccgctgggtacacctggacacagagatcaccaacagcagtggtcgcatcacatacaatgtgccgcggccccggcgcctgggggttggtgtctatcctgtgaagatggtcgtcaggggcgaccagacctgtgccatgagctacctcacggtgttgcccaggggcatggagtgtgtagtgttcagcattgatgggtccttcgcggccagcgtgtctatcatgggaagcgaccccaaggtccggccgggtgcagtggatgttgtccggcactggcaggacttgggctacatgatcctttacatcacgggacggccggacatgcagaagcagcgggtggtgtcgtggctgtcccagcacaacttcccacagggcatgatcttcttctccgatgggctggtgcatgacccgctgcggcagaaggccatcttcctgcgcaacctcatgcaggagtgcttcatcaaaatcagtgcggcctatggctccacgaaggacatctctgtctacagcgtgctgggcctgcctgcctcccagatcttcattgtgggccggcccaccaagaagtaccaaacccagtgccagttcctgagcgagggctacgccgcacacctggccgcgctggaggccagccaccgctcacgcccaaagaagaacaactcgcgcatgatcctgcgcaagggcagcttcgggctgcacgcgcagccagagttcctgcggaagcgcaaccacctgcgcagaaccatgtcagtgcagcagcccgacccgcccgccgccaaccccaagcccgagcgggcccagagccagcccgagtcggacaaagaccacgagcggccgc

SEQ ID NO: 15692 - DNA, 5369 bp, Homo sapiens
  ENST00000572795
tattcatccatccatccgtccatccatccatccatctgtccatccattatctatctatctatctatctatctatctatctatctatctatcatctgatctatctacctcataatatcacagtgctctgatggagcataatatcacagagcacagggcactgtgggctctctgagaaaggccagagaggacttcctggaggagtgacttttgggtttgcataccacggctaagtgtgtgggctctcaggccgcctggatttgagtcctggctgtgtggtctggggaaggtgtttaacttctccttgtctcaatttcctaatctgtacaatgaaggtagccatagtaaataacctctcagggtggctgtgaagagtctgtgtgctaatgtgtgtgaagcactcaacacagtgtccagaatgtagaaagcacatagggatgccagccttgggaatgccagccttggggatgctgaccttggggatgccagccttggggatgccagctgtggggatctagccatggggatactagcctcagggatactagctatggggatgccaaccttggagatactagccatagggatgccagccttggggatactagtcttggagatactagccatggggatgccagccttggggatactaactgtggggatgccagcttcggggatgctggccatgactcacatcatcttcctcctggctggaagaggggctctctctgcaggtggagagtgggctggggagagagacttccaactcgcagcagggaacccagctggtggggagaaaggagggaaggatgtgtccacagaagggctggttgagcgctgggcagcttgctcactgctgacgctggcacatccttgcccactgtgggccctggcacctgtgggggacaaactgaggggacctccagggtatggggcctctgggagctccacccactgctccaggcactgagggctgcagtgctcccctcctgcctatcctgttgaactagctaaaggtaggtgcctggggccgggtggatacctgggttctcagcagtcatatgtgcaaaaatgacccaaacgcctacagggcccaaatcctataggcattcggcagatcactggggctggcagctggaagctttggaactttcagtcaggggcaggagggaggcctctgcacctctgttctgcctgtccccctcacaggacctcgccagagacttggggctgctgcagagcccagccctcaggcagagccctcataccccggggctccggagctgggaagggtgggaagaggtccccagcagggtgccaggtgtgtggggcgcaccgcactccgaattccccaggagaatgggagccgatgttctcagccaattgtggctctgaggagggctcagtgcggggagggccaaagtcccctgccctggagcttccagccagtcaggagagagcacgggcaagccccttcccttccctgggccttccttttccccctctagattgggggaaagtcagagactctgatttatctgcgttccttggacaccaacaggaattgcaggcagatctcaatcagagttggaaggaaggaagattaggtctgtaattccgcaacctggctaattgcccaaatccctggtgtgattcttgttaaactgcgagatgtccaggcctccctccagcagtggctgattcaggagggaggtgccccggaatctgcatctttgacacctgctcactgctgaactggtggcgcagcatgttcccttgtcactctgatagtccaggacttcactgtgctagttcatcatccgtctcaggaacccctctacctgtccccaggacatctgacctccagagctgggtcacccctatctccaggaagacggatggcctggccattcattcatggggccagcgggagggagcttagttctcccccaggcagctccttgccagggccattcatcaccccataatcacggctgggagggagctctttctcagctaattaaaatctctccggctgcaatcgaggcctgcttcctctaatttgtgttctttggagatgaggaatggctgacagggccagccttgtacaccacgaggactctgccacctgctgagagtgctccagccctgtcacctgccccagattctgtcgagtcccagtgggatgtgcactgggctccatcagcctgagcttgagctaagggggaagggcaggctctgggcaggggtggagagttcccagcctccctgtatggtccttcctgaccagccaggtccaacagtgcatctgggtcggaagccccagggaacagaagcagagatgggggcagagggaggggtaggtgacttggaggcactggtctcaggtgagtctgagctgcccagagaggaggggatttcctagtgggaaggtagggagttgagggtgccaatgcaaagtctggacagtctgctggctggacactgtggggcaggctttcagccccctcgggggtcacagaactttctgcaaagctgatgaaagctctgatcttctcccagtgatgcaatgaacacaacatcatgtctgcagctatgtgcccagctccaagctgtggccaacatgtgaaccccaagcctggcatgtcctctctcctcctttcccagcttctccaaagcctttcttgaggcctagttcaagccccacctcctccaggaagtctgccatgatgatatgttcctacatgttccacactagctgggtcctcagctgacttcttcctctatgattggggtgccctttggggccatgcagaagagggcaatagagactgcagtcacagggaccccagggcccacacccatggccagcacgggaaggacacacagggagtcagtgtaggcttgaatcctcttcccctctcctccccacactgcctgtgctctgtgtcaccaggctcctgcctgggtcttcctgaagggtccctggagcccaattcctggccagtatgtgctctcttctgcctgatcctcagccccaaacctgccaacctgcccgatcctggctgggctcaccttgggccccctgtctgcagcctgaacccctacagccacgatgagggctgcctcagcagcagccaggaccacgtccctctggccgcccttcccctgttggccatctcctccccgcagtaccaggatgctgtcgccaccgtcatcgagcgagccaaccaggtctacagagagttcctgaagtcctctgatgggattggcttcagtgggcaggtgtgtctcatcggggactgtgtggggggcctcctggccttcgatgccatctgctacagtgcggggccctcaggggacagccctgccagcagcagccggaaggggagcatcagcagcacccaggacaccccagtcgcggtggaggaagattgcagcctggccagcagcaagcgtctcagcaaaagcaacattgacatctccagtgggttggaggatgaggagcccaagaggccgttgccgcggaaacagagcgactcctccacctatgactgcgaggccatcacccagcaccatgccttcctctcaagcatccactccagcgtgctaaaggatgagtctgagaccccggcggctggggggccgcagctccctgaggtcagcctgggccgctttgacttcgatgtgtccgacttcttcctcttcggctcgccactgggcctggtcctggccatgcggaggacggtgctgcctgggctggacggcttccaggtgcgtcctgcctgcagccaggtctacagcttcttccattgcgcagacccctctgcctcacggctcgagccactgctggagcccaagttccacctggtgccgcctgtcagcgtgcctcgctaccagaggttcccactgggcgatgggcagtccctcctcctcgctgatgccctacacacccacagccccctcttcctggagggcagctcccgggacagcccgccacttctggatgcccctgcctcgccccctcaggcctcgaggttccagcgcccaggacggaggatgagcgaggggagctcccacagcgagagctcggagtcctcggacagcatggcacccgtgggtgcctcccgcatcacagccaagtggtggggaagcaagaggatcgactatgccctgtactgccctgatgtcctcacggccttccccaccgtggccctgccccacctcttccacgccagttactgggagtccacagacgtggtggccttcatcctgagacaggtaatgcgctatgagagcgtgaacatcaaggaaagcgcccgcctggaccctgcagcactgagtcctgccaacccccgggagaagtggcttcgtaagcggactcaggtcaagctgaggaatgtcacggctaatcaccgggccaatgatgtgattgctgctgaagatggcccccaggtcctggtggggcggttcatgtacgggcccctcgacatggtggctctgactggagagaaggtggacatcctagtaatggcagagccatcctcaggccgctgggtacacctggacacagagatcaccaacagcagtggtcgcatcacatacaatgtgccgcggccccggcgcctgggggttggtgtctatcctgtgaagatggtcgtcaggggcgaccagacctgtgccatgagctacctcacggtgttgcccaggggcatggagtgtgtagtgttcagcattgatgggtccttcgcggccagcgtgtctatcatgggaagcgaccccaaggtccggccgggtgcagtggatgttgtccggcactggcaggacttgggctacatgatcctttacatcacgggacggccggacatgcagaagcagcgggtggtgtcgtggctgtcccagcacaacttcccacagggcatgatcttcttctccgatgggctggtgcatgacccgctgcggcagaaggccatcttcctgcgcaacctcatgcaggagtgcttcatcaaaatcagtgcggcctatggctccacgaaggacatctctgtctacagcgtgctgggcctgcctgcctcccagatcttcattgtgggccggcccaccaagaagtaccaaacccagtgccagttcctgagcgagggctacgccgcacacctggccgcgctggaggccagccaccgctcacgcccaaagaagaacaactcgcgcatgatcctgcgcaagggcagcttcgggctgcacgcgcagccagagttcctgcggaagcgcaaccacctgcgcagaaccatgtcagtgcagcagcccgacccgcccgccgccaaccccaagcccgagcgggcccagagccagcccgagtcggacaaagaccacg

SEQ ID NO: 15693 - DNA, 734 bp, Homo sapiens
  ENST00000575201
gggcgaccagacctgtgccatgagctacctcacggtgttgcccaggggcatggagtgtgtagtgttcagcattgatgggtccttcgcggccagcgtgtctatcatgggaagcgaccccaaggtccggccgggtgcagtggatgttgtccggcactggcaggacttgggctacatgatcctttacatcacgggacggccggacatgcagaagcagcgggtggtgtcgtggctgtcccagcacaacttcccacagggcatgatcttcttctccgatgggctggtgcatgacccgctgcggcagaaggccatcttcctgcgcaacctcatgcaggagatgtgctttccatgaccgaagctatggttcccactagcagcaccaggaaactcggaaactcgggagaagtgcaaattatctgccctgcctcctcctgccaccctcttagacctactcaatcagaaactctggggaggggctcaggaaccttttcacaagccctccaggggattctgatgcacagaaagattaatcaagaatccctgacctagagcagaagaggcgttgacatataatgaccaaacccagcccacagcctgttttgatatgactggtcagctaagaatggtttttacactttcaaatggatggagagaataatcaaaagaatgatatttcatgacatgcaaattacatgaatttcaatgtctctaaataaaaaaagtttgattggaacaca

SEQ ID NO: 15694 - DNA, 3897 bp, Homo sapiens
  ENST00000245255
gttactgggcgtatggcgtacagacacgaggccggcgcccgggaggcggtgttcatccgcccgggaaaagagcgcctgttgctcgctgcccgcgtgtccctggctctctcgggaacccagcgccgaaggcgaggtgggcgcgggccgaaggaggtcctgggaggtcggcggcgcggagggatctccgcgggagccgttggggctgttggcctcgggctgaggtgcaaggaccaggactagggcgagggcagcggtccaagaaatagaaaacaatgactgggagagcccgagccagagccagaggaagggcccgcggtcaggagacagcgcagctggtgggctccactgccagtcagcaacctggttatattcagcctaggcctcagccgccaccagcagagggggaattatttggccgtggacggcagagaggaacagcaggaggaacagccaagtcacaaggactccagatatctgctggatttcaggagttatcgttagcagagagaggaggtcgtcgtagagattttcatgatcttggtgtgaatacaaggcagaacctagaccatgttaaagaatcaaaaacaggttcttcaggcattatagtaaggttaagcactaaccatttccggctgacatcccgtccccagtgggccttatatcagtatcacattgactataacccactgatggaagccagaagactccgttcagctcttctttttcaacacgaagatctaattggaaagtgtcatgcttttgatggaacgatattatttttacctaaaagactacagcaaaaggttactgaagtttttagtaagacccggaatggagaggatgtgaggataacgatcactttaacaaatgaacttccacctacatcaccaacttgtttgcagttctataatattattttcaggaggcttttgaaaatcatgaatttgcaacaaattggacgaaattattataacccaaatgacccaattgatattccaagtcacaggttggtgatttggcctggcttcactacttccatccttcagtatgaaaacagcatcatgctctgcactgacgttagccataaagtccttcgaagtgagactgttttggatttcatgttcaacttttatcatcagacagaagaacataaatttcaagaacaagtttccaaagaactaataggtttagttgttcttaccaagtataacaataagacatacagagtggatgatattgactgggaccagaatcccaagagcacctttaagaaagccgacggctctgaagtcagcttcttagaatactacaggaagcaatacaaccaagagatcaccgacttgaagcagcctgtcttggtcagccagcccaagagaaggcggggccctggggggacactgccagggcctgccatgctcattcctgagctctgctatcttacaggtctaactgataaaatgcgtaatgattttaacgtgatgaaagacttagccgttcatacaagactaactccagagcaaaggcagcgtgaagtgggacgactcattgattacattcataaaaacgataatgttcaaagggagcttcgagactggggtttgagctttgattccaacttactgtccttctcaggaagaattttgcaaacagaaaagattcaccaaggtggaaaaacatttgattacaatccacaatttgcagattggtccaaagaaacaagaggtgcaccattaattagtgttaagccactagataactggctgttgatctatacgcgaagaaattatgaagcagccaattcattgatacaaaatctatttaaagttacaccagccatgggcatgcaaatgagaaaagcaataatgattgaagtggatgacagaactgaagcctacttaagagtcttacagcaaaaggtcacagcagacacccagatagttgtctgtctgttgtcaagtaatcggaaggacaaatacgatgctattaaaaaatacctgtgtacagattgccctaccccaagtcagtgtgtggtggcccgaaccttaggcaaacagcaaactgtcatggccattgctacaaagattgccctacagatgaactgcaagatgggaggagagctctggagggtggacatccccctgaagctcgtgatgatcgttggcatcgattgttaccatgacatgacagctgggcggaggtcaatcgcaggatttgttgccagcatcaatgaagggatgacccgctggttctcacgctgcatatttcaggatagaggacaggagctggtagatgggctcaaagtctgcctgcaagcggctctgagggcttggaatagctgcaatgagtacatgcccagccggatcatcgtgtaccgcgatggcgtaggagacggccagctgaaaacactggtgaactacgaagtgccacagtttttggattgtctaaaatccattggtagaggttacaaccctagactaacggtaattgtggtgaagaaaagagtgaacaccagattttttgctcagtctggaggaagacttcagaatccacttcctggaacagttattgatgtagaggttaccagaccagaatggtatgacttttttatcgtgagccaggctgtgagaagtggtagtgtttctcccacacattacaatgtcatctatgacaacagcggcctgaagccagaccacatacagcgcttgacctacaagctgtgccacatctattacaactggccaggtgtcattcgtgttcctgctccttgccagtacgcccacaagctggcttttcttgttggccagagtattcacagagagccaaatctgtcactgtcaaaccgcctttactacctctaacctgcagaagacgatgcagccgcttttctttttgaaatgactttgggatttttttaagcttttatttactttttttttaactgttatctttctggatgaaacttgggaaggggattaggagatctagcattttatttctagcattgctattcaccggcttccttattttatacgtaaaaattaagattttatattttatcttcttgtttctcatagatattttgtgagcatttttttgtttattttgaagaaatgtggataagatacttggtagtataaaacagactctctgagagtatttgaaatgtgtttggagatttacttaaacgtactttcaggagtgagcaagtcctacttataaacctatattaactttatttttgagatacctgttttgaatttaaaggagataagaggcgtaaagtaggatgctcactacaaccataggtggggtttcagctcatatcttaaagataaaaggtactattatataacctatacacaagatacaggagaaaatatgcttgatttttatttggcaggggggctaggttgtatgggagtaaaaaaaacattgaaaatttttaaattgtccaaagaaacattttaagactctttaacaaaaaaggccatgagtaaatctctatattaacattactatttattttgttttggaactgggacatgattctatttgttataaaataaaattgatgtgattgtcaccttatttgaataactgtaattcttgttttactgaaagtatgtgcgttttcttttcatttaatttttaaaagtgcatacaattccattcataaaagctaaattagcctgaccaacatggtgaaaccccatctctactaaaaatacaaaattagccagatgtggtgccaggaggctgaggcaggagaatcacttgaacctgagaggcggaggttgcagtgagcagagatcacgccactgcactccagcctgggcaacagagtgagactccgtctcaaaaaaaaaaaaaaaaaaaaaaaaaaaaaaaaaaaaaaaa

SEQ ID NO: 15695 - DNA, 571 bp, Homo sapiens
  ENST00000546060
gtgcaaggaccaggactagggcgagggcagcggtccaaggtgcggggccaggctgaggtgctagaaatagaaaacaatgactgggagagcccgagccagagccagaggaagggcccgcggtcaggagacagcgcagctggtgggctccactgccagtcagcaacctggttatattcagcctaggcctcagccgccaccagcagagggggaattatttggccgtggacggcagagaggaacagcaggaggaacagccaagtcacaaggactccagatatctgctggatttcaggagttatcgttagcagagagaggaggtcgtcgtagagattttcatgatcttggtgtgaatacaaggcagaacctagaccatgttaaagaatcaaaaacaggttcttcaggcattatagtaaggttaagcactaaccatttccggctgacatcccgtccccagtgggccttatatcagtatcacattgactataacccactgatggaagccagaagactccgttcagctcttctttttcaacacgaagatctaattggaaagtgtcatgcttttgatgga

SEQ ID NO: 15696 - DNA, 467 bp, Homo sapiens
  ENST00000539400
agcggtccaaggtgcggggccaggctgaggtgctaggtgtgcgggggccgggatgcgggggcggcggctgggggtccgggatgtggagaaatagaaaacaatgactgggagagcccgagccagagccagaggaagggcccgcggtcaggagacagcgcagctggtgggctccactgccagtcagcaacctggttatattcagcctaggcctcagccgccaccagcagagggggaattatttggccgtggacggcagagaggaacagcaggaggaacagccaagtcacaaggactccagatatctgctggatttcaggagttatcgttagcagagagaggaggtcgtcgtagagattttcatgatcttggtgtgaatacaaggcagaacctagaccatgttaaagaatcaaaaacaggttcttcaggcattatagtaaggttaagcactaaccatttccggctgacat

SEQ ID NO: 15697 - DNA, 545 bp, Homo sapiens
  ENST00000539995
gtgcacggcgtggtcctgagctcagcgccggagggacgttaggtggaagcgtctttggcagagctggtagcgaatcggagagaaatagaaaacaatgactgggagagcccgagccagagccagaggaagggcccgcggtcaggagacagcgcagctggtgggctccactgccagtcagcaacctggttatattcagcctaggcctcagccgccaccagcagagggggaattatttggccgtggacggcagagaggaacagcaggaggaacagccaagtcacaaggactccagatatctgctggatttcaggagttatcgttagcagagagaggaggtcgtcgtagagattttcatgatcttggtgtgaatacaaggcagaacctagaccatgttaaagaatcaaaaacaggttcttcaggcattatagtaaggttaagcactaaccatttccggctgacatcccgtccccagtgggccttatatcagtatcacattgactataacccactgatggaagccagaagactccgttcagctcttcttt

SEQ ID NO: 15698 - DNA, 566 bp, Homo sapiens
  ENST00000535956
gttaggtggaagcgtctttggcagagctggtagcgaatcggagaggtgatttccagcgagtgtggttattggaagcacacacttgctttctgactttaagaattcaatatccagactgaggtggttttgaaactggaaggagataaagctgaaaaccagagttgtgctgggaaacctggacgtagagcgctgagccccccagaaatagaaaacaatgactgggagagcccgagccagagccagaggaagggcccgcggtcaggagacagcgcagctggtgggctccactgccagtcagcaacctggttatattcagcctaggcctcagccgccaccagcagagggggaattatttggccgtggacggcagagaggaacagcaggaggaacagccaagtcacaaggactccagatatctgctggatttcaggagttatcgttagcagagagaggaggtcgtcgtagagattttcatgatcttggtgtgaatacaaggcagaacctagaccatgttaaagaatcaaaaacaggttcttcaggcattatagtaaggttaagcactaacc

SEQ ID NO: 15699 - DNA, 879 bp, Homo sapiens
  ENST00000542723
atctccaaatgggaaagaaagaaccagccaccagcatcctaattctttcagcactttctcctcctaagtctgtttataataaataatccaaatgaaaaactaagtcttatattaaaataggttttcccctttggccctactgcagtgcccagtgcaaggtaagcaactgagtttgttgaatgtaggaatgttacattaaaaaaaactgtcattaaagattagaaggatacataataattgcctggggagcttacttttgaaactcaaagaagtttaaagtaacattgtagaaattatcaaatgcgattgcctccattgagtattgtcttcaagattgtttcctctccagaaatagaaaacaatgactgggagagcccgagccagagccagaggaagggcccgcggtcaggagacagcgcagctggtgggctccactgccagtcagcaacctggttatattcagcctaggcctcagccgccaccagcagagggggaattatttggccgtggacggcagagaggaacagcaggaggaacagccaagtcacaaggactccagatatctgctggatttcaggagttatcgttagcagagagaggaggtcgtcgtagagattttcatgatcttggtgtgaatacaaggcagaacctagaccatgttaaagaatcaaaaacaggttcttcaggcattatagtaaggttaagcactaaccatttccggctgacatcccgtccccagtgggccttatatcagtatcacattgactataacccactgatggaagccagaagactccgttcagctcttctttttcaacacgaagatctaattggaaagtgtcatgcttttgatggaacgatattatttttacctaaaag

SEQ ID NO: 15700 - DNA, 1051 bp, Homo sapiens
  ENST00000540672
caggttacagatttaaaccctctaaaccagcaacttctgtagttgtaattgcatcatgacagactgtggaaaatacatgaagacctttaggtagttatcagacttacaatacagaaaaataatttcccagtcagcaaacatatgctcctgcactcttgcaccacagtccagttggcttgatctcttgattcaaggtgcacatctcttgaaagggtgcatctgcaattgcccaggacagtgacaaggcctttatgaatgaagttataactaggaaaccattctctcgttaggctggcagatacctaaaacatgttgataggattgttttatgccttgtcttctacacctcagtatcctttggattacacataatagcactatgggagttaatattgtcatcctttatttcgtgctttatgttgctcaagtacacaatttttttttaaggactccagatatctgctggatttcaggagttatcgttagcagagagaggaggtcgtcgtagagattttcatgatcttggtgtgaatacaaggcagaacctagaccatgttaaagaatcaaaaacaggttcttcaggcattatagtaaggttaagcactaaccatttccggctgacatcccgtccccagtgggccttatatcagtatcacattgactataacccactgatggaagccagaagactccgttcagctcttctttttcaacacgaagatctaattggaaagtgtcatgcttttgatggaacgatattatttttacctaaaagactacagcaaaaggttactgaagtttttagtaagacccggaatggagaggatgtgaggataacgatcactttaacaaatgaacttccacctacatcaccaacttgtttgcagttctataatattattttcaggaggcttttgaaaatcatgaatttgcaacaaattggacgaaattattataacccaaatgacccaattgatattccaagtcacaggttggtgatttggcctggcttcactacttccatccttcagtatgaaaacagcatcatgct

SEQ ID NO: 15701 - DNA, 545 bp, Homo sapiens
  ENST00000541480
caggccaagaagcctgatgaaccttgacacaggagagccgcctgaagaatccaggtggggatgggtggctaaaaagggcagcctctagtatgggtgcatctggcgtgtggtaggccaaggagtgtggggccgtcctggggtctgcggaaaacgtcatttgagactccggtgaaacacgagtatgaaaatgaagttactcctcctgaaaaagccctagactaacggtaattgtggtgaagaaaagagtgaacaccagattttttgctcagtctggaggaagacttcagaatccacttcctggaacagttattgatgtagaggttaccagaccagaatggtatgacttttttatcgtgagccaggctgtgagaagtggtagtgtttctcccacacattacaatgtcatctatgacaacagcggcctgaagccagaccacatacagcgcttgacctacaagctgtgccacatctattacaactggccagtaagtgcttctacttgttgatgtttagcaaataaaggacattcacttttcaaaatgaaa

SEQ ID NO: 15702 - DNA, 3875 bp, Homo sapiens
  ENST00000613226
gttactgggcgtatggcgtacagacacgaggccggcgcccgggaggcggtgttcatccgcccgggaaaagagcgcctgttgctcgctgcccgcgtgtccctggctctctcgggaacccagcgccgaaggcgaggtgggcgcgggccgaaggaggtcctgggaggtcggcggcgcggagggatctccgcgggagccgttggggctgttggcctcgggctgaggtgcaaggaccaggactagggcgagggcagcggtccaagaaatagaaaacaatgactgggagagcccgagccagagccagaggaagggcccgcggtcaggagacagcgcagctggtgggctccactgccagtcagcaacctggttatattcagcctaggcctcagccgccaccagcagagggggaattatttggccgtggacggcagagaggaacagcaggaggaacagccaagtcacaaggactccagatatctgctggatttcaggagttatcgttagcagagagaggaggtcgtcgtagagattttcatgatcttggtgtgaatacaaggcagaacctagaccatgttaaagaatcaaaaacaggttcttcaggcattatagtaaggttaagcactaaccatttccggctgacatcccgtccccagtgggccttatatcagtatcacattgactataacccactgatggaagccagaagactccgttcagctcttctttttcaacacgaagatctaattggaaagtgtcatgcttttgatggaacgatattatttttacctaaaagactacagcaaaaggttactgaagtttttagtaagacccggaatggagaggatgtgaggataacgatcactttaacaaatgaacttccacctacatcaccaacttgtttgcagttctataatattattttcaggaggcttttgaaaatcatgaatttgcaacaaattggacgaaattattataacccaaatgacccaattgatattccaagtcacaggttggtgatttggcctggcttcactacttccatccttcagtatgaaaacagcatcatgctctgcactgacgttagccataaagtccttcgaagtgagactgttttggatttcatgttcaacttttatcatcagacagaagaacataaatttcaagaacaagtttccaaagaactaataggtttagttgttcttaccaagtataacaataagacatacagagtggatgatattgactgggaccagaatcccaagagcacctttaagaaagccgacggctctgaagtcagcttcttagaatactacaggaagcaatacaaccaagagatcaccgacttgaagcagcctgtcttggtcagccagcccaagagaaggcggggccctggggggacactgccagggcctgccatgctcattcctgagctctgctatcttacaggtctaactgataaaatgcgtaatgattttaacgtgatgaaagacttagccgttcatacaagactaactccagagcaaaggcagcgtgaagtgggacgactcattgattacattcataaaaacgataatgttcaaagggagcttcgagactggggtttgagctttgattccaacttactgtccttctcaggaagaattttgcaaacagaaaagattcaccaaggtggaaaaacatttgattacaatccacaatttgcagattggtccaaagaaacaagaggtgcaccattaattagtgttaagccactagataactggctgttgatctatacgcgaagaaattatgaagcagccaattcattgatacaaaatctatttaaagttacaccagccatgggcatgcaaatgagaaaagcaataatgattgaagtggatgacagaactgaagcctacttaagagtcttacagcaaaaggtcacagcagacacccagatagttgtctgtctgttgtcaagtaatcggaaggacaaatacgatgctattaaaaaatacctgtgtacagattgccctaccccaagtcagtgtgtggtggcccgaaccttaggcaaacagcaaactgtcatggccattgctacaaagattgccctacagatgaactgcaagatgggaggagagctctggagggtggacatccccctgaagctcgtgatgatcgttggcatcgattgttaccatgacatgacagctgggcggaggtcaatcgcaggatttgttgccagcatcaatgaagggatgacccgctggttctcacgctgcatatttcaggatagaggacaggagctggtagatgggctcaaagtctgcctgcaagcggctctgagggcttggaatagctgcaatgagtacatgcccagccggatcatcgtgtaccgcgatggcgtaggagacggccagctgaaaacactggtgaactacgaagtgccacagtttttggattgtctaaaatccattggtagaggttacaaccctagactaacggtaattgtggtgaagaaaagagtgaacaccagattttttgctcagtctggaggaagacttcagaatccacttcctggaacagttattgatgtagaggttaccagaccagaatggtatgacttttttatcgtgagccaggctgtgagaagtggtagtgtttctcccacacattacaatgtcatctatgacaacagcggcctgaagccagaccacatacagcgcttgacctacaagctgtgccacatctattacaactggccaggtgtcattcgtgttcctgctccttgccagtacgcccacaagctggcttttcttgttggccagagtattcacagagagccaaatctgtcactgtcaaaccgcctttactacctctaacctgcagaagacgatgcagccgcttttctttttgaaatgactttgggatttttttaagcttttatttactttttttttaactgttatctttctggatgaaacttgggaaggggattaggagatctagcattttatttctagcattgctattcaccggcttccttattttatacgtaaaaattaagattttatattttatcttcttgtttctcatagatattttgtgagcatttttttgtttattttgaagaaatgtggataagatacttggtagtataaaacagactctctgagagtatttgaaatgtgtttggagatttacttaaacgtactttcaggagtgagcaagtcctacttataaacctatattaactttatttttgagatacctgttttgaatttaaaggagataagaggcgtaaagtaggatgctcactacaaccataggtggggtttcagctcatatcttaaagataaaaggtactattatataacctatacacaagatacaggagaaaatatgcttgatttttatttggcaggggggctaggttgtatgggagtaaaaaaaacattgaaaatttttaaattgtccaaagaaacattttaagactctttaacaaaaaaggccatgagtaaatctctatattaacattactatttattttgttttggaactgggacatgattctatttgttataaaataaaattgatgtgattgtcaccttatttgaataactgtaattcttgttttactgaaagtatgtgcgtttccttttcatttaatttttaaaagtgcatacaattccattcataaaagctaaattagcctgaccaacatggtgaaaccccatctctactaaaaatacaaaattagccagatgtggtgccaggaggctgaggcaggagaatcacttgaacctgagaggcggaggttgcagtgagcagagatcacgccactgcactccagcctgggcaacagagtgagactccgtctcaaaaaaaaaaaaaaaaaa

SEQ ID NO: 15703 - DNA, 2579 bp, Homo sapiens
  ENST00000632888
aggtgcaaggaccaggactagggcgagggcagcggtccaagaaatagaaaacaatgactgggagagcccgagccagagccagaggaagggcccgcggtcaggagacagcgcagctggtgggctccactgccagtcagcaacctggttatattcagcctaggcctcagccgccaccagcagagggggaattatttggccgtggacggcagagaggaacagcaggaggaacagccaagtcacaaggactccagatatctgctggatttcaggagttatcgttagcagagagaggaggtcgtcgtagagattttcatgatcttggtgtgaatacaaggcagaacctagaccatgttaaagaatcaaaaacaggttcttcaggcattatagtaaggttaagcactaaccatttccggctgacatcccgtccccagtgggccttatatcagtatcacattgactataacccactgatggaagccagaagactccgttcagctcttctttttcaacacgaagatctaattggaaagtgtcatgcttttgatggaacgatattatttttacctaaaagactacagcaaaaggttactgaagtttttagtaagacccggaatggagaggatgtgaggataacgatcactttaacaaatgaacttccacctacatcaccaacttgtttgcagttctataatattattttcaggaggcttttgaaaatcatgaatttgcaacaaattggacgaaattattataacccaaatgacccaattgatattccaagtcacaggttggtgatttggcctggcttcactacttccatccttcagtatgaaaacagcatcatgctctgcactgacgttagccataaagtccttcgaagtgagactgttttggatttcatgttcaacttttatcatcagacagaagaacataaatttcaagaacaagtttccaaagaactaataggtttagttgttcttaccaagtataacaataagacatacagagtggatgatattgactgggaccagaatcccaagagcacctttaagaaagccgacggctctgaagtcagcttcttagaatactacaggaagcaatacaaccaagagatcaccgacttgaagcagcctgtcttggtcagccagcccaagagaaggcggggccctggggggacactgccagggcctgccatgctcattcctgagctctgctatcttacaggtctaactgataaaatgcgtaatgattttaacgtgatgaaagacttagccgttcatacaagactaactccagagcaaaggcagcgtgaagtgggacgactcattgattacattcataaaaacgataatgttcaaagggagcttcgagactggggtttgagctttgattccaacttactgtccttctcaggaagaattttgcaaacagaaaagattcaccaaggtggaaaaacatttgattacaatccacaatttgcagattggtccaaagaaacaagaggtgcaccattaattagtgttaagccactagataactggctgttgatctatacgcgaagaaattatgaagcagccaattcattgatacaaaatctatttaaagttacaccagccatgggcatgcaaatgagaaaagcaataatgattgaagtggatgacagaactgaagcctacttaagagtcttacagcaaaaggtcacagcagacacccagatagttgtctgtctgttgtcaagtaatcggaaggacaaatacgatgctattaaaaaatacctgtgtacagattgccctaccccaagtcagtgtgtggtggcccgaaccttaggcaaacagcaaactgtcatggccattgctacaaagattgccctacagatgaactgcaagatgggaggagagctctggagggtggacatccccctgaagctcgtgatgatcgttggcatcgattgttaccatgacatgacagctgggcggaggtcaatcgcaggatttgttgccagcatcaatgaagggatgacccgctggttctcacgctgcatatttcaggatagaggacaggagctggtagatgggctcaaagtctgcctgcaagcggctctgagggcttggaatagctgcaatgagtacatgcccagccggatcatcgtgtaccgcgatggcgtaggagacggccagctgaaaacactggtgaactacgaagtgccacagtttttggattgtctaaaatccattggtagaggttacaaccctagactaacggtaattgtggtgaagaaaagagtgaacaccagattttttgctcagtctggaggaagacttcagaatccacttcctggaacagttattgatgtagaggttaccagaccagaatggtatgacttttttatcgtgagccaggctgtgagaagtggtagtgtttctcccacacattacaatgtcatctatgacaacagcggcctgaagccagaccacatacagcgcttgacctacaagctgtgccacatctattacaactggccagtaagtgcttctacttgttgatgtttagcaaataaaggacattcacttttcaaaatg

SEQ ID NO: 15704 - DNA, 571 bp, Homo sapiens; identical to SEQ ID NO: 15695
  ENST00000634077

SEQ ID NO: 15705 - DNA, 467 bp, Homo sapiens; identical to SEQ ID NO: 15696
  ENST00000633272

SEQ ID NO: 15706 - DNA, 545 bp, Homo sapiens; identical to SEQ ID NO: 15697
  ENST00000633252

SEQ ID NO: 15707 - DNA, 566 bp, Homo sapiens; identical to SEQ ID NO: 15698
  ENST00000634115

SEQ ID NO: 15708 - DNA, 879 bp, Homo sapiens; identical to SEQ ID NO: 15699
  ENST00000633042

SEQ ID NO: 15709 - DNA, 1051 bp, Homo sapiens; identical to SEQ ID NO: 15700
  ENST00000631528

SEQ ID NO: 15710 - DNA, 545 bp, Homo sapiens; identical to SEQ ID NO: 15701
  ENST00000631714

SEQ ID NO: 15711 - DNA, 3043 bp, Homo sapiens
  ENST00000318222
cagcatcgccttttcctcccgtttctccttccactcccagctccacatcctcctcctattctcccctctcccctcttcaaacccccaccttccagttccctcacctcccctttcggctggtcccctggggcttgcagcaagagggagagagagctcctgacaggattgatggtccttccccaccctgtcctctcatccgctccctccccagcaggcacagacatccccctacaaaaggcaggagcccaggctgtgtggaaacagctgctctcagacgcctttccatttgctctctgctggctaggctgggctgtgcctctgctccctcttcctctagctgagagtgggcacctggggtaccgggcccccccacctcattccccatgaatgctgtgggaagtcctgaggggcaggagctgcaaaagctggggagtggagcctgggacaaccccgcctacagtggtcccccttccccacacgggacgctgagagtctgcaccatctccagcacggggcctctccagccccaacccaagaagcctgaagatgaaccccaggagacggcatacaggacccaggtgtccagctgctgcctccatatctgtcaaggcatcagaggactttggggaacaaccctgactgagaacacagctgagaaccgggaactttatatcaagaccaccctgagggagctgttggtatatattgtgttcctggtggacatctgtctactgacctatggaatgacaagctccagtgcttattactacaccaaagtgatgtctgagctcttcttacatactccatcagacactggagtctcctttcaggccatcagcagcatggcggacttctgggattttgcccagggcccactactggacagtttgtattggaccaaatggtacaacaaccagagcctgggccatggctcccactccttcatctactatgagaacatgctgctgggggttccgaggctgcggcagctaaaggtccgcaatgactcctgtgtggtgcatgaagacttccgggaggacattctgagctgctatgatgtctactctccagacaaagaagaacaactcccctttgggcccttcaatggcacagcgtggacataccactcgcaggatgagttggggggcttctcccactggggcaggctcacaagctacagcggaggtggctactacctggaccttccaggatcccgacagggtagtgcagaggctctccgggcccttcaggaggggctgtggctggacaggggcactcgagtggtgttcatcgacttctcagtctacaatgccaatatcaatcttttctgtgtcctgaggctggtggtggagtttccagctacaggaggtgccatcccatcctggcaaatccgcacagtcaagctgatccgctatgtcagcaactgggacttctttatcgttggctgtgaggtcatcttctgcgtcttcatcttctactatgtggtggaagagatcctggagctccacattcaccggcttcgctacctcagcagcatctggaacatactggacctggtggtcatcttgctctccattgtggctgtgggcttccacatattccgaaccctcgaggtgaatcggctcatggggaagctcctgcagcagccaaacacgtatgcagactttgagttcctcgccttctggcagacacagtacaacaacatgaatgctgtcaacctcttcttcgcctggatcaagatattcaagtacatcagcttcaacaaaaccatgacccagctctcctccacgctggcccgctgtgccaaggacatcctgggcttcgccgtcatgttcttcattgttttcttcgcctatgcccaactcggctacctgcttttcgggacccaagtggaaaactttagcactttcatcaagtgcattttcactcagttccggataatcctcggggactttgactacaatgctatcgacaatgccaaccgcatcctgggccctgcctactttgtcacctatgtcttcttcgtcttcttcgtgctcctgaacatgttcctggccatcatcaatgacacatattcagaggtcaaggaggagctggctggacagaaggatgagctgcaactttctgacctcctgaaacagggctacaacaagaccctactaagactgcgtctgaggaaggagagggtttcggatgtgcagaaggtcctgcagggtggggagcaggagatccagtttgaggatttcaccaacaccttaagggaactgggacacgcagagcatgaaatcactgagctcacggccaccttcaccaagtttgacagagatgggaatcgtattctggatgagaaggaacaggaaaaaatgcgacaggacctggaggaagagagggtggccctcaacactgagattgagaaactaggccgatctattgtgagcagcccacaaggcaaatcgggtccagaggctgccagagcaggaggctgggtttcaggagaagaattctacatgctcacaaggagagttctgcagctggagactgtcctggaaggagtagtgtcccagattgatgctgtaggctcaaagctgaaaatgctggagaggaaggggtggctggctccctccccaggcgtgaaggaacaagctatttggaagcacccgcagccagccccagctgtgaccccagacccctggggagtccagggtgggcaggagagtgaggttccctataaaagagaagaggaagccttagaggagaggagactctcccgtggtgagattccaacgttgcagaggagttaagtgtgaggcactcccggagcaaagtctatgaaggatcttctgcaagaggctgcctcctggtccactgaacctggaaactgagtgggctttaaccaggagataaaaatggagcctgaagggaatcaggcaaggaaatgaactcaggattcagagatctttgaattaatatgtggtgggttctgacattattcttccataagaccatgtgggtttccatggtggctatcaataaaactccttag

SEQ ID NO: 15712 - DNA, 423 bp, Homo sapiens
  ENST00000465680
gcctctccagccccaacccaagaagcctgaagatgaaccccaggagacggcatacaggacccaggtgtccagctgctgcctccatatctgtcaaggcatcagagaggttccctataaaagagaagaggaagccttagaggagaggagactctcccgtggtgagattccaacgttgcagaggagttaagtgtgaggcactcccggagcaaagtctatgaaggatcttctgcaagaggctgcctcctggtccactgaacctggaaactgagtgggctttaaccaggagataaaaatggagcctgaagggaatcaggcaaggaaatgaactcaggattcagagatctttgaattaatatgtggtgggttctgacattattcttccataagaccatgtgggtttccatggtggctatcaataaaact

SEQ ID NO: 15713 - DNA, 2277 bp, Homo sapiens
  ENST00000528248
atgaaccccaggagacggcatacaggacccaggtgtccagctgctgcctccatatctgtcaaggcatcagaggcatctctcccatgccccttaggactttggggaacaaccctgactgagaacacagctgagaaccgggaactttatatcaagaccaccctgagggagctgttggtatatattgtgttcctggtggacatctgtctactgacctatggaatgacaagctccagtgcttattactacaccaaagtgatgtctgagctcttcttacatactccatcagacactggagtctcctttcaggccatcagcagcatggcggacttctgggattttgcccagggcccactactggacagtttgtattggaccaaatggtacaacaaccagagcctgggccatggctcccactccttcatctactatgagaacatgctgctgggggttccgaggctgcggcagctaaaggtccgcaatgactcctgtgtggtgcatgaagacttccgggaggacattctgagctgctatgatgtctactctccagacaaagaagaacaactcccctttgggcccttcaatggcacagcgtggacataccactcgcaggatgagttggggggcttctcccactggggcaggctcacaagctacagcggaggtggctactacctggaccttccaggatcccgacagggtagtgcagaggctctccgggcccttcaggaggggctgtggctggacaggggcactcgagtggtgttcatcgacttctcagtctacaatgccaatatcaatcttttctgtgtcctgaggctggtggtggagtttccagctacaggaggtgccatcccatcctggcaaatccgcacagtcaagctgatccgctatgtcagcaactgggacttctttatcgttggctgtgaggtcatcttctgcgtcttcatcttctactatgtggtggaagagatcctggagctccacattcaccggcttcgctacctcagcagcatctggaacatactggacctggtggtcatcttgctctccattgtggctgtgggcttccacatattccgaaccctcgaggtgaatcggctcatggggaagctcctgcagcagccaaacacgtatgcagactttgagttcctcgccttctggcagacacagtacaacaacatgaatgctgtcaacctcttcttcgcctggatcaagatattcaagtacatcagcttcaacaaaaccatgacccagctctcctccacgctggcccgctgtgccaaggacatcctgggcttcgccgtcatgttcttcattgttttcttcgcctatgcccaactcggctacctgcttttcgggacccaagtggaaaactttagcactttcatcaagtgcattttcactcagttccggataatcctcggggactttgactacaatgctatcgacaatgccaaccgcatcctgggccctgcctactttgtcacctatgtcttcttcgtcttcttcgtgctcctgaacatgttcctggccatcatcaatgacacatattcagaggtcaaggaggagctggctggacagaaggatgagctgcaactttctgacctcctgaaacagggctacaacaagaccctactaagactgcgtctgaggaaggagagggtttcggatgtgcagaaggtcctgcagggtggggagcaggagatccagtttgaggatttcaccaacaccttaagggaactgggacacgcagagcatgaaatcactgagctcacggccaccttcaccaagtttgacagagatgggaatcgtattctggatgagaaggaacaggaaaaaatgcgacaggacctggaggaagagagggtggccctcaacactgagattgagaaactaggccgatctattgtgagcagcccacaaggcaaatcgggtccagaggctgccagagcaggaggctgggtttcaggagaagaattctacatgctcacaaggagagttctgcagctggagactgtcctggaaggagtagtgtcccagattgatgctgtaggctcaaagctgaaaatgctggagaggaaggggtggctggctccctccccaggcgtgaaggaacaagctatttggaagcacccgcagccagccccagctgtgaccccagacccctggggagtccagggtgggcaggagagtgaggttccctataaaagagaagaggaagccttagaggagaggagactctcccgtggtgagattccaacgttgcagaggagttaa

SEQ ID NO: 15714 - DNA, 554 bp, Homo sapiens
  ENST00000532547
atccccctacaaaaggcaggagcccaggctgtgtggaaacagctgctctcagacgcctttccatttgctctctgctggctaggctgggctgtgcctctgctccctcttcctctagctgagagtgggcacctggggtaccgggcccccccacctcattccccatgaatgctgtgggaagtcctgaggggcaggagctgcaaaagctggggagtggagcctgggacaaccccgcctacagtggtcccccttccccacacgggacgctgagagtctgcaccatctccagcacggggcctctccagccccaacccaagaagcctgaagatgaaccccaggagacggcatacaggacccaggactttggggaacaaccctgactgagaacacagctgagaaccgggaactttatatcaagaccaccctgagggagctgttggtatatattgtgttcctggtggacatctgtctactgacctatggaatgacaagctccagtgcttattactacaccaaagtgatgtctgagctcttcttacatactccatcagacactg

SEQ ID NO: 15715 - DNA, 2502 bp, Homo sapiens
  ENST00000294964
gaggcaagtgtcaggccgatgtgtcgcccgcgaggggccggggtcggggccgccggggccatgcgcgcgggctgggcagggggccggcggggcgcagagcggagccgcctcggagcctgagccgcccggggccggggccggggagccgcgcggggccggccggccggggggaggggagcgatgcggcgccggcgggcggcagtggccgcgggtttctgcgcctccttcctgctgggctccgtcctcaacgtgctcttcgctccgggctcggagcctccgaggccaggccagtcccctgagccttcgccggccccgggtccgggccgtcgcgggggccgcggggagctggcccggcagatccgggcgcgctacgaggaggtgcagcgctattcccgcgggggccccgggcccggggcgggccggccggagcggcggcgcctgatggacctggctccgggcgggcccggcctgccgcgcccccggcccccttgggcccggcccctgtccgacggcgccccaggctggcccccggctcccggcccaggctcccccggcccgggcccgcgcctgggctgcgccgcgcttcgcaacgtgtccggcgcgcagtacatgggctcaggctacaccaaggccgtgtaccgggtccgcctgcccggcggtgccgcggtggcgctcaaggcggtggactttagcggccacgatctgggcagctgcgtgcgcgagttcggggtacggaggggctgctatcggctggcggcccacaagctgcttaaggagatggtgctgctggagcggctgcggcaccccaacgtgctgcagctctatggctactgctaccaggacagcgaggacatcccagacaccctgaccaccatcacggagctgggcgcccctgtagaaatgatccagctgctgcaaacttcctgggaggatcgattccgaatctgcctgagcctgggccgcctcctccaccacctggcccactccccactgggctccgtcactctgctggacttccgccctcggcagtttgtgctggtggatggggagctcaaagtgacggacctggatgacgcacgtgtggaggagacgccgtgtgcaggcagcaccgactgcatactcgagtttccggccaggaacttcaccctgccctgctcagcccagggctggtgcgagggcatgaacgagaagcggaacctctataatgcctacaggtttttcttcacatacctcctgcctcacagtgccccgccttcactgcgtcctctgctggacagcatcgtcaacgccacaggagagctcgcctggggggtggacgagaccctggcccagctggagaaggtgctgcacctgtaccggagcgggcagtatctgcagaactccacggcaagcagcagtaccgagtaccagtgtatcccagacagcaccatcccccaggaagactaccgctgctggccatcctaccaccacgggagctgcctcctttcagtgttcaacctggctgaggctgtggatgtctgtgagagccatgcccagtgtcgggcctttgtggtcaccaaccagaccacctggacaggtcggcagctggtctttttcaagactggatggagccaagtggtccctgatcccaacaagaccacatatgtgaaggcctctggctgacctatctgagggctcggctgaccagctgactatcctcagcagctgggcttgcctgtggagggagtgacttgcactggcagcactgcatgtcacctgggaacccctgcagacaaagctaacatcccagacagacagatgtgaccaggacaaacgtgcaataatgccaaatgttaaaatgtgagtttaccagcctagctatgggactgctggctcctagtccaggaatcatgggggtatgactgcctctccaaccctgtgggctgtaagcaagctcaggctagtctccccactgggggctgtgcccctccctgggacggttccgtgggcagccccatcactgtgttcaatagtgtgagaatgtagctaaagcccctgctgctgctgctgcacatgccacagcaggcggtgggggctgcgtggggacaatccatcgtggagtgttctctcagcttaggtctggacaggagacttggcgggagatgctccaggatgtgggtgattctgtacctggggaggctatctctgacctcccgacaggggacactcccaggccagcccaggggtcaggggcagaggtgcacacctcagcatgagccaagactggggtcagggagcaggtgtggtttgagccaggacctggggcgggggtggggccggggcctttctgcctcatttgctttcaatgaaagcctcaaagcagccaaaaccaggctttcccccttcctcgagtttgaatatccagaatcttttgtacttcttgttggttaaattgtttatttttgtaaaaaataaaataaaattagttaataaaatgatgtttcacagcaaactcttccctaa

SEQ ID NO: 15716 - DNA, 1550 bp, Homo sapiens
  ENST00000401498
cgcccgcgaggggccggggtcggggccgccggggccatgcgcgcgggctgggcagggggccggcggggcgcagagcggagccgcctcggagcctgagccgcccggggccggggccggggagccgcgcggggccggccggccggggggaggggagcgatgcggcgccggcgggcggcagtggccgcgggtttctgcgcctccttcctgctgggctccgtcctcaacgtgctcttcgctccgggctcggagcctccgaggccaggccagtcccctgagccttcgccggccccgggtccgggccgtcgcgggggccgcggggagctggcccggcagatccgggcgcgctacgaggaggctggcccccggctcccggcccaggctcccccggcccgggcccgcgcctgggctgcgccgcgcttcgcaacgtgtccggcgcgcagtacatgggctcaggctacaccaaggccgtgtaccgggtccgcctgcccggcggtgccgcggtggcgctcaaggcggtggactttagcggccacgatctgggcagctgcgtgcgcgagttcggggtacggaggggctgctatcggctggcggcccacaagctgcttaaggagatggtgctgctggagcggctgcggcaccccaacgtgctgcagctctatggctactgctaccaggacagcgaggacatcccagacaccctgaccaccatcacggagctgggcgcccctgtagaaatgatccagctgctgcaaacttcctgggaggatcgattccgaatctgcctgagcctgggccgcctcctccaccacctggcccactccccactgggctccgtcactctgctggacttccgccctcggcagtttgtgctggtggatggggagctcaaagtgacggacctggatgacgcacgtgtggaggagacgccgtgtgcaggcagcaccgactgcatactcgagtttccggccaggaacttcaccctgccctgctcagcccagggctggtgcgagggcatgaacgagaagcggaacctctataatgcctacaggtttttcttcacatacctcctgcctcacagtgccccgccttcactgcgtcctctgctggacagcatcgtcaacgccacaggagagctcgcctggggggtggacgagaccctggcccagctggagaaggtgctgcacctgtaccggagcgggcagtatctgcagaactccacggcaagcagcagtaccgagtaccagtgtatcccagacagcaccatcccccaggaagactaccgctgctggccatcctaccaccacgggagctgcctcctttcagtgttcaacctggctgaggctgtggatgtctgtgagagccatgcccagtgtcgggcctttgtggtcaccaaccagaccacctggacaggtcggcagctggtctttttcaagactggatggagccaagtggtccctgatcccaacaagaccacatatgtgaaggcctctggctgacctatctgagggctcggctgaccagctgactatcctcagcagctgggcttgcct

SEQ ID NO: 15717 - DNA, 563 bp, Homo sapiens
  ENST00000485578
gcccgcgcctgggctgcgccgcgcttcgcaacgtgtccggcgcgcagtacatgggctcaggctacaccaaggccgtgtaccgggtccgcctgcccggcggtgccgcggtggcgctcaaggcggtggactttagcggccacgatctgggcagctgcgtgcgcgagttcggggtacggaggggctgctatcggctggcggcccacaagctgcttaaggagatggtgctgctggagcggctgcggcaccccaacgtgctgcagctctatggctactgctaccaggacagcgaggacatcccagacaccctgaccaccatcacggagctgggcgcccctgtagaaatgatccagctgctgcaaacttcctgggaggatcgattccgagtgagctcagaggagggctcgggccctgggctccttgctaggatggttctgccttagaaggccagccctccaaagcagctcccactcctcctccacccagggagagggaggggaggaaggcgcacaggctgactcagccaccggccaaagggttcaaaaaagaagcaagacttaaaggat

SEQ ID NO: 15718 - DNA, 693 bp, Homo sapiens
  ENST00000492861
cggcccacaagctgcttaaggagatggtgctgctggagcggctgcggcaccccaacgtgctgcagctctatggctactgctaccaggacagcgaggacatcccagacaccctgaccaccatcacggagctgggcgcccctgtagaaatgatccagctgctgcaaacttcctgggaggatcgattccgaatctgcctgagcctgggccgcctcctccaccacctggcccactccccactgggctccgtcactctgctggacttccgccctcggcagtttgtgctggtggatggggagctcaaagtgacggacctggatgacgcacgtgtggaggagacgccgtgtgcaggcagcaccgactgcatactcgagtttccggccaggaacttcaccctgccctgctcagcccagggctggtgcgagggcatgaacgagaagcggaacctctataatgcctacaggtgacctccacccctgactcgggaactccatcgaaggagaatgggccaggagggcatggcaggaagagagccaacgtggaggccagctgggcagggagactcagccttgaccagagcaagggaaggcttctaccctgtccagaagggaacattcaggcctctgatggagaggctaaaaatagacagctccaaggagaatccgggttagggggtggcagctggaggcttcttaa

SEQ ID NO: 15719 - DNA, 725 bp, Homo sapiens
  ENST00000475868
ggggctgctccgacaccgggagtcagtcaggggataatgtggggctgggaggtgggcaagtcctgggaagggttgggaagcaggcccctggtttcggttagtatgaagttaggtgtggtgttagcatgtgcccagaaccctcccccgaggctgagtagacttcactgcgttctgcctggttgctaggcctgagggatccggctccctggccaggttagcgttctgccccaggttggaatagaggaaggatgtgtctccaaaggctggattcctgagccactggtttccctctgccacaggtttttcttcacatacctcctgcctcacagtgccccgccttcactgcgtcctctgctggacagcatcgtcaacgccacaggagagctcgcctggggggtggacgagaccctggcccagctggagaaggtgctgcacctgtaccggagcgggcagtatctgcagaactccacggcaagcagcagtaccggtgagtggccccaagctgatccacagggaagcaagaaacaggtgggagggtgaatgaccccgcccaattaggctaagtggctcaccctttctctggggacccttgtctccaaaggccactgtaggggctcacatagaatcatggaggggctgacatggactaatttgaggttccatctctagctgagctagagcaactataattctgccttcaacctggggttgggcactgatacccc

SEQ ID NO: 15720 - DNA, 773 bp, Homo sapiens
  ENST00000475241
tgcgttctgcctggttgctaggcctgagggatccggctccctggccaggttagcgttctgccccaggttggaatagaggaaggatgtgtctccaaaggctggattcctgagccactggtttccctctgccacaggtttttcttcacatacctcctgcctcacagtgccccgccttcactgcgtcctctgctggacagcatcgtcaacgccacaggtgagctctccagggcccatctgcttccaggcacctaccccacccccacccgccagcaaaagtggggagaaaaataacccagggcagcaggggttctagaaaccatcacttcctaaggtggcattctgccgcaacctccccgctcccccgccctctgttcactggggcacaggctctggaggcagaggtgggagcagctggctgctgacttcagggaggagtgggagccccaggcatcctgtcttagccacactgcactctgcaggagagctcgcctggggggtggacgagaccctggcccagctggagaaggtgctgcacctgtaccggagcgggcagtatctgcagaactccacggcaagcagcagtaccgagtaccagtgtatcccagacagcaccatcccccaggaagactaccgctgctggccatcctaccaccacgggagctgcctcctttcagtgttcaacctggctgaggctgtggatgtctgtgagagccatgcccagtgtcgggcctttgtggtcaccaaccagaccacctggacaggtgagccagtgg

SEQ ID NO: 15721 - DNA, 1447 bp, Homo sapiens
  ENST00000490302
tctgccacaggtttttcttcacatacctcctgcctcacagtgccccgccttcactgcgtcctctgctggacagcatcgtcaacgccacaggagagctcgcctggggggtggacgagaccctggcccagctggagaaggtgctgcacctgtaccggagcgggcagtatctgcagaactccacggcaagcagcagtaccgagtaccagtgtatcccagacagcaccatcccccaggaagactaccgctgctggccatcctaccaccacgggagctgcctcctttcagtgttcaacctggctgaggctgtggatgtctgtgagagccatgcccagtgtcgggcctttgtggtcaccaaccagaccacctggacaggtgagccagtgggagaagcccttccaagggagatggcaggacctctctggaggttgatagatagtgatcccccatcggaagtcagagggggtgctgaggtgatgagagagaggtatacgtgtcttcaaggcagtcaaattagggagaatggtcttgcctccagaaagagaaacatccagccctgttacctctcacctctgccccccaggtcggcagctggtctttttcaagactggatggagccaagtggtccctgatcccaacaagaccacatatgtgaaggcctctggctgacctatctgagggctcggctgaccagctgactatcctcagcagctgggcttgcctgtggagggagtgacttgcactggcagcactgcatgtcacctgggaacccctgcagacaaagctaacatcccagacagacagatgtgaccaggacaaacgtgcaataatgccaaatgttaaaatgtgagtttaccagcctagctatgggactgctggctcctagtccaggaatcatgggggtatgactgcctctccaaccctgtgggctgtaagcaagctcaggctagtctccccactgggggctgtgcccctccctgggacggttccgtgggcagccccatcactgtgttcaatagtgtgagaatgtagctaaagcccctgctgctgctgctgcacatgccacagcaggcggtgggggctgcgtggggacaatccatcgtggagtgttctctcagcttaggtctggacaggagacttggcgggagatgctccaggatgtgggtgattctgtacctggggaggctatctctgacctcccgacaggggacactcccaggccagcccaggggtcaggggcagaggtgcacacctcagcatgagccaagactggggtcagggagcaggtgtggtttgagccaggacctggggcgggggtggggccggggcctttctgcctcatttgctttcaatgaaagcctcaaagcagccaaaaccaggctttcccccttcctcgagtttgaatatccagaatcttttgtacttcttgttggttaaattgtttattttt

SEQ ID NO: 15722 - DNA, 765 bp, Homo sapiens
  ENST00000470578
tttttcttcacatacctcctgcctcacagtgccccgccttcactgcgtcctctgctggacagcatcgtcaacgccacaggctctggaggcagaggtgggagcagctggctgctgacttcagggaggagtgggagccccaggcatcctgtcttagccacactgcactctgcaggagagctcgcctggggggtggacgagaccctggcccagctggagaaggtgctgcacctgtaccggagcgggcagtatctgcagaactccacggcaagcagcagtaccgagtaccagtgtatcccagacagcaccatcccccaggaagactaccgctgctggccatcctaccaccacgggagctgcctcctttcagtgttcaacctggctgaggctgtggatgtctgtgagagccatgcccagtgtcgggcctttgtggtcaccaaccagaccacctggacaggtcggcagctggtctttttcaagactggatggagccaagtggtccctgatcccaacaagaccacatatgtgaaggcctctggctgacctatctgagggctcggctgaccagctgactatcctcagcagctgggcttgcctgtggagggagtgacttgcactggcagcactgcatgtcacctgggaacccctgcagacaaagctaacatcccagacagacagatgtgaccaggacaaacgtgcaataatgccaaatgttaaaatgtgagtttaccagcctagctatgggactgctggctcctagtccaggaa

SEQ ID NO: 15723 - DNA, 787 bp, Homo sapiens
  ENST00000480099
ctcctgcctcacagtgccccgccttcactgcgtcctctgctggacagcatcgtcaacgccacaggaagactaccgctgctggccatcctaccaccacgggagctgcctcctttcagtgttcaacctggctgaggctgtggatgtctgtgagagccatgcccagtgtcgggcctttgtggtcaccaaccagaccacctggacaggtcggcagctggtctttttcaagactggatggagccaagtggtccctgatcccaacaagaccacatatgtgaaggcctctggctgacctatctgagggctcggctgaccagctgactatcctcagcagctgggcttgcctgtggagggagtgacttgcactggcagcactgcatgtcacctgggaacccctgcagacaaagctaacatcccagacagacagatgtgaccaggacaaacgtgcaataatgccaaatgttaaaatgtgagtttaccagcctagctatgggactgctggctcctagtccaggaatcatgggggtatgactgcctctccaaccctgtgggctgtaagcaagctcaggctagtctccccactgggggctgtgcccctccctgggacggttccgtgggcagccccatcactgtgttcaatagtgtgagaatgtagctaaagcccctgctgctgctgctgcacatgccacagcaggcggtgggggctgcgtggggacaatccatcgtggagtgttctctcagcttaggtctggacaggagacttggcgggagatgctccaggatgtgggtg

SEQ ID NO: 15724 - DNA, 4163 bp, Homo sapiens
  ENST00000396418
atccataatccagcgatgctgcagctgtaaaagcattaatagaaaatcaatccacaacctcgcggggcagcgatcgtcgagcgccgtttccaggctgccttccctggggtcgggagcggccccgctccccccgtggctggcgcggaatgtggtgatccgtcccggggcggggatgacttcatgcagccggagctccgcggcgggagcggaggctgctgctggcaggtggggcgcgggccggcgcgagctgaccgagcactcggcgggcgcggcgggactgcggcccgtggcggcgtgcgcggggacctgcgctgactaggtccggggaagtttcctgactttctgagaagccctggtttccccaaagaagtgatttctgatagaaatctgaaggtcatctccaagaaaaaagagatctagtatagtcaatgaattaaagacaagaaggtttccaatcagtccctgctatgtggatatttggtagcaatgactgatgtggaaactacatatgcagattttattgcttcaggaagaacaggtagaagaaatgcaatacatgatatcctggtttcctctgcaagtggcaacagcaatgaattagccttgaaattagcaggtcttgatatcaacaagacagaaggtgaagaagatgcacaacgaagttctacagaacaaagtggggaagcccagggagaagcagcaaaatctgaaagctaacaccccactttgaccctcgaccacacctgaaaatgtctcaaatctccaggagtatctggaatgcatttgtttccatgagtgaaaagaggaaaaagaaaatggctgtgctgcattgcaggaacctgctcattatcatgttaaaaatgagggcagaggctgtggctgcaggcagacttttccctacctctgtcattagcaatggttgaaatcatgtggcttgtgtttgggcgtcatttttgtatggatcctttcacttgatcatatgacgaaatgcttatagagagtagctccgacctagatgatgattcttcctgtagcatctggcccctcacaatgtcagaggatttaattgtgtctaattgcgaagggttgattgaaccccagagtttaaatatctctggctcaagtgttcacccagtaaaagaaagatccagaaagcactgtttttagcattacgtatctgtgtgttactgctgtgttatttacactgttttgtattgtacaatatatatgctcagcactgcccccttctctgattgcttatgaaaaacaaaatgatgtacattactgtgaatttttataccactcatttttaaaagggctgtcttttcattttagttttccatactgtggtggtgtacacaggatagaacacccttttttaaaacacagtctttccccttgctcattgtatgttgatgagttgattaagtctaacagattcatcaagactccattgctttattatagagacatttgaaaatatccattaatgtgaatatcacctgaattcagtctgtttggtgtctgcacagactggaattcaatctgtcaaatttgttttattctcaagtggagaacttctcccacataatatatatatatatatatattttaatttatgagaattttggacaattggaaaggtagaaaagaaaagccaagatcatactaaggactggaaatattttgttctatggaatcaaatttctcacaatgctgtatgatactatttaaatttggaggacaacttatcttcactaagctgaatcaggtggagaaagtaatctccttgcaatcatgtggacaccaatcacaaaagtaaagccctggtgttgtgttttcatgtcttttttcagccctctcagatccaaatgttattatgcactttttaatgtttgtaaacttttactaataattagtgtgaattgcattctgatacaataatgattatcattagaagctaacaaaattctcattaatactgtgtttgatggcctctgctgtgttttaacatcgtgcttcttatatggaaagtttttgtgagctgtgtaatccctctggtcagtattatgaaatcatttgtcagtggtaataaataaggaaccagtaatatgccaatggttcatgaattactggacaaatagcagacaatgggagtccctttacaataacgagcccacttagctgtccttgagggcttagataccttgccacgtgaagtaggtagagcagcatttcaataggtaatttgtgtggttgtgccagaaactcagcccttctatgtaattacatacaggataaaaggtaagtctgctcacttctccttctacagggcatttcaactgactggaataagggcatggttgcatttagtactcaatcagatattactagaaaaaaaattaataatgtgagcctttccgagagcagaacgaggaaagattaaattttagaatgcttccttctgtctaatccatcaggggccaaaatgcccagtaaaattcaaacacatcacctattaatagacttacaagtgagaaaagaggttcctagggttattttaggcaatccctggtaaactgtttaaaccatcaaacccctacagtcagttttcagtatcctcatttaatattttaataggtttcttgtgaatttaaacttctcttctttcttaaggttgtgaaattccaaactgattttatgtgattttgaaaagtttagaaccagtgctgagtctatgtggagggtttatattcctatgtgatatactgttattaatgcatgtggtgccatgcttgtctttaaatatataaatagtgctaaattgcaaagtcatatggagctttggatttagtttgacttcttactactgctttgtctgctatattcaaacccaaaggcattcccaagctagggagataaaaattaattttctaaaatgtccacatcctatacattttgcttattcatggcatctttcaaattttattttagtttcctttatttgccaagaatacatatggatttgaatttttaaggagagaaggaaagggtaggaaaccagggccttgggtttagtaacaggcattggatgtctattaaccaactattcttacgctaatggctttgcagctcctattctcccatttgatcctcaaacaattctattagagtggtatttttatccaatttcacagattaaaatataagcactcaataaaatataacctttagaagcttaaaaagctagtaagtgatgaactgaggatttgaacccatgtttgtcaccaaggagctttccagggcacatgtcataaaattagagccaactgcagagctgtaagggaacttttagagatgaacttcttcagcctccatattttacagaaggaaactgaatcccagaaggagaaattgccgttctcaaggctccctggatgggtaataacacagatatgagtaggtcacataaagtatatcttttttaaaaaaaagaaattcaattatgtcttatttggggggtatatttcccagaagatatttttctggcatgtggtctgtaaacacagcatgattcatattttttatgtttcatgctactcattttgtttaattaccaacaaacatggggactttggctttttgacttatttgcaacaagcatgaaattgttaaatttaccttttatcaattgtaatcatcctatgccaacatattatcataaattcatagaaatatttttaaaaataaataacagacattgaaatccaattcttagataatactcccagaacagccaatggtaaatgccctatacttgagtcttacttagatgctgtggtaatgcaccattttagaagatgaatgatactgctatttctcttcagggaaacaataatggataaagaaatgtaactgccgggcagcaaagcttctaagtgaaacctgtagtagcagtagtagtagggagaaaatgtgtagtcatcaagtgaaaataggaaaggatctatgatttatgatgtcttaatagaccctaaattgttctttaattacaagagtggcagtctctgaagtcatttgtgagcttgtatgacttttgtatttagcaatgttgcatgctcacataattgaaaattaaaagtaacacatttttctgaaatgta

SEQ ID NO: 15725 - DNA, 1736 bp, Homo sapiens
  ENST00000352966
tgctggcaggtggggcgcgggccggcgcgagctgaccgagcactcggcgggcgcggcgggactgcggcccgtggcggcgtgcgcggggacctgcgctgactaggtccggggaagtccctgctatgtggatatttggtagcaatgactgatgtggaaactacatatgcagattttattgcttcaggaagaacaggtagaagaaatgcaatacatgatatcctggtttcctctgcaagtggcaacagcaatgaattagccttgaaattagcaggtcttgatatcaacaagacagaaggtgaagaagatgcacaacgaagttctacagaacaaagtggggaagcccagggagaagcagcaaaatctgaaagctaacaccccactttgaccctcgaccacacctgaaaatgtctcaaatctccaggagtatctggaatgcatttgtttccatgagtgaaaagaggaaaaagaaaatggctgtgctgcattgcaggaacctgctcattatcatgttaaaaatgagggcagaggctgtggctgcaggcagacttttccctacctctgtcattagcaatggttgaaatcatgtggcttgtgtttgggcgtcatttttgtatggatcctttcacttgatcatatgacgaaatgcttatagagagtagctccgacctagatgatgattcttcctgtagcatctggcccctcacaatgtcagaggatttaattgtgtctaattgcgaagggttgattgaaccccagagtttaaatatctctggctcaagtgttcacccagtaaaagaaagatccagaaagcactgtttttagcattacgtatctgtgtgttactgctgtgttatttacactgttttgtattgtacaatatatatgctcagcactgcccccttctctgattgcttatgaaaaacaaaatgatgtacattactgtgaatttttataccactcatttttaaaagggctgtcttttcattttagttttccatactgtggtggtgtacacaggatagaacacccttttttaaaacacagtctttccccttgctcattgtatgttgatgagttgattaagtctaacagattcatcaagactccattgctttattatagagacatttgaaaatatccattaatgtgaatatcacctgaattcagtctgtttggtgtctgcacagactggaattcaatctgtcaaatttgttttattctcaagtggagaacttctcccacataatatatatatatatatatattttaatttatgagaattttggacaattggaaaggtagaaaagaaaagccaagatcatactaaggactggaaatattttgttctatggaatcaaatttctcacaatgctgtatgatactatttaaatttggaggacaacttatcttcactaagctgaatcaggtggagaaagtaatctccttgcaatcatgtggacaccaatcacaaaagtaaagccctggtgttgtgttttcatgtcttttttcagccctctcagatccaaatgttattatgcactttttaatgtttgtaaacttttactaataattagtgtgaattgcattctgatacaataatgattatcattagaagctaacaaaattctcattaatactgtgtttgatggcctctgctgtgttttaacatcgtgcttcttatatggaaagtttttgtgagctgtgtaatccctctggtcagtattatgaaatcattt

SEQ ID NO: 15726 - DNA, 588 bp, Homo sapiens
  ENST00000518467
aacttctagaatccatcgatgtggaacacttcagtttgtttaacgtaggagactccctgctatgtggatatttggtagcaatgactgatgtggaaactacatatgcagattttattgcttcaggaagaacaggtagaagaaatgcaatacatgatatcctggtttcctctgcaagtggcaacagcaatgaattagccttgaaattagcaggtcttgatatcaacaagacagaaggtgaagaagatgcacaacgaagttctacagaacaaagtggggaagcccagggagaagcagcaaaatctgaaagctaacaccccactttgaccctcgaccacacctgaaaatgtctcaaatctccaggagtatctggaatgcatttgtttccatgagtgaaaagaggaaaaagaaaatggctgtgctgcattgcaggaacctgctcattatcatgttaaaaatgagggcagaggctgtggctgcaggcagacttttccctacctctgtcattagcaatggttgaaatcatgtggcttgtgtttgggcgtcatttttgtatggatcctttcacttgatcatatgacgaaatgctta

SEQ ID NO: 15727 - DNA, 2308 bp, Homo sapiens
  ENST00000431515
agtcctccgcccgggcgtccggaacagtcgacggcagactccggcccgctgagccacccgaggggtcccgtggcctccgcggacccggaatctgggccctcgcggacccgcgccccgcccagtcgccccagggcttccccacacccacggagtgaagtcagccgcggccctgcctgggaggaacttaccgtctaccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggccttcactctcccctgaggctgtcctggcccggactgtggggagcacctccaccccccggagcaggtgcacacccagggtcttaacgcccctgaggctgagccctgctgcagaacccagcgctcctggccttgggccagcagctgaagccccatgctgtgtggagcaaagaggtttcctgagcaggcacatcccccggtccttctctgcattccaggcagctccaccaaagtctgcgtgcaacgcccttcatttgcatggacacacgcaaccctcggcgtttgtatggtcattaacatgctcctcccaccacggaagaactttcgaggcccgtaccaaagtagatcctttattcaaaatctgtgggggttttttgactgtttttgctgacctgtgacctctcactgaggacggcagtccaggaccacccccagaggggttcaaagacctccgaaaccagagaccacccccacatacaggtccatggagagggcctggaccatctggacccccacggtcaggccaagtcccagataatagcaccagatgtttcctgtccgacttttggtctccccaaggcgaccagaggccgagctgcccctacacaggcgc

SEQ ID NO: 15728 - DNA, 360 bp, Homo sapiens
  ENST00000572832
tctgggtcctgcgggctgcgctagagtgaccctggcacctcgcgtccctcagaactgtgcatccgggctttccgcgtgacacccaggtctccgtacctttgggcacccaccctcgggggcatagtcctgccacctagccctaccctgcagacggggctctgtccaaggtgctgccggacgggtccggcctacatccggtccttctctgcattccaggcagctccaccaaagtctgcgtgcaacgcccttcatttgcatggacacacgcaaccctcggcgtttgtatggtcattaacatgctcctcccaccacggaagaactttcgaggcccgtaccaaagtagatcctttattcaaaatc

SEQ ID NO: 15729 - DNA, 479 bp, Homo sapiens
  ENST00000574333
acatttactaaaagtttatttcaaatctgcctccaagtccatgtgttctgaaaaggacagagggggtcagtccacagggaagaacgggtgaacagggctcctgctgagacatctcatgagctggaagcatccaaggagccagccccttgcagacgagttgggaggaacacctggtgttgctaactctaggaggctgctgtgggcaggctggcatggcagctcagtcccggggacaggcgtggtgggcagcccagagcaggtcgggcacgacgccggcgtgcagctgcaggatggagcccacgctcagcaggtgcatgatctggtgggagttgccccagtagtcaaagcggccaggtccccagcgctcgggcagacgggctacatttaccagtcccccaagcagcgccagtgcgtccatgcgcaggtagcagggcagggagcctggagcccctgaacccagacccactccccgggcccca

SEQ ID NO: 15730 - DNA, 2061 bp, Homo sapiens
  ENST00000440027
agtcgacggcagactccggcccgctgagccacccgaggggtcccgtggcctccgcggacccggaatctgggccctcgcggacccgcgccccgcccagtcgccccagggcttccccacacccacggagtgaagtcagccgcggccctgcctgggaggaacttaccgtctaccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctaggccctggacaccctccttgtctcgcctgccctcctgcaggccttcactctcccctgaggctgtcctggcccggactgtggggagcacctccaccccccggagcaggtgcacacccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttgggagcacccaagcttgctcatgtggcaa

SEQ ID NO: 15731 - DNA, 2171 bp, Homo sapiens
  ENST00000262300
gagcctcggagcccgggcacccctgacgggctgcactggggagggggaggagcctcgaggccggtttggaatttttggcgcgagcagctccgcgcgcgttcacgggccgttccccctcacgggagtcctccgcccgggcgtccggaacagtcgacggcagactccggcccgctgagccacccgaggggtcccgtggcctccgcggacccggaatctgggccctcgcggacccgcgccccgcccagtcgccccagggcttccccacacccacggagtgaagtcagccgcggccctgcctgggaggaacttaccgtctaccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggccttcactctcccctgaggctgtcctggcccggactgtggggagcacctccaccccccggagcaggtgcacacccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttgggagcacccaagcttgctcatgtggcaa

SEQ ID NO: 15732 - DNA, 605 bp, Homo sapiens
  ENST00000575040
agccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggccttcactctcccctgaggctgtcctggcccggactgtggggagcacctccaccccccggagcaggtgcacacccaggtaagcaggtccaggggctggggtgggcagggctagcttttggatcctgagtgtcactactctctcctcccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttgggagcacccaagcttgctcatgtggc

SEQ ID NO: 15733 - DNA, 910 bp, Homo sapiens
  ENST00000575981
cccttccccctgcttccgcccctccctgactgatgaagacagcagccctctcccacccacctccaagaggcagccctggactgggtctgtgtcccagggccaaccctgcccctttctgtccccatcccgtccctgccagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggccttcactctcccctgaggctgtcctggcccggactgtggggagcacctccaccccccggagcaggtgcacacccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttgggagcaccc

SEQ ID NO: 15734 - DNA, 717 bp, Homo sapiens
  ENST00000574680
ggaaaccacacgctcagggcagacagctcttggggactctgccgttagccccttccttacaaacacatcacctcatccctcggggcacttgatagcagacaagaagttccagaaaggcttacatttactaaaagtttatttcaaatctgcctccaagtccatgtgttctgaaaaggacagagggggccttggagtgcagccagatggaaggactttgaaggctgtccaagtgctgctttcagagtgcaccaagtttttattgtccctgactgtggctccctgcctgtttgtcaggcgggagcctggagcctgcacagggacagagctggtttcatccggcactccctagccctggacaccctccttgtctcgcctgccctcctgcaggccttcactctcccctgaggctgtcctggcccggactgtggggagcacctccaccccccggagcaggtgcacacccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttgggagca

SEQ ID NO: 15735 - DNA, 1892 bp, Homo sapiens
  ENST00000574385
ctcacgggagtcctccgcccgggcgtccggaacagtcgacggcagactccggcccgctgagccacccgaggggtcccgtggcctccgcggacccggaatctgggccctcgcggacccgcgccccgcccagtcgccccagcccgtccactgctctgttcgccagggcttccccacacccacggagtgaagtcagccgcggccctgcctgggaggaacttaccgtctaccgggaaaggtggccagcagatgtgtcgggcctggtgagaggggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggccttcactctcccctgaggctgtcctggcccggactgtggggagcacctccaccccccggagcaggtgcacacccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttg

SEQ ID NO: 15736 - DNA, 1806 bp, Homo sapiens
  ENST00000574730
cacgggccgttccccctcacgggagtcctccgcccgggcgtccggaacagtcgacggcagactccggcccgctgagccacccgaggggtcccgtggcctccgcggacccggaatctgggccctcgcggacccgcgccccgcccagtcgccccagggcttccccacacccacggagtgaagtcagccgcggccctgcctgggaggaacttaccgtctaccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacgctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggccttcactctcccctgaggctgtcctggcccggactgtggggagcacctccaccccccggagcaggtgcacacccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctgg

SEQ ID NO: 15737 - DNA, 1891 bp, Homo sapiens
  ENST00000573944
ccggtttggaatttttggcgcgagcagctccgcgcgcgttcacgggccgttccccctcacgggagtcctccgcccgggcgtccggaacagtcgacggcagactccggcccgctgagccacccgaggggtcccgtggcctccgcggacccggaatctgggccctcgcggacccgcgccccgcccagtcgccccagggcttccccacacccacggagtgaagtcagccgcggccctgcctgggaggaacttaccgtctaccgggaaaggtggccagcagatgtgtcgggcctggtgagaggggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggccttcactctcccctgaggctgtcctggcccggactgtggggagcacctccaccccccggagcaggtgcacacccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcct

SEQ ID NO: 15738 - DNA, 1991 bp, Homo sapiens
  ENST00000382240
actgccattctggaagtggacaccactaactgggttttggcacgacagttatgaaaaagaaagacacttgagggattccgggttttcactttggaattggagataagggatcgtgggcccgtgtagtctcggaagaggttgtgtagtttaggatcaaagagctggccgtgatgagggcagggatgcaggcgcagcccgtctgactccaaactgccttgctcttaacccgactgcaagaccctcaagaacacgggccccatggttttcctcttatgtttctatcatctctaaaatacaacagcctggtgggcagggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctaggtccatgtgttctgaaaaggacagagggggccttggagtgcagccagatggaaggactttgaaggctgtccaagtgctgctttcagagtgcaccaagtttttattgtccctgactgtggctccctgcctgtttgtcaggcgggagcctggagcctgcacagggacagagctggtttcatccggcactccctagccctggacaccctccttgtctcgcctgccctcctgcaggccttcactctcccctgaggctgtcctggcccggactgtggggagcacctccaccccccggagcaggtgcacacccagggatgccctggacctaagtgacatcaactcagagcctcctcggggctccttcccctcctttgagcctcgg

SEQ ID NO: 15739 - DNA, 1091 bp, Homo sapiens
  ENST00000576268
acgggccgttccccctcacgggagtcctccgcccgggcgtccggaacagtcgacggcagactccggcccgctgagccacccgaggggtcccgtggcctccgcggacccggaatctgggccctcgcggacccgcgccccgcccagtcgccccagggcttccccacacccacggagtgaagtcagccgcggccctgcctgggaggaacttaccgtctaccgggaaaggtggccagcagatgtgtcgggcctgggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgg

SEQ ID NO: 15740 - DNA, 1006 bp, Homo sapiens
  ENST00000574415
gggccctcgcggacccgcgccccgcccagtcgccccaggtgagcccagaccccgccgtgaggggcctcggcgtggccacctcgccgctcccctccgcctcgccagggcttccccacacccacggagtgaagtcagccgcggccctgcctgggaggaacttaccgtctaccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaagctgctttttccacctcgtgacacatccaagaggtcccctggggtcagtgcaggtcggccctggctcctccgtcgctgggtctccacagacccagcccgagggatggaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagg

SEQ ID NO: 15741 - DNA, 979 bp, Homo sapiens
  ENST00000575632
gtttggaatttttggcgcgagcagctccgcgcgcgttcacgggccgttccccctcacgggagtcctccgcccgggcgtccggaacagtcgacggcagactccggcccgctgagccacccgaggggtcccgtggcctccgcggacccggaatctgggccctcgcggacccgcgccccgcccagtcgccccagcccgtccactgctctgttcgccagggcttccccacacccacggagtgaagtcagccgcggccctgcctgggaggaacttaccgtctaccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctg

SEQ ID NO: 15742 - DNA, 880 bp, Homo sapiens
  ENST00000572059
cgtccggaacagtcgacggcagactccggcccgctgagccacccgaggggtcccgtggcctccgcggacccggaatctgggccctcgcggacccgcgccccgcccagtcgccccaggtgagcccagaccccgccgtgaggggcctcggcgtggccacctcgccgctcccctccgcctcgccagggcttccccacacccacggagtgaagtcagccgcggccctgcctgggaggaacttaccgtctaccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggcc

SEQ ID NO: 15743 - DNA, 495 bp, Homo sapiens
  ENST00000572619
agcccagaccccgccgtgaggggcctcggcgtggccacctcgccgctcccctccgcctcgccagcccgtccactgctctgttcgccagggcttccccacacccacggagtgaagtcagccgcggccctgcctgggaggaacttaccgtctaccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacggcctcctgcactggccatgcccatgcccacggagggcaccccgccacctctgagtggcacccccatcccagtcccagcctacttccgccacgcagaacctggattctccctcaagaggcccagggggctcagccggagcct

SEQ ID NO: 15744 - DNA, 612 bp, Homo sapiens
  ENST00000570649
agcagctccgcgcgcgttcacgggccgttccccctcacgggagtcctccgcccgggcgtccggaacagtcgacggcagactccggcccgctgagccacccgaggggtcccgtggcctccgcggacccggaatctgggccctcgcggacccgcgccccgcccagtcgccccagggcttccccacacccacggagtgaagtcagccgcggccctgcctgggaggaacttaccgtctaccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacgtaagtcgtagggcagggacggtgggagaactgggttaagatgcacaggcccaggtccccgagtgtgccagggttgggcctggaggctgtgcttgtgaccagtgacctccaggatcccaacaccctggctcctgacttggagaaaccctgggctgggactctgaggtagttagag

SEQ ID NO: 15745 - DNA, 551 bp, Homo sapiens
  ENST00000572658
aacagtcgacggcagactccggcccgctgagccacccgaggggtcccgtggcctccgcggacccggaatctgggccctcgcggacccgcgccccgcccagtcgccccagcccgtccactgctctgttcgccagggcttccccacacccacggagtgaagtcagccgcggccctgcctgggaggaacttaccgtctaccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacgtaagtcgtagggcagggacggtgggagaactgggttaagatgcacaggcccaggtccccgagtgtgccagggttgggcctggaggctgtgcttgtgaccagtgacctccaggatcccaacaccctggctcctgacttggagaaaccctgggc

SEQ ID NO: 15746 - DNA, 846 bp, Homo sapiens
  ENST00000571102
ggcgggggcgtcaggacggcggcgctgggaggctcctcccgggccctcctcatcgcagtcaacaccatctcccggctgggtgctggcgggagggggttcccagggcgctgggattacagaggccggacaccatgctccctacccctggggctcagagggattaagcaggctcagaccctactctgctcccctctcctgacccggcccccacccgccgggaaaacggaagctggcagcgcggcccgggacaatggcagctttgtcaccgcggctactggcggtgccagggccggggcagccctggacttgggcgctggggccctcctcggcctcagtgcccccggcccaacgcaggtccttctctgcattccaggcagctccaccaaagtctgcgtgcaacgcccttcatttgcatggacacacgcaaccctcggcgtttgtatggtcattaacatgctcctcccaccacggaagaactttcgaggcccgtaccaaagtagatcctttattcaaaatctgtgggggttttttgactgtttttgctgacctgtgacctctcactgaggacggcagtccaggaccacccccagaggggttcaaagacctccgaaaccagagaccacccccacatacaggtccatggagagggcctggaccatctggacccccacggtcaggccaagtcccagataatagcaccagatgtttcctgtccgacttttggtctccccaaggcgaccagaggccgagctgcccctacacaggcgcaaggccgaggcagggcgcagcacagcatctcaggtgtccatctcgccggcggcgggcccagcggaccctcggggccca

SEQ ID NO: 15747 - DNA, 1709 bp, Homo sapiens
  ENST00000530517
gggtccctgtgccgctgacgtcccgagcagtgctgggaagtataggctgtgttgtcacgccggtgtcagtctgatgaagattggcatcaggtgaagtctggagcaggacttctgaggctttctatcctccatgctgctcactagaaaaggggctgtgaactgtgctttggctctagcagacaggaagaaattctggcccagctggaagtagaaagaggggagtgagtctcctgaggaccatctcagaggccccgggatcacccgaacaatgacggcaaccgcccagccaccctccaaggcccaggctgtccacatctctgccccctcagctgctgccagcacacctgtgcccagtgcccccatcgacccccaggcccagctggaggctgacaagcgagctgtatacaggcaccctcttttcccgctcctgacgctgctgtttgagaaatgtgaacaggccacccagggctctgagtgcatcacctccgccagctttgatgtggacatcgagaactttgtccaccagcaggaacaggagcacaaacccttcttcagcgatgacccagaactggacaatctgatggtgaaggcaatccaggtcctgagaatccacctgctggagctggagaaagtcaatgaactctgcaaggacttttgtaaccgttacatcacctgcctcaaaaccaagatgcacagcgacaacctgctcaggaatgatctaggggggccctactcccccaaccagccctccatcaaccttcactcacaggacctcctgcagaattcccccaattccatgtccggagtctccaataacccccaggggattgtggtcccagcctcagcgctccagcagggcaacatcgccatgacaaccgtcaactcacaagttgtgtcaggtggagccttataccaaccggttaccatggtaacctcccagggtcaggtggtcacccaagcaatcccccagggagccatccagatccagaacacacaggttaaccttgacctcacctccctcctggacaatgaggataagaagtccaagaacaaacgaggagtcttgcccaagcatgccaccaatataatgcgttcttggctcttccagcatctcatgcacccctaccccacggaggatgagaagaggcagatcgcagcccagaccaacctcaccctcctgcaagtaaacaactggttcatcaatgcccggaggcgcatcctgcagcccatgcttgatgccagcaacccagatcctgcccccaaagccaagaagatcaagtctcagcaccggcccacccaaagattctggcccaactccatcgctgcgggggtgctgcagcagcagggcggtgccccagggacaaaccccgatggttccatcaacttggacaacctgcagtccctgtcctcagacagtgccaccatggccatgcagcaggctatgatggctgcacacgatgactcattggatgggacagaagaagaggatgaggatgagatggaagaggaggaggaggaggagctggaggaggaggtcgacgagctgcagacgacaaatgtcagcgacctgggcttggaacacagtgactccctggagtagtcgggcagcccagatggcactgatcactgagcaggagaggagtgtcgccgggaggccttcagggtgggggggaaggggacatgggcaggaagcaccgagggagttgggc

SEQ ID NO: 15748 - DNA, 1673 bp, Homo sapiens
  ENST00000531116
gtgccgctgacgtcccgagcagtgctgggaagtataggctgtgttgtcacgccggtgtcagtctgatgaagattggcatcaggtgctttggctctagcagacaggaagaaattctggcccagctggaagtagaaagaggggagtgagtctcctgaggaccatctcagaggccccgggatcacccgaacaatgacggcaaccgcccagccaccctccaaggcccaggctgtccacatctctgccccctcagctgctgccagcacacctgtgcccagtgcccccatcgacccccaggcccagctggaggctgacaagcgagctgtatacaggcaccctcttttcccgctcctgacgctgctgtttgagaaatgtgaacaggccacccagggctctgagtgcatcacctccgccagctttgatgtggacatcgagaactttgtccaccagcaggaacaggagcacaaacccttcttcagcgatgacccagaactggacaatctgatggtgaaggcaatccaggtcctgagaatccacctgctggagctggagaaagtcaatgaactctgcaaggacttttgtaaccgttacatcacctgcctcaaaaccaagatgcacagcgacaacctgctcaggaatgatctaggggggccctactcccccaaccagccctccatcaaccttcactcacaggacctcctgcagaattcccccaattccatgtccggagtctccaataacccccaggggattgtggtcccagcctcagcgctccagcagggcaacatcgccatgacaaccgtcaactcacaagttgtgtcaggtggagccttataccaaccggttaccatggtaacctcccagggtcaggtggtcacccaagcaatcccccagggagccatccagatccagaacacacaggttaaccttgacctcacctccctcctggacaatgaggataagaagtccaagaacaaacgaggagtcttgcccaagcatgccaccaatataatgcgttcttggctcttccagcatctcatgcacccctaccccacggaggatgagaagaggcagatcgcagcccagaccaacctcaccctcctgcaagtaaacaactggttcatcaatgcccggaggcgcatcctgcagcccatgcttgatgccagcaacccagatcctgcccccaaagccaagaagatcaagtctcagcaccggcccacccaaagattctggcccaactccatcgctgcgggggtgctgcagcagcagggcggtgccccagggacaaaccccgatggttccatcaacttggacaacctgcagtccctgtcctcagacagtgccaccatggccatgcagcaggctatgatggctgcacacgatgactcattggatgggacagaagaagaggatgaggatgagatggaagaggaggaggaggaggagctggaggaggaggtcgacgagctgcagacgacaaatgtcagcgacctgggcttggaacacagtgactccctggagtagtcgggcagcccagatggcactgatcactgagcaggagaggagtgtcgccgggaggccttcagggtgggggggaaggggacatgggcaggaagcaccgagggagttgggccctagcttccccaaatcagtagcttgaagaaaggcaaaggaga

SEQ ID NO: 15749 - DNA, 3687 bp, Homo sapiens
  ENST00000298282
gtcccgagcagtgctgggaagtataggctgtgttgtcacgccggtgtcagtctgatgaagattggcatcaggtgaagtctggagcaggacttctgaggctttctatcctccatgctgctcactagaaaaggggctgtgaactgtgctttggctctagcagacaggaagaaattctggcccagctggaagtagaaagaggggagtgagtctcctgaggaccatctcagaggccccgggatcacccgaacagtcctccatgtgaatcaatcccatgatgcaacatgcctccccagcccccgctctgacgatgatggccacgcagaatgtcccgcccccaccctaccaggacagcccacagatgacggcaaccgcccagccaccctccaaggcccaggctgtccacatctctgccccctcagctgctgccagcacacctgtgcccagtgcccccatcgacccccaggcccagctggaggctgacaagcgagctgtatacaggcaccctcttttcccgctcctgacgctgctgtttgagaaatgtgaacaggccacccagggctctgagtgcatcacctccgccagctttgatgtggacatcgagaactttgtccaccagcaggaacaggagcacaaacccttcttcagcgatgacccagaactggacaatctgatggtgaaggcaatccaggtcctgagaatccacctgctggagctggagaaagtcaatgaactctgcaaggacttttgtaaccgttacatcacctgcctcaaaaccaagatgcacagcgacaacctgctcaggaatgatctaggggggccctactcccccaaccagccctccatcaaccttcactcacaggacctcctgcagaattcccccaattccatgtccggagtctccaataacccccaggggattgtggtcccagcctcagcgctccagcagggcaacatcgccatgacaaccgtcaactcacaagttgtgtcaggtggagccttataccaaccggttaccatggtaacctcccagggtcaggtggtcacccaagcaatcccccagggagccatccagatccagaacacacaggttaaccttgacctcacctccctcctggacaatgaggataagaagtccaagaacaaacgaggagtcttgcccaagcatgccaccaatataatgcgttcttggctcttccagcatctcatgcacccctaccccacggaggatgagaagaggcagatcgcagcccagaccaacctcaccctcctgcaagtaaacaactggttcatcaatgcccggaggcgcatcctgcagcccatgcttgatgccagcaacccagatcctgcccccaaagccaagaagatcaagtctcagcaccggcccacccaaagattctggcccaactccatcgctgcgggggtgctgcagcagcagggcggtgccccagggacaaaccccgatggttccatcaacttggacaacctgcagtccctgtcctcagacagtgccaccatggccatgcagcaggctatgatggctgcacacgatgactcattggatgggacagaagaagaggatgaggatgagatggaagaggaggaggaggaggagctggaggaggaggtcgacgagctgcagacgacaaatgtcagcgacctgggcttggaacacagtgactccctggagtagtcgggcagcccagatggcactgatcactgagcaggagaggagtgtcgccgggaggccttcagggtgggggggaaggggacatgggcaggaagcaccgagggagttgggccctagcttccccaaatcagtagcttgaagaaaggcaaaggagacacctgttccttcccaaccaccgagcttcaatgaggaccccagccccacttccctggaactgccgaggactctgtttggcggggccagtcgagcagcctgtgtggaaagacaggagtgagatctggactcaccaaatccctgaggatagatggcacccatggcccccacccacggaaggacttgagttgtttacaagccctgcactgaggcagattggtgctgttcgcagagtaggcctttgcccgggggcagacttagaaggaaggggagagacaaagggggactgagtttcatccccagaagtttctcagctcctttgacagacattcaagggcaggagggagccccaaagcataaccagtggccagaggagtgggagggcctgaggcatcacatcttgcagatcagaatgggatggaatccaccaggctccagctcatccctccaaggccctgtctctgcgcacagcaaccatggacatgggagaaagggatgggagccacagtgcccttcactctctcctggaaaccaactgtaagctggtgggctcaacctgtgggaggttaagaggagtcccttctgggttgactccaagagccaaggagatggcagaccctgggctaggaaccatatggaggtgactttgaggccacagctgtccctaggtgatcacagaacttagctcctttaacaacaggacaatggttttttaccctagatgttcccaccttcagtgctccacgccctccatagaccttcagagaaggtgaaaccaggttatctgggaatctttccagcccgcaggtcgccacggccatccctttgctcccagcctggctccatcagcctccagcttcctttcttcattctgtccttcagggaaggcagaagaaacattggaaagcatctagtccagtgggaagccaggggttggagaaggtgctacatccctcttcccatcaatatcctaaatgtgggggagggcccagagaatggcacccaagagcctgcggggatgcccatcccacacaccccacccagctgttctaaccctgctatccacagccctggaggaactggggctcctggaaggaggaggaggctctccactgtccaccctaacacataccctcccacccaccttccagacccccttggttggcaccctctcctccggttccctctcaccccatggctgtgaatgacaggacaggtcacacgtgtgttttccattgggtttaatttaatggacgtgcagtttcatttgtaaattgtgcattggccacctccttcagtggcaggatgtgagtggctacctggctcaactggaggggaccccttgggccctctggggcttcccctcccccacctggttggggtagagcaaaaggatggtcactcttccgaggtctccctgaaatgaatgtatttctcccccaaaagagctgatatttaatgttttaataaggatttttgagaaacaaataaccttatttataatctgggtgatccaatcattttttactcccttttgatgccatacatagaggaaagtctagcttttttggcgtgagacttttgcaatgtgcagtgggataaaatgcatttccttttctggttcgtttttcttgttaacacgcgcacacagacacacacacacaccgttccactcaccacctggacaggcgtcccccagcacggacacactggcacacaggtgcccacatctcttcctctcagcccctccacctgcctaatgttatgcaacctccttctgatgtatccaccaaaccagtactgaatgtggccgagacgttttcagtaaatcttattacctaccgtaa

SEQ ID NO: 15750 - DNA, 588 bp, Homo sapiens
  ENST00000559662
gtataggctgtgttgtcacgccggtgtcagtctgatgaagattggcatcaggtgaagtctggagcaggacttctgaggctttctatcctccatgctgctcactagaaaaggggctgtgaactgtgctttggctctagcagacaggaagaaattctggcccagctggaagtagaaagaggggagtgagtctcctgaggaccatctcagaggccccgggatcacccgaacagtcctccatgtgaatcaatcccatgatgcaacatgcctccccagcccccgctctgacgatgatggccacgcagaatgtcccgcccccaccctaccaggacagcccacagatgacggcaaccgcccagccaccctccaaggcccaggctgtccacatctctgccccctcagctgctgccagcacacctgtgcccagtgcccccatcgacccccaggcccagctggaggctgacaagcgagctgtatacagatggtgaaggcaatccaggtcctgagaatccacctgctggagctggagaaagtcaatgaactctgcaaggacttttgtaaccgttacatcacctgcctcaaaaccaagat

SEQ ID NO: 15751 - DNA, 559 bp, Homo sapiens
  ENST00000557814
ataggctgtgttgtcacgccggtgtcagtctgatgaagattggcatcaggtgaagtctggagcaggacttctgaggctttctatcctccatgctgctcactagaaaaggggctgtgaactgtcctccatgtgaatcaatcccatgatgcaacatgcctccccagcccccgctctgacgatgatggccacgcagaatgtcccgcccccaccctaccaggacagcccacagatgacggcaaccgcccagccaccctccaaggcccaggctgtccacatctctgccccctcagctgctgccagcacacctgtgcccagtgcccccatcgacccccaggcccagctggaggctgacaagcgagctgtatacagatggtgaaggcaatccaggtcctgagaatccacctgctggagctggagaaagtcaatgaactctgcaaggacttttgtaaccgttacatcacctgcctcaaaaccaagatgcacagcgacaacctgctcaggaatgatctaggggggccctactcccccaaccagccctccatcaaccttcactcacagg

SEQ ID NO: 15752 - DNA, 545 bp, Homo sapiens
  ENST00000527238
gtgttgtcacgccggtgtcagtctgatgaagattggcatcaggtgaagtctggagcaggacttctgaggctttctatcctccatgctgctcactagaaaaggggctgtgaactattgcatctacagacagtcagagtgcccgcaagaaatcaggcaatgagcgtaaaaacaacagactcgatccaccccgctcgaccagatcttgatgggaacctatgctcgaagggtgctttggctctagcagacaggaagaaattctggcccagctggaagtagaaagaggggagtgagtctcctgaggaccatctcagaggccccgggatcacccgaacatatgccatgataagggctggatctgttatggtgagattgggccccaactccaaaggaccttgcccaggattttgtcctccatgtgaatcaatcccatgatgcaacatgcctccccagcccccgctctgacgatgatggccacgcagaatgtcccgcccccaccctaccaggacagcccacagatgacggcaaccgcccagccaccctccaag

SEQ ID NO: 15753 - DNA, 521 bp, Homo sapiens
  ENST00000561399
tcagtctgatgaagattggcatcaggtgaagtctggagcaggacttctgaggctttctatcctccatgctgctcactagaaaaggggctgtgaactgtctcctcggcagctgctgagctgcagaatttatggaagcccttcacgctttgtgacagactgctaatgaaagagaggccaggcttctgcgtctgccttctttggtttctaatttgtccagggattctatccccaagtgggggcaagcgacttggaagccaggggggccacacagagccctgcagcctgtcagcagggcttggcttgaaaggcccctgctgagggccacccagggggcagagggttgctcccagctccaagtacctgccagggatgtgaaacatgctctgggattaatgggaaccagatgggcaggacagcccctccacctggcctccaccggagaaatgctcagatttctggcattgtgctgaagcttttcttaggagttctctgagactgttttttcgctccaggccacatgc

SEQ ID NO: 15754 - DNA, 1654 bp, Homo sapiens
  ENST00000532623
agtctgatgaagattggcatcaggtgaagtctggagcaggacttctgaggctttctatcctccatgctgctcactagaaaaggggctgtgaactgtgctttggctctagcagacaggaagaaattctggcccagctggaagtagaaagaggggagtgagtctcctgaggaccatctcagaggccccgggatcacccgaacagtcctccatgtgaatcaatcccatgatgcaacatgcctccccagcccccgctctgacgatgatggccacgcagaatgtcccgcccccaccctaccaggacagcccacaggcaccctcttttcccgctcctgacgctgctgtttgagaaatgtgaacaggccacccagggctctgagtgcatcacctccgccagctttgatgtggacatcgagaactttgtccaccagcaggaacaggagcacaaacccttcttcagcgatgacccagaactggacaatctgatggtgaaggcaatccaggtcctgagaatccacctgctggagctggagaaagtcaatgaactctgcaaggacttttgtaaccgttacatcacctgcctcaaaaccaagatgcacagcgacaacctgctcaggaatgatctaggggggccctactcccccaaccagccctccatcaaccttcactcacaggacctcctgcagaattcccccaattccatgtccggagtctccaataacccccaggggattgtggtcccagcctcagcgctccagcagggcaacatcgccatgacaaccgtcaactcacaagttgtgtcaggtggagccttataccaaccggttaccatggtaacctcccagggtcaggtggtcacccaagcaatcccccagggagccatccagatccagaacacacaggttaaccttgacctcacctccctcctggacaatgaggataagaagtccaagaacaaacgaggagtcttgcccaagcatgccaccaatataatgcgttcttggctcttccagcatctcatgcacccctaccccacggaggatgagaagaggcagatcgcagcccagaccaacctcaccctcctgcaagtaaacaactggttcatcaatgcccggaggcgcatcctgcagcccatgcttgatgccagcaacccagatcctgcccccaaagccaagaagatcaagtctcagcaccggcccacccaaagattctggcccaactccatcgctgcgggggtgctgcagcagcagggcggtgccccagggacaaaccccgatggttccatcaacttggacaacctgcagtccctgtcctcagacagtgccaccatggccatgcagcaggctatgatggctgcacacgatgactcattggatgggacagaagaagaggatgaggatgagatggaagaggaggaggaggaggagctggaggaggaggtcgacgagctgcagacgacaaatgtcagcgacctgggcttggaacacagtgactccctggagtagtcgggcagcccagatggcactgatcactgagcaggagaggagtgtcgccgggaggccttcagggtgggggggaaggggacatgggcaggaagcaccgagggagttgggccctagcttccccaaatcagtagcttgaagaaaggcaaaggaga

SEQ ID NO: 15755 - DNA, 521 bp, Homo sapiens
  ENST00000531212
attgccaaatgagcgacactaacaagagtgatgctctcagaggaaggacagactgagtggactgcaaggataggggagacttctggaagaggtggatggtgtggcagacccttgacactcattccccttcagcaggcttggaatgtggggatgactatccccattttcacatatggcaaaggcccaagccacacagctggtgaagtctggagcaggacttctgaggctttctatcctccatgctgctcactagaaaaggggctgtgaactgtgctttggctctagcagacaggaagaaattctggcccagctggaagtagaaagaggggagtgagtctcctgaggaccatctcagaggccccgggatcacccgaacagtcctccatgtgaatcaatcccatgatgcaacatgcctccccagcccccgctctgacgatgatggccacgcagaatgtcccgcccccaccctaccaggacagcccacagatgacggcaaccgcccagccaccctccaaggccca

SEQ ID NO: 15756 - DNA, 604 bp, Homo sapiens
  ENST00000558729
aaggcactttagcaggaatctggcggcagagaggccgattgatgagatgccgaggtctgcagccccaactggaggcgccccggaagagtgagatggagtggggagggggtggaccgggcaggggaggaggcaaagagtctgtttccctggcccaaggaggccgagtggagccggcccagagatgaacgcatctgggagctgccaaggtgctttggctctagcagacaggaagaaattctggcccagctggaagtagaaagaggggagtgagtctcctgaggaccatctcagaggccccgggatcacccgaacagtcctccatgtgaatcaatcccatgatgcaacatgcctccccagcccccgctctgacgatgatggccacgcagaatgtcccgcccccaccctaccaggacagcccacagatgacggcaaccgcccagccaccctccaaggcccaggctgtccacatctctgccccctcagctgctgccagcacacctgtgcccagtgcccccatcgacccccaggcccagctggaggctgacaagcgagctgtatacagatggtgaaggcaatccaggtcctgagaatccacctgctggag

SEQ ID NO: 15757 - DNA, 340 bp, Homo sapiens
  ENST00000561115
agcaggaatctggcggcagagaggccgattgatgagatgccgaggtctgcagccccaactggaggcgccccggaagagtgagatggagtggggagggggtggaccgggcaggggaggaggcaaagagtctgtttccctggcccaaggaggccgagtggagccggcccagagatgaacgcatctgggagctgccaaggtgctttggctctagcagacaggaagaaattctggcccagctggaagtagaaagaggggagtgagtctcctgaggaccatctcagaggccccgggatcacccgaacaatgacggcaaccgcccagccaccctccaaggcccagg

SEQ ID NO: 15758 - DNA, 554 bp, Homo sapiens
  ENST00000558705
tatctcccaggtttgctgctggggtggccgcagaaccgggagtcggtcacagagttcacagacgaggtcacatggaggagaagcctggtgccaggaacaagctaggagtaactggaccacgatgacgcctgtgctttggctctagcagacaggaagaaattctggcccagctggaagtagaaagaggggagtgagtctcctgaggaccatctcagaggccccgggatcacccgaacagtcctccatgtgaatcaatcccatgatgcaacatgcctccccagcccccgctctgacgatgatggccacgcagaatgtcccgcccccaccctaccaggacagcccacagatgacggcaaccgcccagccaccctccaaggcccaggctgtccacatctctgccccctcagctgctgccagcacacctgtgcccagtgcccccatcgacccccaggcccagctggaggctgacaagcgagctgtatacaggcaccctcttttcccgctcctgacgctgctgtttgagaaatgtgaacaggccacccagggctctgagt

SEQ ID NO: 15759 - DNA, 591 bp, Homo sapiens
  ENST00000561298
tacagtggctccatgggcctcagtgaccacattgagagagagttgaatggcaaatacaggagaaatggctgcaagggaaattacagaatagaggacatcctggagaggcctggagaggggagaacacagcccggaagcccctcctctctgaccacccctgcacttcttgccttccctgctgagagctgctctacccttttttgcaggtgctttggctctagcagacaggaagaaattctggcccagctggaagtagaaagaggggagtgagtctcctgaggaccatctcagaggccccgggatcacccgaacaatgacggcaaccgcccagccaccctccaaggcccaggctgtccacatctctgccccctcagctgctgccagcacacctgtgcccagtgcccccatcgacccccaggcccagctggaggctgacaagcgagctgtatacaggcaccctcttttcccgctcctgacgctgctgtttgagaaatgtgaacaggccacccagggctctgagtgcatcacctccgccagctttgatgtggacatcgagaactttgtccaccagcaggaacaggagcacaaacc

SEQ ID NO: 15760 - DNA, 4531 bp, Homo sapiens
  ENST00000526955
ccttcttcagcgatgacccagaactggacaatctgatggtgaaggcaatccaggtcctgagaatccacctgctggagctggagaaagtcaatgaactctgcaaggacttttgtaaccgttacatcacctgcctcaaaaccaagatgcacagcgacaacctgctcaggaatgatctaggggggccctactcccccaaccagccctccatcaaccttcactcacaggaaaccaagagagttgccttctggacctgggtctggggaggagctagaaggagggaggggggcaggcaggaaggggaaaggacggaagaggactctggggctgtagggtctaagctctcagtgtcattgtcacaaaccacgcctccctcactgccaggacctcctgcagaattcccccaattccatgtccggagtctccaataacccccaggggattgtggtcccagcctcagcgctccagcagggcaacatcgccatgacaaccgtcaactcacaagttgtgtcaggtcggtgcaaagactgggaagggtgattgtgggaattccctgggaggagaaagggtggccccgaggcggttccaggggtgggggttgtcctccaccgagggaggggctcccagctcagtttcttgactaaagttttctgtaagtttatagacggttagcgccaagacccaattgtgatggtttagaacaaatttgggtcaaaatctcatgagcccctgagaggaccaagtaaggctgttgtcccttccccgaagcacctcccaccagaggctctgtcctaggctctagacaccatcccccacccacccataaagcagaaagccatagctcgctacccaagggctccaagtagagggtctttacacatgagtgccaaatgaactgggaaccctgcttgccctcgctcctacccactcccatggcaggggaccccaaaactggttgtctcctcaggtggagccttataccaaccggttaccatggtaacctcccagggtcaggtggtcacccaagcaatcccccagggagccatccagatccagaacacacaggtgagtgtgtgtaggtgtgtgcacatgtgcatggtgtgggctagggcacctgtaatcgcttcttatctgccaggcactttacacgggtgactcattgaatcctcatcatcctctaagaggtatcattacccctactttacagataagaagctgggtcttggaaaggttttatcaactcctgggattttgctgcctccctcctggggttacatcaaaggatcctgcacttcctattcctgtctgcagactgagccgctgtgtccctcagtggtagagagtgcacacacaaaggaagagtagaaagatcggaagtcagagtctgggatctgacattaactctgggatctctgataagtcacctaacctctctgagcctcagacttcttattgataaaagggggattaatagcaactgcacacagcctagccaacctacagggctgctgtgagaatgaaccacagcgatggataggaaagtgctttgcaaactgtaaagtaccacagaaatgctgataactacttgacagcttatggcaaattcatatcttctcctgttctctctgcatggccctgtttcctctgtctttctctctctctctctctctctctctctctctctctctctctctctctcccccccttccccatctcttcctccttgtccttcttcccttctcccatcacccaagcctcacctccactctctgaggggctggcatgggctgagagggaaaggtgacctccccagggccctaggaatgagccgggaaaggggctggcagccaagcctgccgtcgctatggcaacaggtccccagccgctgccctcacaggctgctgatgctgattttctctccacgtgccctgaaggttaaccttgacctcacctccctcctggacaatgaggataagaagtccaagaacaaacgaggagtcttgcccaagcatgccaccaatataatgcgttcttggctcttccagcatctcatgcacccctaccccacggaggatgagaagaggcagatcgcagcccagaccaacctcaccctcctgcaagtaaacaactggttcatcaatgcccggaggcgcatcctgcagcccatgcttgatgccagcaacccagatcctgcccccaaagccaagaagatcaagtctcagcaccggcccacccaaagattctggcccaactccatcgctgcgggggtgctgcagcagcagggcggtgccccagggacaaaccccgatggttccatcaacttggacaacctgcagtccctgtcctcagacagtgccaccatggccatgcagcaggctatgatggctgcacacgatgactcattggatgggacagaagaagaggatgaggatgagatggaagaggaggaggaggaggagctggaggaggaggtcgacgagctgcagacgacaaatgtcagcgacctgggcttggaacacagtgactccctggagtagtcgggcagcccagatggcactgatcactgagcaggagaggagtgtcgccgggaggccttcagggtgggggggaaggggacatgggcaggaagcaccgagggagttgggccctagcttccccaaatcagtagcttgaagaaaggcaaaggagacacctgttccttcccaaccaccgagcttcaatgaggaccccagccccacttccctggaactgccgaggactctgtttggcggggccagtcgagcagcctgtgtggaaagacaggagtgagatctggactcaccaaatccctgaggatagatggcacccatggcccccacccacggaaggacttgagttgtttacaagccctgcactgaggcagattggtgctgttcgcagagtaggcctttgcccgggggcagacttagaaggaaggggagagacaaagggggactgagtttcatccccagaagtttctcagctcctttgacagacattcaagggcaggagggagccccaaagcataaccagtggccagaggagtgggagggcctgaggcatcacatcttgcagatcagaatgggatggaatccaccaggctccagctcatccctccaaggccctgtctctgcgcacagcaaccatggacatgggagaaagggatgggagccacagtgcccttcactctctcctggaaaccaactgtaagctggtgggctcaacctgtgggaggttaagaggagtcccttctgggttgactccaagagccaaggagatggcagaccctgggctaggaaccatatggaggtgactttgaggccacagctgtccctaggtgatcacagaacttagctcctttaacaacaggacaatggttttttaccctagatgttcccaccttcagtgctccacgccctccatagaccttcagagaaggtgaaaccaggttatctgggaatctttccagcccgcaggtcgccacggccatccctttgctcccagcctggctccatcagcctccagcttcctttcttcattctgtccttcagggaaggcagaagaaacattggaaagcatctagtccagtgggaagccaggggttggagaaggtgctacatccctcttcccatcaatatcctaaatgtgggggagggcccagagaatggcacccaagagcctgcggggatgcccatcccacacaccccacccagctgttctaaccctgctatccacagccctggaggaactggggctcctggaaggaggaggaggctctccactgtccaccctaacacataccctcccacccaccttccagacccccttggttggcaccctctcctccggttccctctcaccccatggctgtgaatgacaggacaggtcacacgtgtgttttccattgggtttaatttaatggacgtgcagtttcatttgtaaattgtgcattggccacctccttcagtggcaggatgtgagtggctacctggctcaactggaggggaccccttgggccctctggggcttcccctcccccacctggttggggtagagcaaaaggatggtcactcttccgaggtctccctgaaatgaatgtatttctcccccaaaagagctgatatttaatgttttaataaggatttttgagaaacaaataaccttatttataatctgggtgatccaatcattttttactcccttttgatgccatacatagaggaaagtctagcttttttggcgtgagacttttgcaatgtgcagtgggataaaatgcatttccttttctggttcgtttttcttgttaacacgcgcacacagacacacacacacaccgttccactcaccacctggacaggcgtcccccagcacggacacactggcacacaggtgcccacatctcttcctctcagcccctccacctgcctaatgttatgcaacctccttctgatgtatccaccaaaccagtactgaatgtggccgagacgttttcagtaaatcttattacctaccgtaa

SEQ ID NO: 15761 - DNA, 756 bp, Homo sapiens
  ENST00000534401
gcgccgggccagggatggagtcctggacacctcggccgtcagcagtggcctctgggatgagctgggaggctggcgggatccggaccacgagccggcctgaggccggcgtgtgctccctggcgctgccctctgacctgcagctggaccgccggggcgccgaggggccggaggccgagcggctgcgggcagcccgcgtccaggagcaggtccgcgcccgcctcttgcagctgggacagcagccgcggcacaacggggccgctgagcccgagcctgaggccgagactgccagaggcacatccagggggcagtaccacaccctgcaggctggcttcagctctcgctctcagggcctgagtggggacaagacctcgggcttccggcccatcgccaagccggcctacagcccagcctcctggtcctcccgctccgccgtggatctgagctgcagtcggaggctgagttcagcccacaacgggggcagcgcctttggggccgctgggtacgggggtgcccagcccacccctcccatgcccaccaggcccgtgtccttccatgagcgcggtggggttgggagccgggccgactatgacacactctccctgcgctcgctgcggctggggcccgggggcctggacgaccgctacagcctggtgtctgagcagctggagcccgcggccacctccacctacagggcctttgcgtacgagcgccaggccagctccagctccagccgggcaggggggctggactggcccg

SEQ ID NO: 15762 - DNA, 1111 bp, Homo sapiens
  ENST00000533249
cctggggtgcaggagcagtggtgccagggtcccagaagccagagagggttttggaggcctctgtagggggtgagggggtcctggggcctgaggccggcgtgtgctccctggcgctgccctctgacctgcagctggaccgccggggcgccgaggggccggaggccgagcggctgcgggcagcccgcgtccaggagcaggtccgcgcccgcctcttgcagctgggacagcagccgcggcacaacggggccgctgagcccgagcctgaggccgagactgccagaggcacatccagggggcagtaccacaccctgcaggctggcttcagctctcgctctcagggcctgagtggggacaagacctcgggcttccggcccatcgccaagccggcctacagcccagcctcctggtcctcccgctccgccgtggatctgagctgcagtcggaggctgagttcagcccacaacgggggcagcgcctttggggccgctgggtacgggggtgcccagcccacccctcccatgcccaccaggcccgtgtccttccatgagcgcggtggggttgggagccgggccgactatgacacactctccctgcgctcgctgcggctggggcccgggggcctggacgaccgctacagcctggtgtctgagcagctggagcccgcggccacctccacctacagggcctttgcgtacgagcgccaggccagctccagctccagccgggcaggggggctggactggcccgaggccactgaggtttccccgagccggaccatccgtgcccctgccgtgcggaccctgcagcgattccagagcagccaccggagccgcggggtaggcggggcagtgccgggggccgtcctggagccagtggctcgagcgccatctgtgcgcagcctcagcctcagcctggctgactcgggccacctgccggacgtgcatgggttcaacagctacggtagccaccgaaccctgcagagactcagcagcggttttgatgacattgacctgccctcagcagtcaagtacctcatggcttcagaccccaacctgcaggtgctgggagcggcctacatccagcacaagtgctacagcgatgcagccgccaa

SEQ ID NO: 15763 - DNA, 847 bp, Homo sapiens
  ENST00000527442
gcagtggtgccagggtcccagaagccagagagggttttggaggcctctgtaggggcctgaggccggcgtgtgctccctggcgctgccctctgacctgcagctggaccgccggggcgccgaggggccggaggccgagcggctgcgggcagcccgcgtccaggagcaggtccgcgcccgcctcttgcagctgggacagcagccgcggcacaacggggccgctgagcccgagcctgaggccgagactgccagaggcacatccagggggcagtaccacaccctgcaggctggcttcagctctcgctctcagggcctgagtggggacaagacctcgggcttccggcccatcgccaagccggcctacagcccagcctcctggtcctcccgctccgccgtggatctgagctgcagtcggaggctgagttcagcccacaacgggggcagcgcctttggggccgctgggtacgggggtgcccagcccacccctcccatgcccaccaggcccgtgtccttccatgagcgcggtggggttgggagccgggccgactatgacacactctccctgcgctcgctgcggctggggcccgggggcctggacgaccgctacagcctggtgtctgagcagctggagcccgcggccacctccacctacagggcctttgcgtacgagcgccaggccagctccagctccagccgggcaggggggctggactggcccgaggccactgaggtttccccgagccggaccatccgtgcccctgccgtgcggaccctgcagcgattccagagcagccaccggagccgcggggtaggcggggcagtgccgggggccgtcctggagccagtggct

SEQ ID NO: 15764 - DNA, 940 bp, Homo sapiens
  ENST00000528036
ctcagggctgggcaggcgtctgtcttcaggcggctctggcctgaggccggcgtgtgctccctggcgctgccctctgacctgcagctggaccgccggggcgccgaggggccggaggccgagcggctgcgggcagcccgcgtccaggagcaggtccgcgcccgcctcttgcagctgggacagcagccgcggcacaacggggccgctgagcccgagcctgaggccgagactgccagaggcacatccagggggcagtaccacaccctgcaggctggcttcagctctcgctctcagggcctgagtggggacaagacctcgggcttccggcccatcgccaagccggcctacagcccagcctcctggtcctcccgctccgccgtggatctgagctgcagtcggaggctgagttcagcccacaacgggggcagcgcctttggggccgctgggtacgggggtgcccagcccacccctcccatgcccaccaggcccgtgtccttccatgagcgcggtggggttgggagccgggccgactatgacacactctccctgcgctcgctgcggctggggcccgggggcctggacgaccgctacagcctggtgtctgagcagctggagcccgcggccacctccacctacagggcctttgcgtacgagcgccaggccagctccagctccagccgggcaggggggctggactggcccgaggccactgaggtttccccgagccggaccatccgtgcccctgccgtgcggaccctgcagcgattccagagcagccaccggagccgcggggtaggcggggcagtgccgggggccgtcctggagccagtggctcgagcgccatctgtgcgcagcctcagcctcagcctggctgactcgggccacctgccggacgtgcatgggttcaacagctacggtagccaccgaaccctgcagagactca

SEQ ID NO: 15765 - DNA, 2809 bp, Homo sapiens
  ENST00000331563
ggcctcgagggacaggacgtgaagatagttgggtttggaggcggccgccaggcccaggcccggtggacctgccgccatgcaggacggtaacttcctgctgtcggccctgcagcctgaggccggcgtgtgctccctggcgctgccctctgacctgcagctggaccgccggggcgccgaggggccggaggccgagcggctgcgggcagcccgcgtccaggagcaggtccgcgcccgcctcttgcagctgggacagcagccgcggcacaacggggccgctgagcccgagcctgaggccgagactgccagaggcacatccagggggcagtaccacaccctgcaggctggcttcagctctcgctctcagggcctgagtggggacaagacctcgggcttccggcccatcgccaagccggcctacagcccagcctcctggtcctcccgctccgccgtggatctgagctgcagtcggaggctgagttcagcccacaacgggggcagcgcctttggggccgctgggtacgggggtgcccagcccacccctcccatgcccaccaggcccgtgtccttccatgagcgcggtggggttgggagccgggccgactatgacacactctccctgcgctcgctgcggctggggcccgggggcctggacgaccgctacagcctggtgtctgagcagctggagcccgcggccacctccacctacagggcctttgcgtacgagcgccaggccagctccagctccagccgggcaggggggctggactggcccgaggccactgaggtttccccgagccggaccatccgtgcccctgccgtgcggaccctgcagcgattccagagcagccaccggagccgcggggtaggcggggcagtgccgggggccgtcctggagccagtggctcgagcgccatctgtgcgcagcctcagcctcagcctggctgactcgggccacctgccggacgtgcatgggttcaacagctacggtagccaccgaaccctgcagagactcagcagcggttttgatgacattgacctgccctcagcagtcaagtacctcatggcttcagaccccaacctgcaggtgctgggagcggcctacatccagcacaagtgctacagcgatgcagccgccaagaagcaggcccgcagccttcaggccgtgcctaggctggtgaagctcttcaaccacgccaaccaggaagtgcagcgccatgccacaggtgccatgcgcaacctcatctacgacaacgctgacaacaagctggccctggtggaggagaacgggatcttcgagctgctgcggacactgcgggagcaggatgatgagcttcgcaaaaatgtcacagggatcctgtggaacctttcatccagcgaccacctgaaggaccgcctggccagagacacgctggagcagctcacagacctggtgttgagccccctgtcgggggctgggggtccccccctcatccagcagaacgcctcggaggcagagatcttctacaacgccaccggcttcctcaggaacctcagctcagcctctcaggccactcgccagaagatgcgggagtgccacgggctggtggacgccctggtcacctctatcaaccacgccctggacgcgggcaaatgcgaggacaagagcgtggagaacgcggtgtgcgtcctgcggaacctgtcctaccgcctctacgacgagatgccgccgtccgcgctgcagcggctggagggtcgcggccgcagggacctggcgggggcgccgccgggagaggtcgtgggctgcttcacgccgcagagccggcggctgcgcgagctgcccctcgccgccgatgcgctcaccttcgcggaggtgtccaaggaccccaagggcctcgagtggctgtggagcccccagatcgtggggctgtacaaccggctgctgcagcgctgcgagctcaaccggcacacgacggaggcggccgccggggcgctgcagaacatcacggcaggcgaccgcaggtgggcgggggtgctgagccgcctggccctggagcaggagcgtattctgaaccccctgctagaccgtgtcaggaccgccgaccaccaccagctgcgctcactgactggcctcatccgaaacctgtctcggaacgctaggaacaaggacgagatgtccacgaaggtggtgagccacctgatcgagaagctgccgggcagcgtgggtgagaagtcgcccccagccgaggtgctggtcaacatcatagctgtgctcaacaacctggtggtggccagccccatcgctgcccgagacctgctgtattttgacggactccgaaagctcatcttcatcaagaagaagcgggacagccccgacagtgagaagtcctcccgggcagcatccagcctcctggccaacctgtggcagtacaacaagctccaccgtgacttccgggcgaagggctatcggaaggaggacttcctgggcccataggtgaagccttctggaggagaaggtgacgtggcccagcgtccaagggacagactcagctccaggctgcttggcagcccagcctggaggagaaggctaatgacggaggggcccctcgctggggcccctgtgtgcatctttgagggtcctgggccaccaggaggggcagggtcttatagctggggacttggcttccgcagggcagggggtggggcagggctcaaggctgctctggtgtatggggtggtgacccagtcacattggcagaggtgggggttggctgtggcctggcagtatcttgggatagccagcactgggaataaagatggccatgaacagtca

SEQ ID NO: 15766 - DNA, 590 bp, Homo sapiens
  ENST00000533069
agttgggtttggaggcggccgccaggcccaggcccggtggacctgccgccatgcaggacggtaacttcctgctgtcggccctgcagcctgaggccggcgtgtgctccctggcgctgccctctgacctgcagctggaccgccggggcgccgaggggccggaggccgagcggctgcgggcagcccgcgtccaggagcaggtccgcgcccgcctcttgcagctgggacagcagccgcggcacaacggggccgctgagcccgagcctgaggccgagactgccagaggcacatccagggggcagtaccacaccctgcaggctggcttcagctctcgctctcagggcctgagtggggacaagacctcggtgagcgatgggcccagcccgagggggacgatctgagctctgcagtctggagagtgggaggctctgcagcgggcccggacacaggtgagcccaggcacgccctcaccgccccctctcgacccacagggcttccggcccatcgccaagccggcctacagcccagcctcctggtcctcccgctccgccgtggatctgagctgcagtcggaggctgagttcagcccacaac

SEQ ID NO: 15767 - DNA, 687 bp, Homo sapiens
  ENST00000531857
agttgggtttggaggcggccgccaggcccaggcccggtggacctgccgccatgcaggacggtaacttcctgctgtcggccctgcagcctgaggccgagactgccagaggcacatccagggggcagtaccacaccctgcaggctggcttcagctctcgctctcagggcctgagtggggacaagacctcgggcttccggcccatcgccaagccggcctacagcccagcctcctggtcctcccgctccgccgtggatctgagctgcagtcggaggctgagttcagcccacaacgggggcagcgcctttggggccgctgggtacgggggtgcccagcccacccctcccatgcccaccaggcccgtgtccttccatgagcgcggtggggttgggagccgggccgactatgacacactctccctgcgctcgctgcggctggggcccgggggcctggacgaccgctacagcctggtgtctgagcagctggagcccgcggccacctccacctacagggcctttgcgtacgagcgccaggccagctccagctccagccgggcaggggggctggactggcccgaggccactgaggtttccccgagccggaccatccgtgcccctgccgtgcggaccctgcagcgattccagagcagccaccggagccgcggggtaggcggggcagtgccgggggccg

SEQ ID NO: 15768 - DNA, 441 bp, Homo sapiens
  ENST00000530695
cagggagacagtgtcactctcctgtgaccgggcacagatgaggtttgggcacaggaggggctcaaaaggagtcagtgtgggccggggcaggccaggctggcttcctggaggaggctgggcactgtaccatggcaaggattggagaactgatgtcagaggccctggcacattcctcctggcgaccaggaggcacatccagggggcagtaccacaccctgcaggctggcttcagctctcgctctcagggcctgagtggggacaagacctcgggcttccggcccatcgccaagccggcctacagcccagcctcctggtcctcccgctccgccgtggatctgagctgcagtcggaggctgagttcagcccacaacgggggcagcgcctttggggccgctgggtacgggggtgcccagcccacccctcccatgcccaccaggcccg

SEQ ID NO: 15769 - DNA, 312 bp, Homo sapiens
  ENST00000524646
tcgggccacctgccggacgtgcatgggttcaacagctacggtagccaccgaaccctgcagagactcagcagcggttttgatgacattgacctgccctcagcagtcaagtacctcatggcttcagaccccaacctgcaggtgctgggagcggcctacatccagcacaagtgctacagcgatgcagccgccaagaagcaggtgaccaccccgaccacccactcgctgccccctggtgacctccttcgtgggccccaccacctcccactgtcctctgctcactgagcacccctcatgatccccaagctgactggg

SEQ ID NO: 15770 - DNA, 532 bp, Homo sapiens
  ENST00000526971
aagtgctacagcgatgcagccgccaagaagcaggcccgcagccttcaggccgtgcctaggctggtgaagctcttcaaccacgccaaccaggaagtgcagcgccatgccacaggtgccatgcgcaacctcatctacgacaacgctgacaacaagctggccctggtggaggagaacgggatcttcgagctgctgcggacactgcgggagcaggatgatgagcttcgcaaaaatgtcacagggatcctgtggaacctttcatccagcgaccacctgaaggaccgcctggccagagacacgctggagcagctcacagacctggtgttgagccccctgtcgggggctgggggtccccccctcatccagcagaacgcctcggaggcagagatcttctacaacgccaccggcttcctcaggtgcgccagcctcgggcagcggggtggggattgcaggcgcgggtcactgtggggactccgcctggcctggcgttcgcagcccacacaccgcacgcctcgcgctggggatgggcgtgcga

SEQ ID NO: 15771 - DNA, 495 bp, Homo sapiens
  ENST00000525642
attttgacggactccgaaagctcatcttcatcaagaagaagcgggacagccccgacagtgagaagtcctcccgggcagcatccagcctcctggccaacctgtggcagtacaacaagctccaccgtgacttccgggcggtacgtttcccgagcccagggcaagcagggacccgggtgcagggcatgggacgccgggggagggtcagtgaagaggcccatgggaggatggagaccagggacccagagaggaagggtccgggccacacccagcacactgcaggagggacagcgggcagagggccacatgggcagacatgcaccctgaccttgggcctctctccactgtagaagggctatcggaaggaggacttcctgggcccataggtgaagccttctggaggagaaggtgacgtggcccagcgtccaagggacagactcagctccaggctgcttggcagcccagcctggaggagaaggctaatgacggaggggcccc

SEQ ID NO: 15772 - DNA, 2594 bp, Homo sapiens
  ENST00000323646
cttcctggaagggtgcgataaggccgggcgaggtgcctgggatgcttctccccttccgcgaggaagagatctaattgggtagggcgggtgtagactagcctgccgagccgcccgctggcacctgcagcctcctgggcgcccgccgggccccggcgagaaagttgttaaagggagcgaggtggttgttcctggggtccgaggcgcgcctctcacgccctgcccaacagaagccgcagtcccgtggggtctggagacgcagtttcctgttaatgacaataaatccctgctccccctgcctcagacatctacgcagcgaaatcgagcctggccttgagggtccacaccgcgagggaagatgcgtgcgcccattccagagcctaagcctggagacctgattgagatttttcgccctttctacagacactgggccatctatgttggcgatggatatgtggttcatctggcccctccaagtgaggtcgcaggagctggtgcagccagtgtcatgtccgccctgactgacaaggccatcgtgaagaaggaattgctgtatgatgtggccgggagtgacaagtaccaggtcaacaacaaacatgatgacaagtactcgccgctgccctgcagcaaaatcatccagcgggcggaggagctggtggggcaggaggtgctctacaagctgaccagtgagaactgcgagcactttgtgaatgagctgcgctatggagtcgcccgcagtgaccaggtcagagatgtcatcatcgctgcaagcgttgcaggaatgggcttggcagccatgagccttattggagtcatgttctcaagaaacaagcgacaaaagcaataactgaaaaagactgtcctgtcagcgatgactttatacatcaagggggtcttgttttgctagagagtttggggtttggtttgtggatttcattgtgatttataataaggcttattttcacagaataaaataaagcaaaacgagggaggattttattgggggaagtgcagcaagaactgcctggtgtgaagtctgttcagggaacagccgggctgtcttcctggtcagggattgtctttcactttctttttgcgtgctgtgttctttgcattgcaggaggcagagtccagctccagttatctcaagtagagggcgtttctggtcgtcaggatacatgcggggcggaagggagacagaaagacataatacacaagaacagaaagcagcagacagccaggacccttggcccggaactagatctaggatggcctctgagactcagcagctggagtctgtagatgttcagctgagttgaaaaaaaaaaagtcctcggctataaggaaatttagtatagatgcttgccaatcttactaaaatttcccttattttcctttgctctacacgtctttcctttgccttgttgcttccatctccttggcactcctgcttcctcactgcttctgcttgccatgatccccaagtctctgacccaccttcctgcctgctcctctcctcccacattggctcagattctttccccgctgtctgtgggtccacactcccagtggcacctccaggagagaatctgattggctcagttcgccagataactcaactttcccattggctacctttgggtcaggtgatctccactagacctatcgcctatgcctgatggtgggtcacatggtgcaaatgttgcctgagagcttagtggattagggatgtggctgggctcatggttgacgtccctgctgctgagcccttacgggtcaggctgggagaaggtaccatgttgtgtgactggtcatttgaggtcttgcagctgttgcttgctgggcttggcaggtgttcaaagtgaccatttttctgaagggtttttttctgagtattcctcagatgtactcccctggggccgacggtctttccttccacagggcgatgcttccctacttgcttgtgaatgtttccttcatctccaggttgtctggggacaattctgtcttttggaggcctgggcaggatttacagagggctccatgccagctccttcctgccgggtccacttctggtgtagggtaaacacctgcccattcatgtcctagtgttgatagaataatcattttctttcagtacagtttcctttttttttttttttgccccggctttttagatgtagcacttaatgccagttctcgagctccccaaacttaagggacacaggtcaacaagcagtaggtctttggaagctcgctctctcacatggtataaggtgagggggacacatggaatgtaaacctccaaactaattatgggggaaaaaggaatgagaaaaacaaacacaagaaggcaaaacaaaaacacctggttcaattaaaaacaacaacaaagcaaaacaaaaaaaacccaaaaccaaaccacacaataaatgagaaaaaaattacataaaacagatgacatgtatagaaataaaaaaatagaatggaggaactaattccaaatatataagtaatcctaagtggactaaatttgcaaagtaaaaggcaaacattacactggattaaaaaacaaatccagggaatacagtttacag

SEQ ID NO: 15773 - DNA, 678 bp, Homo sapiens
  ENST00000394613
acgccctgcccaacagaagccgcagtcccgtggggtctggagacgcagtttcctgttaatgacaataaatccctgctccccctgcctcagacatctacgcagcgaaatcgagcctggccttgagggtccacaccgcgagggaagatgcgtgcgcccattacactgggccatctatgttggcgatggatatgtggttcatctggcccctccaagtgaggtcgcaggagctggtgcagccagtgtcatgtccgccctgactgacaaggccatcgtgaagaaggaattgctgtatgatgtggccgggagtgacaagtaccaggtcaacaacaaacatgatgacaagtactcgccgctgccctgcagcaaaatcatccagcgggcggaggagctggtggggcaggaggtgctctacaagctgaccagtgagaactgcgagcactttgtgaatgagctgcgctatggagtcgcccgcagtgaccaggtcagagatgtcatcatcgctgcaagcgttgcaggaatgggcttggcagccatgagccttattggagtcatgttctcaagaaacaagcgacaaaagcaataactgaaaaagactgtcctgtcagcgatgactttatacatcaagggggtcttgttttgctagagagtttggggtttggtttgtggatttcattgtga

SEQ ID NO: 15774 - DNA, 243 bp, Homo sapiens
  ENST00000540943
cttgggttaaaaagtattctgaaagcatcctcactgtcctccctggtcccgcacagtgccagagccgggggtcttggactgagtcagagttgcatgggtgcatctggagggaccttgattggagagaggtgaggtcgcaggagctggtgcagccagtgtcatgtccgccctgactgacaaggccatcgtgaagaaggaattgctgtatgatgtggccgggagtgacaagtaccaggtcaacaa

SEQ ID NO: 15775 - DNA, 430 bp, Homo sapiens
  ENST00000544269
agcctcccgagtagctgggactacaggcacccgccacctcgcccggctaattttttgtatttttagtagagacggggtttcactgtgttagccaggatggtctcgatctcctgacctcgtgatccacccgcctcggcctcccaaagtcctgggattacgggcgtgagccaccgcgcccggcctatactggtctctctactcctctgcgtcctgcaacacaggagccctcataaggaaatgaagacccaaagaagtagttggtgtcagttacttctacaccgaattggacaaagaataccagagcctaagcctggagacctgattgagatttttcgccctttctacagacactgggccatctatgttggcgatggatatgtggttcatctggcccctccaagtgaggtcgcaggagctggtgcagccagtg

SEQ ID NO: 15776 - DNA, 1099 bp, Homo sapiens
  ENST00000415826
gggtgacctcacgccggcccggccaccgcggccattagacccggtccaattgctggggctgcagcgctgcctccgagaccgcgagacatctacgcagcgaaatcgagcctggccttgagggtccacaccgcgagggaagatgcgtgcgcccattccagagcctaagcctggagacctgattgagatttttcgccctttctacagacactgggccatctatgttggcgatggatatgtggttcatctggcccctccaagtgaggtcgcaggagctggtgcagccagtgtcatgtccgccctgactgacaaggccatcgtgaagaaggaattgctgtatgatgtggccgggagtgacaagtaccaggtcaacaacaaacatgatgacaagtactcgccgctgccctgcagcaaaatcatccagcgggcggaggagctggtggggcaggaggtgctctacaagctgaccagtgagaactgcgagcactttgtgaatgagctgcgctatggagtcgcccgcagtgaccaggtcagagatgtcatcatcgctgcaagcgttgcaggaatgggcttggcagccatgagccttattggagtcatgttctcaagaaacaagcgacaaaagcaataactgaaaaagactgtcctgtcagcgatgactttatacatcaagggggtcttgttttgctagagagtttggggtttggtttgtggatttcattgtgatttataataaggcttattttcacagaataaaataaagcaaaacgagggaggattttattgggggaagtgcagcaagaactgcctggtgtgaagtctgttcagggaacagccgggctgtcttcctggtcagggattgtctttcactttctttttgcgtgctgtgttctttgcattgcaggaggcagagtccagctccagttatctcaagtagagggcgtttctggtcgtcaggatacatgcggggcggaagggagacagaaagacataatacacaagaacagaaagcagcagacagccaggacccttggcccggaactagatctaggatggcctctgagactcagcagctggagtctgtagatgttcagctgagttg

SEQ ID NO: 15777 - DNA, 957 bp, Homo sapiens
  ENST00000639271
catggaccccagccagagcctaagcctggagacctgattgagatttttcgccctttctacagacactgggccatctatgttggcgatggatatgtggttcatctggcccctccaagtgaggtcgcaggagctggtgcagccagtgtcatgtccgccctgactgacaaggccatcgtgaagaaggaattgctgtatgatgtggccgggagtgacaagtaccaggtcaacaacaaacatgatgacaagtactcgccgctgccctgcagcaaaatcatccagcgggcggaggagctggtggggcaggaggtgctctacaagctgaccagtgagaactgcgagcactttgtgaatgagctgcgctatggagtcgcccgcagtgaccaggtcagagatgtcatcatcgctgcaagcgttgcaggaatgggcttggcagccatgagccttattggagtcatgttctcaagaaacaagcgacaaaagcaataactgaaaaagactgtcctgtcagcgatgactttatacatcaagggggtcttgttttgctagagagtttggggtttggtttgtggatttcattgtgatttataataaggcttattttcacagaataaaataaagcaaaacgagggaggattttattgggggaagtgcagcaagaactgcctggtgtgaagtctgttcagggaacagccgggctgtcttcctggtcagggattgtctttcactttctttttgcgtgctgtgttctttgcattgcaggaggcagagtccagctccagttatctcaagtagagggcgtttctggtcgtcaggatacatgcggggcggaagggagacagaaagacataatacacaagaacagaaagcagcagacagccaggacccttggcccggaactagatctaggatggcctctgagactcagcagctggagtctgtagatgttcagctgagttg

SEQ ID NO: 15778 - DNA, 2697 bp, Homo sapiens
  ENST00000215885
atgggggcgtgggccctggcaagtgcactcctcagccaatcagcgtcctgcccggctggtggattcggttacaagcccaagatcaccccatactccagcctctttcctcctcctcccgcagctccattcattggtcccgccgcaccgggcctgctgggctccgcttccgttccactgctcagctgccgcctggtggggccaccaagggcaggcatcccaggggctttgtctgactggactgggccagtgcagaatgggggttcaggcagggctgtttgggatgctgggcttcctgggggtggccctggggggctcccctgccctccgctggtacaggacctcctgccacttgaccaaggccgtccctggcaacccactggggtacctgagcttcctggccaaggatgctcagggactggccctgatccatgcccgctgggatgcgcataggaggctgcagtcatgtagctgggaggatgagccggagctcaccgcagcctacggtgctctctgtgctcatgagactgcctggggctccttcatccacacccccggacccgagctgcagagagcactggccactcttcagagtcagtgggaggcatgccgagcgcttgaggagagtccagcaggggccaggaagaagcgagcagcagggcagagtggagtccctggtggagggcaccagcgagagaagagaggatggaccatgcctggcacactgtggtgtggagttggagattctgctgggaactcctcggagctgggggtcttccagggacctgatctctgttgccgggaacatgaccgctgcccacagaacatctcacccttgcagtacaactatggcatccgaaactaccgattccacaccatctcccactgtgactgtgacaccaggtttcagcaatgcctacagaatcagcacgactccatctcggacatcgtgggcgtggccttcttcaacgtgctggagatcccctgctttgtgctggaggagcaggaggcgtgtgtggcgtggtactggtggggcgggtgtaggatgtacggcacagtgcccctcgctcgcctgcagcccaggaccttctacaatgcctcctggagctcccgggccacctccccaactcccagctcccggagcccagcccctcccaagcctcgacagaagcagcaccttcggaaggggccaccacatcagaaagggtccaagcgccccagcaaagccaacaccacagccctccaggaccctatggtctctcccaggcttgatgtggcccccacaggcctccagggcccacagggtggcctaaaacctcagggtgcccgctgggtctgccgcagcttccgccgccacctggaccagtgtgagcaccagattgggccccgggaaatcgagttccagctgctcaacagcgcccaagagcccctcttccactgcaactgcacgcgccgtctggcacgcttcctgaggctccacagcccacccgaggttaccaacatgctttgggagctgctgggcacaacctgcttcaagctggcccctccactggactgtgtggaaggcaaaaactgttccagagaccctagggccatcagggtgtcagcccggcacttgcggaggcttcagcagaggcgacaccagctccaggataaaggcacagatgagaggcagccatggccttcagagcccctgagaggccccatgtcattctacaaccagtgcctgcagctaacccaggcagccaggagacccgacaggcagcagaagtcctggagccagtgacctcagtttcagctttcctgggcaccagcctggaccttgcccatggctatgccaagccttgggaatctcagcctcccctccgtaggttagactgaagcatggcagaggctgttgtggacaatcaagaggatgaatggggggatctcaaggcccaaatgctggaccacatctcctgctgttctgggtaaccttgagctatgtatgacacaactcttctatgcctggatgtggtgttcaggaagctcattctgatgccctgggctttggccttgccagggaacttcacatacagatgagaatggggaaagggtaacttattgcagcagccccaggcagtaccaggaggaggtacatgtatgtccgtgttgcaaaaataatacatgcctcaaaaacctgcctaggggagccctagtgcctgggtgctgtggcctgaggtagcaggtgggaagttagggatgtcacagaaatgtctgtgtctgaatccaggattggggtgggtgttggagagggctttcagctcccctcctcccaggggggcctctttttttaacggctgccgtgcccttcctggcccagccctaaacctaaattcaaatctcctccatgcctttgcgcaaaggacctccctcttgcactctaagccttagtttcctcctctaaaaaaagggggtctctaaacaggagctacctcatagggttgttgaggattaagtgaaccaatacatatacagtgcttagcacttaataagtattcccccctgcgacacctagctgaactatggtttggtgtctgatcttgagaggttgatgtaaccttttaaaggcctcagttcgctcacctgtgaaatgggtctaagaatagcactgatctcacagggttgtgatgcagattaaaggagatggcatgtgtaatg

SEQ ID NO: 15779 - DNA, 2875 bp, Homo sapiens
  ENST00000367466
aggataagactttctctaagtccggagctgaaaaaggatcctgactgaaagctagaggcattgaggagcctgaagattctcaggttttaaagacgctagagtgccaaagaagactttgaagtgtgaaaacatttcctgtaattgaaaccaaaatgtcatttatagatccttaccagcacattatagtggagcaccagtattcccacaagtttacggtagtggtgttacgtgccaccaaagtgacaaagggggcctttggtgacatgcttgatactccagatccctatgtggaactttttatctctacaacccctgacagcaggaagagaacaagacatttcaataatgacataaaccctgtgtggaatgagacctttgaatttattttggatcctaatcaggaaaatgttttggagattacgttaatggatgccaattatgtcatggatgaaactctagggacagcaacatttactgtatcttctatgaaggtgggagaaaagaaagaagttccttttattttcaaccaagtcactgaaatggttctagaaatgtctcttgaagtttgctcatgcccagacctacgatttagtatggctctgtgtgatcaggagaagactttcagacaacagagaaaagaacacataagggagagcatgaagaaactcttgggtccaaagaatagtgaaggattgcattctgcacgtgatgtgcctgtggtagccatattgggttcaggtgggggtttccgagccatggtgggattctctggtgtgatgaaggcattatacgaatcaggaattctggattgtgctacctacgttgctggtctttctggctccacctggtatatgtcaaccttgtattctcaccctgattttccagagaaagggccagaggagattaatgaagaactaatgaaaaatgttagccacaatccccttttacttctcacaccacagaaagttaaaagatatgttgagtctttatggaagaagaaaagctctggacaacctgtcacctttactgatatctttgggatgttaataggagaaacactaattcataatagaatgaatactactctgagcagtttgaaggaaaaagttaatactgcacaatgccctttacctcttttcacctgtcttcatgtcaaacctgacgtttcagagctgatgtttgcagattgggttgaatttagtccatacgaaattggcatggctaaatatggtacttttatggctcccgacttatttggaagcaaattttttatgggaacagtcgttaagaagtatgaagaaaaccccttgcatttcttaatgggtgtctggggcagtgccttttccatattgttcaacagagttttgggcgtttctggttcacaaagcagaggctccacaatggaggaagaattagaaaatattaccacaaagcatattgtgagtaatgatagctcggacagtgatgatgaatcacacgaacccaaaggcactgaaaatgaagatgctggaagtgactatcaaagtgataatcaagcaagttggattcatcgtatgataatggccttggtgagtgattcagctttattcaataccagagaaggacgtgctgggaaggtacacaacttcatgctgggcttgaatctcaatacatcttatccactgtctcctttgagtgactttgccacacaggactcctttgatgatgatgaactggatgcagctgtagcagatcctgatgaatttgagcgaatatatgagcctctggatgtcaaaagtaaaaagattcatgtagtggacagtgggctcacatttaacctgccgtatcccttgatactgagacctcagagaggggttgatctcataatctcctttgacttttctgcaaggccaagtgactctagtcctccgttcaaggaacttctacttgcagaaaagtgggctaaaatgaacaagctcccctttccaaagattgatccttatgtgtttgatcgggaagggctgaaggagtgctatgtctttaaacccaagaatcctgatatggagaaagattgcccaaccatcatccactttgttctggccaacatcaacttcagaaagtacagggctccaggtgttccaagggaaactgaggaagagaaagaaatcgctgactttgatatttttgatgacccagaatcaccattttcaaccttcaattttcaatatccaaatcaagcattcaaaagactacatgatcttatgcacttcaatactctgaacaacattgatgtgataaaagaagccatggttgaaagcattgaatatagaagacagaatccatctcgttgctctgtttcccttagtaatgttgaggcaagaagatttttcaacaaggagtttctaagtaaacccaaagcatagttcatgtactggaaatggcagcagtttctgatgctgaggcagtttgcaatcccatgacaactggatttaaaagtacagtacagatagtcgtactgatcatgagagactggctgatactcaaagttgcagttacttagctgcatgagaataatactattataagttaggttgacaaatgatgttgattatgtaaggatatacttagctacattttcagtcagtatgaacttcctgatacaaatgtagggatatatactgtatttttaaacatttctcaccaactttcttatgtgtgttctttttaaaaattttttttcttttaaaatatttaacagttcaatctcaataagacctcgcattatgtatgaatgttattcactgactagatttattcataccatgagacaacactatttttatttatatatgcatatatatacatacatgaaataaatacatcaatataaaaataa

SEQ ID NO: 15780 - DNA, 850 bp, Homo sapiens
  ENST00000466600
gttttaaagacgctagagtgccaaagaagactttgaagtgtgaaaacatttcctgtaattgaaaccaaaatgtcatttatagatccttaccagcacattatagtggagcaccagtattcccacaagtttacggtagtggtgttacgtgccaccaaagtgacaaagggggcctttggtgacatgcttgatactccagatccctatgtggaactttttatctctacaacccctgacagcaggaagagaacaagacatttcaataatgacataaaccctgtgtggaatgagacctttgaatttattttggatcctaatcaggaaaatgttttggagattacgttaatggatgccaattatgtcatggatgaaactctagggacagcaacatttactgtatcttctatgaaggtgggagaaaagaaagaagttccttttattttcaaccaagtcactgaaatggttctagaaatgtctcttgaagtttgctcatgcccagacctacgatttagtatggctctgtgtgatcaggagaagactttcagacaacagagaaaagaacacataagggagagcatgaagaaactcttgggtccaaagaatagtgaaggattgcattctgcacgtgatgtatatgtcaaccttgtattctcaccctgattttccagagaaagggccagaggagattaatgaagaactaatgaaaaatgttagccacaatccccttttacttctcacaccacagaaagttaaaagatatgttgagtctttatggaagaagaaaagctctggacaacctgtcacctttactgatatctttgggatgttaataggagaaacactaattcataat

SEQ ID NO: 15781 - DNA, 5266 bp, Homo sapiens
  ENST00000399518
gtgaggctccttcaggggcctggatggcctcagccatttcacccccagccctctctccctccctctcccactgacatattgagtttcgcactttaaaaatagctctgcagcactaagaagctttctctgagcgtggatcccagccctgaaacgcaggcctcccttgacggagaactgtcctatgtgagcataatgctagctccctgcttgtctttcaggcagcgcaagaaatttctctccacaaaataggtccagatggtttgaaatattcacagagatagacgtggggctcctttagttaagccctggcttccttcagctccttaataattcatcctggcttagcttcaggaggagtctggtggcactgcttccctttcacacaaaactcccttgaaattaccccaggaggctccaacaacaccttactttgaggaccagcctcagctccacacagcccgtcctgagtcccagagaggaggctgggatgagtctccaggcctcggaaggctgtcctggcctgggaactaatgtgtttgtcccacagagcccacaaacggatgaagaaggcagcaggtcaggaagaagtttcagtgagttcgaggatacacaggacctggacactcctggtctcccacctttctgtcctatggctccttggggctctgaggaggggctgtctccatgccacctgttgacagtgagggtcatccggatgaaaaatgtccggcaggctgatatgctgagccagacagactgttttgtgagcctctggctgcccaccgcctctcagaagaagctgaggacaaggaccatctccaactgcccaaatccagagtggaatgaaagcttcaacttccagatccagagccgagtgaagaacgtgctagagttgagtgtctgtgatgaagacacagtgacaccagatgaccatctcctgacagttctctatgacctcaccaagctctgtttccgaaagaaaacccacgtgaagtttccactcaacccgcagggcatggaagagctggaggtggagttcctgctggaggagagtccctctccacctgagaccctcgtcaccaatggcgtgctggtgtctcgacaagtctcctgcctggaggttcatgcacaatccaggaggcggaggaagagggagaaaatgaaggacctcctggtgatggtgaacgaatcctttgagaacacccagcgtgtccggccctgcttggaaccctgctgcccaacctctgcctgcttccaaaccgctgcctgcttccactaccccaagtacttccagtcccaggtgcacgtggaagtgcccaagagtcactggagctgtgggctttgctgccgctctcgcaagaagggccccatcagccagcccctcgactgcctttccgatggtcaggtgatgaccctgcctgtgggtgagagttatgaattacacatgaagtctacaccctgccctgagacactggacgtgcggctgggcttcagcctgtgcccagcagagctggagtttctgcagaagcggaaggtcgtggtggccaaggccctgaagcaggtgctgcagctggaggaagacctgcaggaggacgaggtgccgctgatagccatcatggccactgggggtggaacaagatccatgacctccatgtatggccacctgctggggctgcagaagctgaacctcctggactgtgccagctacatcaccggtctatcaggggccacctggaccatggctaccttgtaccgtgaccctgactggtcctccaaaaacttggagcctgctatctttgaggctcggagacatgtggtaaaggacaagctaccctccctgttcccagaccagctccgcaaattccaggaggagctccggcagcgcagccaggaaggctacagggtcacctttacagacttctggggcctgctgatagagacctgcctgggggacgagagaaatgaatgcaaactgtcagatcagcgtgctgctttgagctgcggccagaaccccctgcccatctacctcaccatcaatgtcaaggatgatgtaagcaaccaggacttcagagagtggttcgagttctccccctacgaggtgggcctgcagaagtatggggccttcatcccctccgagctcttcggctccgagttcttcatggggcggctggtgaagaggatcccggagtctcgaatctgctacatgctaggcctgtggagcagcatcttctccctgaacctgctggatgcctggaacctgtcacacacctcggaggagtttttccacaggtggacaagggagaaagtgcaggacatcgaagacgagccgatcctgcctgaaatccccaaatgtgatgctaacatcctggagaccacggtagtgatcccagggtcatggctgtccaattctttccgagaaatccttacccatcggtccttcgtgtctgagtttcacaacttcctgtctgggctgcagctgcacaccaactacctccagaatggccagttctctaggtggaaagacacagtgctagatggtttcccaaaccagctgaccgagtccgcgaaccacctgtgcctgctggacactgcgttctttgtcaactccagctacccgcccctcctcaggccagagcgaaaagccgacctcatcatccacctcaactactgtgctgggtcccagacaaagcccctgaaacaaacctgtgagtactgcactgtgcagaacatccccttccccaaatacgagctgccagatgagaatgaaaatctcaaggaatgctacctgatggagaacccccaggaacccgatgcccccatcgtgactttcttcccactcatcaatgacactttccgaaaatacaaggcaccaggtgtagagcgaagccctgaggagctggagcagggccaggtggacatttatggtcccaaaactccctatgccaccaaggagctgacatacacagaggccacctttgacaagctggtgaaactctcagagtataacatcctgaataataaggacactctcctccaggctctgcggctcgcagtggagaagaagaagcgcctgaagggccagtgtccctcctaggccccagggagcctcccctgttctgtgtcagcttctaccatcagaggtgcaggacccctcagggctgaccaggttactacgcagccagctctgctctccggcaatgggtgtgagcaggttggcctgggctttctaacgaaaagtaaaaaattttaaaaagttgagaaagtcagaaagagagagagaggagctctgttggggttttatacccactagagtttcttcaagtgcttccctatagagaaggtggtctcatagccacaggctcccacacatctgtggagaggaaaagcctggggaagaggctgggcccccagaaacctcgactcagaggcagagcccagggctggcagccctcctctctctgtcctctacctcgtgtggcgggcctagggaaatgcacagaaggacctgagaggcactcggcgtttcactggaaaaacacttcaaaatttaaggcaattctagtcttgtgatttttgggtttttttagacggagtctcactctgttgcccaggctggagtgcaatggcgcgatctcggctcactgcaacctctgcctcccaggttcaagcaattctcttgcctcagcctcccaagtggccgggattagaggcacccgccaccatgcccagctaattttttgtatttttagtacaggctggtctggaactcctgacctcaggtgatccacctgcctcggcctcccaaagtgctgggattacaggcatgagccaacgcacccggccctagtctcattatttttataggcaattatatttcatgatttttatttttatgaatcggagtattaataggaagcatgaagctagaagatctagatggagccctagaaataagccagtctctgccacaacaaagccaaataggtggccggtttcagtggctctctccagctacccagagctccagggctggtgatccatgtcatcatgaccagacagccatgcccaagcatccagctccaaacaaatgccaggcaaagcctaagtctatagcccaggttcaccaaatgaggatctgggatggagttcagcaaggtcaggcaggctgtgggtaaatgaggttgggggccaggcaggcgatgcatccagcgctgcccactccagctgtcggtgctcactgacgaccctgctccaagagcatctctcagcctcttactgcccatctctctggctgcctcatgggattacttatttctaaatgtgattcctcttatctgtgttgtcaacaccgtgaccagtgcattccaactcttggagagtcacccacagagactgaaactgggaagaattagtgaaaaaggactaggttagccgtcagaggaagaagcccgccctttaagattgcttcctaatgaatctctgggaaaaccctgggacacagagaaacccaaagtcagcaggtctcccttcaggctgggaacataaccaaggaaatgtataaccggagccactgacaggcccaggctgatagaaggtgaaagcagaaaggcaggaagacatgaggtctgcaggaaacccagcaaccctggaaggcggagtcccctttctgggccaccatgctccctaagcagtctttgggttgtgaggaaaccagtggtgacaggtaccaaaagtttagaaaaattggcctccgatgtacatccttgctactcaaagtgcagtggggagctggttggaaatgcggaatctcaggccttagcccagctgtactaaattagaagctgcatttttcaggagattcccatccccaggcgccccccgtgattcctgtgcatattgaagtttgagaggcctggatttacgccactccctcccatgagcttggaacgtatgaatcagtgctcccttgagccactgataaactgagctctggacctgcaaaactggtccccatccaggtaatgctaacctgggacaccagccctcccctccaccagagcaactggctgcctccactttgacatcttttctttctgactgcaacagactctccttccagtatcaaagagtgagccaagcaacagacaggacttgtttatcgtaaggcgaaggcagccatgccttggattcatcaaaagtttgtgaaacgaggtttataaaatcatcatattatttgtgcatggaataaaatggccatgtgggtgaa

SEQ ID NO: 15782 - DNA, 4066 bp, Homo sapiens
  ENST00000547930
atcttttgttgagtaccagctcgcattgtgccagctaaggctttgggggctttgcatttgttatctctttaagtgctgaagacagtgctgagagttcagcacgattcgccccactttacagatgggaaagtggagacccaaggtcacagaagtggtcgctggcagaagtaggctttgagcctaggtccaatggaccctgaagctgtgtctactccagggaggtagaggctgcaggcccaatacagggtcctctctccctccagccctgagacactggacgtgcggctgggcttcagcctgtgcccagcagagctggagtttctgcagaagcggaaggtcgtggtggccaaggccctgaagcaggtgctgcagctggaggaagacctgcaggaggacgaggtgccgctgatagccatcatggccactgggggtggaacaagatccatgacctccatgtatggccacctgctggggctgcagaagctgaacctcctggactgtgccagctacatcaccggtctatcaggggccacctggaccatggctaccttgtaccgtgaccctgactggtcctccaaaaacttggagcctgctatctttgaggctcggagacatgtggtaaaggacaagctaccctccctgttcccagaccagctccgcaaattccaggaggagctccggcagcgcagccaggaaggctacagggtcacctttacagacttctggggcctgctgatagagacctgcctgggggacgagagaaatgaatgcaaactgtcagatcagcgtgctgctttgagctgcggccagaaccccctgcccatctacctcaccatcaatgtcaaggatgatgtaagcaaccaggacttcagagagtggttcgagttctccccctacgaggtgggcctgcagaagtatggggccttcatcccctccgagctcttcggctccgagttcttcatggggcggctggtgaagaggatcccggagtctcgaatctgctacatgctaggcctgtggagcagcatcttctccctgaacctgctggatgcctggaacctgtcacacacctcggaggagtttttccacaggtggacaagggagaaagtgcaggacatcgaagacgagccgatcctgcctgaaatccccaaatgtgatgctaacatcctggagaccacggtagtgatcccagggtcatggctgtccaattctttccgagaaatccttacccatcggtccttcgtgtctgagtttcacaacttcctgtctgggctgcagctgcacaccaactacctccagaatggccagttctctaggtggaaagacacagtgctagatggtttcccaaaccagctgaccgagtccgcgaaccacctgtgcctgctggacactgcgttctttgtcaactccagctacccgcccctcctcaggccagagcgaaaagccgacctcatcatccacctcaactactgtgctgggtcccagacaaagcccctgaaacaaacctgtgagtactgcactgtgcagaacatccccttccccaaatacgagctgccagatgagaatgaaaatctcaaggaatgctacctgatggagaacccccaggaacccgatgcccccatcgtgactttcttcccactcatcaatgacactttccgaaaatacaaggcaccaggtgtagagcgaagccctgaggagctggagcagggccaggtggacatttatggtcccaaaactccctatgccaccaaggagctgacatacacagaggccacctttgacaagctggtgaaactctcagagtataacatcctgaataataaggacactctcctccaggctctgcggctcgcagtggagaagaagaagcgcctgaagggccagtgtccctcctaggccccagggagcctcccctgttctgtgtcagcttctaccatcagaggtgcaggacccctcagggctgaccaggttactacgcagccagctctgctctccggcaatgggtgtgagcaggttggcctgggctttctaacgaaaagtaaaaaattttaaaaagttgagaaagtcagaaagagagagagaggagctctgttggggttttatacccactagagtttcttcaagtgcttccctatagagaaggtggtctcatagccacaggctcccacacatctgtggagaggaaaagcctggggaagaggctgggcccccagaaacctcgactcagaggcagagcccagggctggcagccctcctctctctgtcctctacctcgtgtggcgggcctagggaaatgcacagaaggacctgagaggcactcggcgtttcactggaaaaacacttcaaaatttaaggcaattctagtcttgtgatttttgggtttttttagacggagtctcactctgttgcccaggctggagtgcaatggcgcgatctcggctcactgcaacctctgcctcccaggttcaagcaattctcttgcctcagcctcccaagtggccgggattagaggcacccgccaccatgcccagctaattttttgtatttttagtacaggctggtctggaactcctgacctcaggtgatccacctgcctcggcctcccaaagtgctgggattacaggcatgagccaacgcacccggccctagtctcattatttttataggcaattatatttcatgatttttatttttatgaatcggagtattaataggaagcatgaagctagaagatctagatggagccctagaaataagccagtctctgccacaacaaagccaaataggtggccggtttcagtggctctctccagctacccagagctccagggctggtgatccatgtcatcatgaccagacagccatgcccaagcatccagctccaaacaaatgccaggcaaagcctaagtctatagcccaggttcaccaaatgaggatctgggatggagttcagcaaggtcaggcaggctgtgggtaaatgaggttgggggccaggcaggcgatgcatccagcgctgcccactccagctgtcggtgctcactgacgaccctgctccaagagcatctctcagcctcttactgcccatctctctggctgcctcatgggattacttatttctaaatgtgattcctcttatctgtgttgtcaacaccgtgaccagtgcattccaactcttggagagtcacccacagagactgaaactgggaagaattagtgaaaaaggactaggttagccgtcagaggaagaagcccgccctttaagattgcttcctaatgaatctctgggaaaaccctgggacacagagaaacccaaagtcagcaggtctcccttcaggctgggaacataaccaaggaaatgtataaccggagccactgacaggcccaggctgatagaaggtgaaagcagaaaggcaggaagacatgaggtctgcaggaaacccagcaaccctggaaggcggagtcccctttctgggccaccatgctccctaagcagtctttgggttgtgaggaaaccagtggtgacaggtaccaaaagtttagaaaaattggcctccgatgtacatccttgctactcaaagtgcagtggggagctggttggaaatgcggaatctcaggccttagcccagctgtactaaattagaagctgcatttttcaggagattcccatccccaggcgccccccgtgattcctgtgcatattgaagtttgagaggcctggatttacgccactccctcccatgagcttggaacgtatgaatcagtgctcccttgagccactgataaactgagctctggacctgcaaaactggtccccatccaggtaatgctaacctgggacaccagccctcccctccaccagagcaactggctgcctccactttgacatcttttctttctgactgcaacagactctccttccagtatcaaagagtgagccaagcaacagacaggacttgtttatcgtaaggcgaaggcagccatgccttggattcatcaaaagtttgtgaaacgaggtttataaaatcatcatattatttgtgcatggaataaaatggccatgtgggtg

SEQ ID NO: 15783 - DNA, 826 bp, Homo sapiens
  ENST00000551073
gctttgagctgcggccagaaccccctgcccatctacctcaccatcaatgtcaaggatgatgtaagcaaccaggacttcagagagtggttcgagttctccccctacgaggtgggcctgcagaagtatggggccttcatcccctccgagctcttcggctccgagttcttcatggggcggctggtgaagaggatcccggagtctcgaatctgctacatgctaggcctgtggagcagcatcttctccctgaacctgctggatgcctggaacctgtcacacacctcggaggagtttttccacaggtggacaagggagaaagtgcaggacatcgaagacgagccgatcctgcctgaaatccccaaatgtgatgctaacatcctggagaccacggtagtgatcccagggtcatggctgtccaattctttccgagaaatccttacccatcggtccttcgtgtctgagtttcacaacttcctgtctgggctgcagctgcacaccaactacctccagaatggccagttctctaggtggaaaggtaaccctacctggctactccttgaggcctgcctccatatggaggaggaagatgtggatgtcaaggctgccatggataaagaataagaaaacttctctggctatgttcactgggccaggcacctctctccccatggtgttttccacatttggtggtgtcgtcttgaacactgtatgtgtctggcagcagggagtggtgtgggtacttaactcactgcatctgtacagtcattctatacagaatctgtacaacagtcctagcaggtagaagttggccccatgttacagatgggga

SEQ ID NO: 15784 - DNA, 1871 bp, Homo sapiens
  ENST00000486277
aatgtcagtgcccgcccctgcttacaggctggggccatctgtaggcttggacaggaggggtttggggagacatggcctgctgtctgggaaaatattgataacatgttcccaggatgaggcatttctgacccttgttgtggtggaacgtggtgttccttgtactttctcccagcagaatatgataagaggcaggctatttctcatggcctgaatccctgtggaatatttcactttaagcacggtctgtgaaatggcgggggacttacaaaatggtgcagattggactttcttgccttctactttaatataaaaggaagaggggcgttgttgattatctggctgtttcctgtcgaattaggggcactgtaaccagggtttgggttttgaagtagtgggtgttcgactttagagttgttttcctggaagcgctgatactggacttagtggaggagaacgacggtatcaatgtgtttctggatgactgcctggacaagggagttcagcttttgggagactgactgggctatgaaggatggtagaggacagtcttcagcctgagacccatccctagttatatcttctggacagattcctagaagtgggattactggctcaaaagtgtacctttctactctgcagaggctggaaaggcaaaaatgatggctaaggcttccttgcagtggccgtgccattttgaatttccactggcattgaatgagagtccctgttccacatccttggcagcatttgtggtgttaacgttttggattttagccatcctcgtagccgctgatacagaagcctgagggaacacactcccccctacgtccttctccaacacagcagagccaggaaggacccggatggaagttaggacaaagaggcccagaattggcacagataccaacagaccattcgttgaagaagaaatccaaatggccataagaaccccagagatgaaaggcctcctcccactggcttggttcctggcttgtagtgtgcctgctgtgcaaggaggcttgctggacctaaaatcaatgatcgagaaggtgacagggaagaacgccctgacaaactacggcttctacggctgttactgcggctggggcggccgaggaacccccaaggatggcaccgattggtgctgttgggcgcatgaccactgctatgggcggctggaggagaagggctgcaacattcgcacacagtcctacaaatacagattcgcgtggggcgtggtcacctgcgagcccgggcccttctgccatgtgaacctctgtgcctgtgaccggaagctcgtctactgcctcaagagaaacctacggagctacaacccacagtaccaatactttcccaacatcctctgctcctaggcctccccagcgagctcctcccagaccaagacttttgttctgtttttctacaacacagagtactgactctgcctggttcctgagagaggctcctaagtcacagacctcagtctttctcgaagcttggcggacccccagggccacactgtaccctccagcgagtcccaggagagtgactctggtcataggacttggtagggtcccagggtccctaggcctccacttctgagggcagcccctctggtgccaagagctctcctccaactcagggttggctgtgtctcttttcttctctgaagacagcgtcctggctccagttggaacactttcctgagatgcacttacttctcagcttctgcgatcagattatcatcaccaccaccctccagagaatttttacgcaagaagagccaaattgactctctaaatctggtgtatgggtattaaataaaattcattctcaaggctaataaaaaccacattggcattttcctctgc

SEQ ID NO: 15785 - DNA, 1513 bp, Homo sapiens
  ENST00000465698
tggcgggggacttacaaaatggtgcagattggactttcttgccttctactttaatataaaaggaagaggggcgttgttgattatctggctgtttcctgtcgaattaggggcactgtaaccagggtttgggttttgaagtagtgggtgttcgactttagagttgttttcctggaagcgctgatactggacttagtggaggagaacgacggtatcaatgtgtttctggatgactgcctggacaagggagttcagcttttgggagactgactgggctatgaagtgtacctttctactctgcagaggctggaaaggcaaaaatgatggctaaggcttccttgcagccgctgatacagaagcctgagggaacacactcccccctacgtccttctccaacacagcagagccaggaaggacccggatggaagttaggacaaagaggcccagaattggcacagataccaacagaccattcgttgaagaagaaatccaaatggccataagaaccccagagatgaaaggcctcctcccactggcttggttcctggcttgtagtgtgcctgctgtgcaaggaggcttgctggacctaaaatcaatgatcgagaaggtgacagggaagaacgccctgacaaactacggcttctacggctgttactgcggctggggcggccgaggaacccccaaggatggcaccgattgggtctcactctggttgcccaggctggagtgcaatggtgcgatctcagctcactgcatcctagaccttctgcactcaggtgattctcccacctcagcctcctgagtagctgggactgcaggtgctgttgggcgcatgaccactgctatgggcggctggaggagaagggctgcaacattcgcacacagtcctacaaatacagattcgcgtggggcgtggtcacctgcgagcccgggcccttctgccatgtgaacctctgtgcctgtgaccggaagctcgtctactgcctcaagagaaacctacggagctacaacccacagtaccaatactttcccaacatcctctgctcctaggcctccccagcgagctcctcccagaccaagacttttgttctgtttttctacaacacagagtactgactctgcctggttcctgagagaggctcctaagtcacagacctcagtctttctcgaagcttggcggacccccagggccacactgtaccctccagcgagtcccaggagagtgactctggtcataggacttggtagggtcccagggtccctaggcctccacttctgagggcagcccctctggtgccaagagctctcctccaactcagggttggctgtgtctcttttcttctctgaagacagcgtcctggctccagttggaacactttcctgagatgcacttacttctcagcttctgcgatcagattatcatcaccaccaccctccagagaatttttacgcaagaagagccaaattgactctctaaatctggtgtatgggtattaaataaaattcattctcaagg

SEQ ID NO: 15786 - DNA, 964 bp, Homo sapiens
  ENST00000460175
gggggacttacaaaatggtgcagattggactttcttgccttctactttaatataaaaggaagaggggcgttgttgattatctggctgtttcctgtcgaattaggggcactgtaaccagggtttgggttttgaagtagtgggtgttcgactttagagttgttttcctggaagcgctgatactggacttagtggaggagaacgacggtatcaatgtgtttctggatgactgcctggacaagggagttcagcttttgggagactgactgggctatgaagtgtacctttctactctgcagaggctggaaaggcaaaaatgatggctaaggcttccttgcagccgctgatacagaagcctgagggaacacactcccccctacgtccttctccaacacagcagagccaggaaggacccggatggaagttaggacaaagaggcccagaattggcacagataccaacagaccattcgttgaagaagaaatccaaatggccataagctttaagattctggaggccaagaatttgactccccccggatccatggtctgtggataccaatgttccgactggagacggggagcccgcgagacccgggtctccagggtctgcccaaggaagttgctcatgggagcagacctctagagcaggatttgaggccaggccaaagagggagagaattcgccgacatctatttaacatcccttaattgttgagagcatccactgtgtgccagacacttcggtacacacagaaagaaacccagaggaggaaccccagagatgaaaggcctcctcccactggcttggttcctggcttgtagtgtgcctgctgtgcaaggaggcttgctggacctaaaatcaatgatcgagaaggtgacagggaagaacgccctgacaaactacggcttctacggctgttactgcggctggggcggccgaggaacccccaaggatggcaccgattg

SEQ ID NO: 15787 - DNA, 826 bp, Homo sapiens
  ENST00000469069
tgtcgaattaggggcactgtaaccagggtttgggttttgaagtagtgggtgttcgactttagagttgttttcctggaagcgctgatactggacttagtggaggagaacgacggtatcaatgtgtttctggatgactgcctggacaagggagttcagcttttgggagactgactgggctatgaagtgtacctttctactctgcagaggctggaaaggcaaaaatgatggctaaggcttccttgcaggagaggctgcccctccagaactagactcttccttggctttaagatgtgaagtcgagcagctggaaggacagacacctcatctgaccactgttctatggaccaaaggcaggatgagcatgccgctgatacagaagcctgagggaacacactcccccctacgtccttctccaacacagcagagccaggaaggacccggatggaagttaggacaaagaggcccagaattggcacagataccaacagaccattcgttgaagaagaaatccaaatggccataagaaccccagagatgaaaggcctcctcccactggcttggttcctggcttgtagtgtgcctgctgtgcaaggaggcttgctggacctaaaatcaatgatcgagaaggtgacagggaagaacgccctgacaaactacggcttctacggctgttactgcggctggggcggccgaggaacccccaaggatggcaccgattggtgctgttgggcgcatgaccactgctatgggcggctggaggagaagggctgcaacattcgcacacagtcctacaaatacagattcgcgtggggcgtggtcacctgcg

SEQ ID NO: 15788 - DNA, 1092 bp, Homo sapiens
  ENST00000489871
tgtcgaattaggggcactgtaaccagggtttgggttttgaagtagtgggtgttcgactttagagttgttttcctggaagcgctgatactggacttagtggaggagaacgacggtatcaatgtgtttctggatgactgcctggacaagggagttcagcttttgggagactgactgggctatgaagtgtacctttctactctgcagaggctggaaaggcaaaaatgatggctaaggcttccttgcagccgctgatacagaagcctgagggaacacactcccccctacgtccttctccaacacagcagagccaggaaggacccggatggaagttaggacaaagaggcccagaattggcacagataccaacagaccattcgttgaagaagaaatccaaatggccataagctttaagattctggaggccaagaatttgactccccccggatccatggtctgtggataccaatgttccgactggagacggggagcccgcgagacccgggtctccagggtctgcccaaggaagttgctcatgggagcagacctctagagcaggatttgaggccaggccaaagagaaccccagagatgaaaggcctcctcccactggcttggttcctggcttgtagtgtgcctgctgtgcaaggaggcttgctggacctaaaatcaatgatcgagaaggtgacagggaagaacgccctgacaaactacggcttctacggctgttactgcggctggggcggccgaggaacccccaaggatggcaccgattggtgctgttgggcgcatgaccactgctatgggcggctggaggagaagggctgcaacattcgcacacagtcctacaaatacagattcgcgtggggcgtggtcacctgcgagcccgggcccttctgccatgtgaacctctgtgcctgtgaccggaagctcgtctactgcctcaagagaaacctacggagctacaacccacagtaccaatactttcccaacatcctctgctcctaggcctccccagcgagctcctcccagaccaagacttttgttctgtttttctacaacacagagtactgactctgcctggttcctgagagag

SEQ ID NO: 15789 - DNA, 483 bp, Homo sapiens
  ENST00000498348
tgggtgttcgactttagagttgttttcctggaagcgctgatactggacttagtggaggagaacgacggtatcaatgtgtttctggatgactgcctggacaagggagttcagcttttgggagactgactgggctatgaagtgtacctttctactctgcagaggctggaaaggcaaaaatgatggctaaggcttccttgcagccgctgatacagaagcctgagggaacacactcccccctacgtccttctccaacacagcagagccaggaaggacccggatggaagttaggacaaagaggcccagaattggcacagataccaacagaccattcgttgaagaagaaatccaaatggccataaggtctttaagattctggaggccaagaatttgactccccccggatccatggtctgtggataccaatgttccgactggagacggggagcccgcgagacccgggtctccagggtctgcccaaggaag

SEQ ID NO: 15790 - DNA, 1161 bp, Homo sapiens
  ENST00000375108
cagggttctacccggctgggtccaggcagaagtttttcctccccacctccgggtttgtcctcatcatcggtcactcccattcacagctttaagattctggaggccaagaatttgactccccccggatccatggtctgtggataccaatgttccgactggagacggggagcccgcgagacccgggtctccagggtctgcccaaggaagttgctcatgggagcagacctctagagcaggatttgaggccaggccaaagagaaccccagagatgaaaggcctcctcccactggcttggttcctggcttgtagtgtgcctgctgtgcaaggaggcttgctggacctaaaatcaatgatcgagaaggtgacagggaagaacgccctgacaaactacggcttctacggctgttactgcggctggggcggccgaggaacccccaaggatggcaccgattggtgctgttgggcgcatgaccactgctatgggcggctggaggagaagggctgcaacattcgcacacagtcctacaaatacagattcgcgtggggcgtggtcacctgcgagcccgggcccttctgccatgtgaacctctgtgcctgtgaccggaagctcgtctactgcctcaagagaaacctacggagctacaacccacagtaccaatactttcccaacatcctctgctcctaggcctccccagcgagctcctcccagaccaagacttttgttctgtttttctacaacacagagtactgactctgcctggttcctgagagaggctcctaagtcacagacctcagtctttctcgaagcttggcggacccccagggccacactgtaccctccagcgagtcccaggagagtgactctggtcataggacttggtagggtcccagggtccctaggcctccacttctgagggcagcccctctggtgccaagagctctcctccaactcagggttggctgtgtctcttttcttctctgaagacagcgtcctggctccagttggaacactttcctgagatgcacttacttctcagcttctgcgatcagattatcatcaccaccaccctccagagaatttttacgcaagaagagccaaattgactctctaaatctggtgtatgggtattaaataaaattcattctcaaggctaataaaaa

SEQ ID NO: 15791 - DNA, 949 bp, Homo sapiens
  ENST00000478803
tttaagattctggaggccaagaatttgactccccccggatccatggtctgtggataccaatgttccgactggagacggggagcccgcgagacccgggtctccagggtctgcccaaggaagttgctcatgggagcagacctctagagcaggatttgaggccaggccaaagaggaaatgccagagtggacagcatatcagatgagttctataacattccagagacaggtaagctccctgtggaaagaaggatcatggaagacttcccggaggaggaggacttgatgtagattttctgccaatgagctctggaaccccagagatgaaaggcctcctcccactggcttggttcctggcttgtagtgtgcctgctgtgcaaggaggcttgctggacctaaaatcaatgatcgagaaggtgacagggaagaacgccctgacaaactacggcttctacggctgttactgcggctggggcggccgaggaacccccaaggatggcaccgattgggtctcactctggttgcccaggctggagtgcaatggtgcgatctcagctcactgcatcctagaccttctgcactcaggtgctgttgggcgcatgaccactgctatgggcggctggaggagaagggctgcaacattcgcacacagtcctacaaatacagattcgcgtggggcgtggtcacctgcgagcccgggcccttctgccatgtgaacctctgtgcctgtgaccggaagctcgtctactgcctcaagagaaacctacggagctacaacccacagtaccaatactttcccaacatcctctgctcctaggcctccccagcgagctcctcccagaccaagacttttgttctgtttttctacaacacagagtactgactctgcctggttcctgagagaggctcctaagtcacagacctcagtctttctcgaagcttggcggaccccc

SEQ ID NO: 15792 - DNA, 1882 bp, Homo sapiens
  ENST00000274793
gccagagctgctcggcccgcagccagggggacagcggctggtcggaggctcgcagtgctgtcggcgagaagcagtcgggtttggagcgcttgggtcgcgttggtgcgcggtggaacgcgcccagggaccccagttcccgcgagcagctccgcgccgcgcctgagagactaagctgaaactgctgctcagctcccaagatggtgccacccaaattgcatgtgcttttctgcctctgcggctgcctggctgtggtttatccttttgactggcaatacataaatcctgttgcccatatgaaatcatcagcatgggtcaacaaaatacaagtactgatggctgctgcaagctttggccaaactaaaatcccccggggaaatgggccttattccgttggttgtacagacttaatgtttgatcacactaataagggcaccttcttgcgtttatattatccatcccaagataatgatcgccttgacaccctttggatcccaaataaagaatatttttggggtcttagcaaatttcttggaacacactggcttatgggcaacattttgaggttactctttggttcaatgacaactcctgcaaactggaattcccctctgaggcctggtgaaaaatatccacttgttgttttttctcatggtcttggggcattcaggacactttattctgctattggcattgacctggcatctcatgggtttatagttgctgctgtagaacacagagatagatctgcatctgcaacttactatttcaaggaccaatctgctgcagaaataggggacaagtcttggctctaccttagaaccctgaaacaagaggaggagacacatatacgaaatgagcaggtacggcaaagagcaaaagaatgttcccaagctctcagtctgattcttgacattgatcatggaaagccagtgaagaatgcattagatttaaagtttgatatggaacaactgaaggactctattgatagggaaaaaatagcagtaattggacattcttttggtggagcaacggttattcagactcttagtgaagatcagagattcagatgtggtattgccctggatgcatggatgtttccactgggtgatgaagtatattccagaattcctcagcccctcttttttatcaactctgaatatttccaatatcctgctaatatcataaaaatgaaaaaatgctactcacctgataaagaaagaaagatgattacaatcaggggttcagtccaccagaattttgctgacttcacttttgcaactggcaaaataattggacacatgctcaaattaaagggagacatagattcaaatgtagctattgatcttagcaacaaagcttcattagcattcttacaaaagcatttaggacttcataaagattttgatcagtgggactgcttgattgaaggagatgatgagaatcttattccagggaccaacattaacacaaccaatcaacacatcatgttacagaactcttcaggaatagagaaatacaattaggattaaaataggttttttaaaagtcttgtttcaaaactgtctaaaattatgtgtgtgtgtgtgtgtgtgtgtgtgtgtgtgagagagagagagagagagagagagagagagagagagaattttaatgtattttcccaaaggactcatattttaaaatgtaggctatactgtaatcgtgattgaagcttggactaagaattttttccctttagatgtaaagaaagaatacagtatacaatattcatatcagcctaaattttaattttaaagatgattccttttcagtgtcgaagttaaaaactgtttttacattactttgacagacaagtagattaaaacaggcaaaatcccagtgaaaa

SEQ ID NO: 15793 - DNA, 1747 bp, Homo sapiens
  ENST00000537365
ggaaaaccggcctgactggggggtgaattcagcagggagtaaatctgatcggcatcaggtctgcggaaaggagctggtgagcacgacaccacccaggcattgcctggctctctccgcggcgggctaagttaaccgcgggtccaggagactaagctgaaactgctgctcagctcccaagatggtgccacccaaattgcatgtgcttttctgcctctgcggctgcctggctgtggtttatccttttgactggcaatacataaatcctgttgcccatatgaaatcatcagcatgggtcaacaaaatacaagtactgatggctgctgcaagctttggccaaactaaaatcccccggggaaatgggccttattccgttggttgtacagacttaatgtttgatcacactaataagggcaccttcttgcgtttatattatccatcccaagataatgatcgccttgacaccctttggatcccaaataaagaatatttttggggtcttagcaaatttcttggaacacactggcttatgggcaacattttgaggttactctttggttcaatgacaactcctgcaaactggaattcccctctgaggcctggtgaaaaatatccacttgttgttttttctcatggtcttggggcattcaggacactttattctgctattggcattgacctggcatctcatgggtttatagttgctgctgtagaacacagagatagatctgcatctgcaacttactatttcaaggaccaatctgctgcagaaataggggacaagtcttggctctaccttagaaccctgaaacaagaggaggagacacatatacgaaatgagcaggtacggcaaagagcaaaagaatgttcccaagctctcagtctgattcttgacattgatcatggaaagccagtgaagaatgcattagatttaaagtttgatatggaacaactgaaggactctattgatagggaaaaaatagcagtaattggacattcttttggtggagcaacggttattcagactcttagtgaagatcagagattcagatgtggtattgccctggatgcatggatgtttccactgggtgatgaagtatattccagaattcctcagcccctcttttttatcaactctgaatatttccaatatcctgctaatatcataaaaatgaaaaaatgctactcacctgataaagaaagaaagatgattacaatcaggggttcagtccaccagaattttgctgacttcacttttgcaactggcaaaataattggacacatgctcaaattaaagggagacatagattcaaatgtagctattgatcttagcaacaaagcttcattagcattcttacaaaagcatttaggacttcataaagattttgatcagtgggactgcttgattgaaggagatgatgagaatcttattccagggaccaacattaacacaaccaatcaacacatcatgttacagaactcttcaggaatagagaaatacaattaggattaaaataggttttttaaaagtcttgtttcaaaactgtctaaaattatgtgtgtgtgtgtgtgtgtgtgtgtgtgtgtgagagagagagagagagagagagagagagagagagagaattttaatgtattttcccaaaggactcatattttaaaatgtaggctatactgtaatcgtgattgaagcttggactaagaattttttccctttagatgtaaagaaagaatacagtatacaatattc

SEQ ID NO: 15794 - DNA, 7322 bp, Homo sapiens
  ENST00000316981
ggcagcgcatacactacaatggctgctggaaagaggcgtaaggaaacaatttccaggcccgccgcgtccagcccgaaatatgagaaaaaaattattagaaattccgcgggcggtgtagaggcggcggacgggccggagggaggatgttaaagccccgcggttgcctcttggtgctgccttggccgtatttggcacccagaatgcttcattctgtgacggtctattaataaggttgccttgctagagtttggagcagggcctcagattggccaaaatgggaaggattggattccactctcttccacgaagagtcaatgggactggctaagatcaaagtctgaggctttttccatcagtaatcagtccctttttgctttcttttacgaccacatgaaacttgagaagccacctaaagctatatcatttagtggagttgggcagttcccaagtgtccaacaagaaggcctggtttaggctgcgatggccactgtcattcctggtgatttgtcagaagtaagagatacccagaaagtcccttcagggaaacgtaagcgtggtgaaaccaaaccaagaaaaaactttccttgccaactgtgtgacaaggcctttaacagtgttgagaaattaaaggttcactcctactctcacacaggagagaggccctacaagtgcatacaacaagactgcaccaaggcctttgtttctaagtacaaattacaaaggcacatggctactcattctcctgagaaaacccacaagtgtaattattgtgagaaaatgtttcaccggaaagatcatctgaagaatcacctccatacacacgaccctaacaaagagacgtttaagtgcgaagaatgtggcaagaactacaataccaagcttggatttaaacgtcacttggccttgcatgccgcaacaagtggtgacctcacctgtaaggtatgtttgcaaacttttgaaagcacgggagtgcttctggagcaccttaaatctcatgcaggcaagtcgtctggtggggttaaagaaaaaaagcaccagtgcgaacattgtgatcgccggttctacacccgaaaggatgtccggagacacatggtggtgcacactggaagaaaggacttcctctgtcagtattgtgcacagagatttgggcgaaaggatcacctgactcgacatatgaagaagagtcacaatcaagagcttctgaaggtcaaaacagaaccagtggatttccttgacccatttacctgcaatgtgtctgtgcctataaaagacgagctccttccggtgatgtccttaccttccagtgaactgttatcaaagccattcacaaacactttgcagttaaacctctacaacactccatttcagtccatgcagagctcgggatctgcccaccaaatgatcacaactttacctttgggaatgacatgcccaatagatatggacactgttcatccctctcaccacctttctttcaaatatccgttcagttctacctcatatgcaatttctattcctgaaaaagaacagccattaaagggggaaattgagagttacctgatggagttacaaggtggcgtgccctcttcatcccaagattctcaagcatcgtcatcatctaagctagggttggatcctcagattgggtccctagatgatggtgcaggagacctctccctatccaaaagctctatctccatcagtgaccccctaaacacaccagcattggatttttctcagttgtttaatttcatacctttaaatggtcctccctataatcctctatcagtggggagccttggaatgagctattcccaggaagaagcacattcttctgtttcccagctccccccacaaacacaggatcttcaggatcctgcaaacactatagggcttgggtctctgcactcactgtcagcagctttcaccagcagtttaagcacaagtaccaccctcccacgtttccatcaagcttttcagtaggattctgggacatggattcattacagaaatgtatgtgtagctgtgccctagatgaccatttttattttagtgcctactttaaaacagtataaaaatttctgcttttgtataatacaaattttcattaagccagtataaaatagaaactagcttttaaactgagctttggaaccatttgtgttcagttaagtttacctgggtattttgtcctgattcactgccaattgtcacattttaagacttttttttttccatataggaaagccattattagtagtaaacttttacaaatcccattttcaaattacttttagatcttaaaattttcatttttgtctaataacagtggctctaccttttgacatctggctcattaaaaaatttagcaatagaatgtaaattgtataaaaagtttgtgaataactcaagggtttaaattttcttactagcttctaaatggattaataatcaagtgcttcaaatgaattaagagtccagtttcggaagataataaatgtttgttagatacaccataatttcagatcagtatattctgaagactccctgttgtctggctaaaatatttgccatctttattatgagcctttaaggaaaacaaaccctaaacacaaagcatcagtatttatagcaaaaagagactctgttaggtgacatggcatttcgtgtcacttaatagttggccctaaattagtacacaggatattttgtcgtgtttcatccttcttaacatgctatcttttcatttaataatagtaatagtgtatggcattggggtcttcagagtcgatatataggtagatctctttagtcttttccacctttcacatccaaggggtgggtcaagtgcagccagcaatttattttcattgttggcccacggttagtccataatctagagccattgtggaactgcagccatgaggtgtgtttatcccacagtggattgactcagcctctgtgggtgacagacttctaagcaggaagatagacgtgaagcacatggttacatttgggaacttgtgtagggatcatggcccctgtagccagggttaaaaactggactttttagaagtaaagtaaaagcatatcgcttatatcatttcttgctgaatttgatatgtttttctttcccttaagaatcaaaagcagaaaacaaaaacaacagtcctactccgatgttatctttctgattcaatgtgaatccatctttccttgcaatattttggatggagaatttgaagttaaatgcattagaaaactacctgatgaactaccacaaagttttaagtgactagaaatatatacagtaaaatcccactttcatgcatctctgggaaatgataggagtattgcaaataagttgagtttgtagagggtaacaaagtaaagtaaaacaaacctatcttggttaacatgaaaataacaattgagaatatattatattcactgaataattataggcttttcctcacattagacaaccaacataatcttcttaaaggtctaattaatatatttttctaagggtcagttgggacattaacctaagaaacatatctattaagcacttgttaacaccttattttaggaccctttccgttggggatgggggcaagggtgggaggtttttagaagagtatatatctctttaaaaaaaaacagaaagaaaaatatttctgagcactcattagccctatatggaaacttctttcctttttgtagggccagttatcactgcagattgcaatgtttaccaagaatttctaaaaatgagtgcagattactgaatataatacattatttaaaatatttgggagtagtataatttgtggagaaatgtaaattgtaataatgtaaatgggggcttcaatatatatatataatacacacacacacacacatgcacacataccgcacttcatagaatcaaagttgctctctgaaggagctttggctcctgatattttatcatgctcctatatttttttaatccttggagcagtagtttttatacttatgtatttaaattttattatgaaaaattacatttattaaaaaagtgtgttccaaaggcattaaaattatatatgttaataaggaagtacatttttaaatttttcaaactgctcctagcttttgattaggagaatattttttctgaaagtaggcttttcgctctgcttcattactgcttcctttagtttctatgaaacagattgcttacctaaatctttagttgaatgattagtgttcaatattgctttaatcaccatataaaaggaaaaaaattggtgacagagcacaaatagaaaacctatttttaaatagaaatcacaaatagcaagtgtggaagcactactttattctgtttaaaatgtacttaagaagtcatcaaattagtgaactgagacattggccttagtaggctgtattcactgctaatttaaaaaagggagtaccaggatttattaagtaaagcattttggaaatggggaatagcgccatatatgtatgtatgtgtatgtgtgtgtgtgtgtgtgtatatatacacacacacacacatacttaaatcttgccctgcatgaaattcaaatacatggaggcacatcttcagggcaccagtgttaaaattttggagtcttaattttcatgtgtacacctctttgcctgttcccacccccagacttgaaataacacttcagagtaagagggaattcagctaatttgtttttaaaattgactgtagtggtcactaaaccctttttgagagaatttctattaaagatgaggcagactcgcttatttgaattgcacaatgttctaacaaggatgtaacacagaattggcttttttttccctagaaaaagattgtttgtttctatgtcaactagatatgattaaaaataagtattgccaatgctgttttcattctctagtggccagaatcattatccttgaaatttctggtagtgccttagcttggttaaaaaaaaaaaaaaaaaaaaaaaaaagggattaacattaaataaaagtagtttagaatttgggcctcagacaagatattgaacctcattcagtttcacttccacatgtatgtacaagttaggtcaccaaacacggaagtgtgagtgtggaaggatcttggcactgtaagcaatgctatccattgatgtatacaagtacctttatagttatcgatcactgttaaaactttcattttaaaatcctattaccaagttcagttttttaaaacttcaattgtcctggctgattatgcatcactctgtgtgcaacttttttatttcatttagtgtttctttcaagctgtgtatttttgcctatttgttgcttgtgctttatttttcttagtcatttgtggaatatagtgatatattgtgttaatttggacagtagcggtttttaaaaaccatatactgactgaaacatgagccagagccgattgctttattaagctaataatgaatgttaaagagtacatattttcaggatcgttcatctagtgagcaatacacatattataggccaatatttttttaaaaaatagagcttggtcaacctctatactacacatattacaagatatagcactttcaaaatgaatctaaacctttacagaaactttcttataggttatgccttttattttaagacttattataattcaagtgccattagatgatatatatgtaggcctttgatatataatgctttgtgtacaaaaatggtagatggtattttaaacaggtacatttttacagtgttttcttatcaatttgctatattgcacagaatcagtgtgtgtcttttcataaggttttacaatggtttatttttttacaaggtttacgtgtctcaaagcacactgtcttcccagtacgtaagttaaaaaataccagttcacccaagttgcttctagcctactgagatccatgtgacattggaggagatcttttaaatgtttagtattcgtcattagcaatggctggctgttagttctggtaaatgtgtgcctaagttgaatttgtcttgtttttctcacactgtgtcagcagccatgtctacaacacagataagtctgttgtgatcacatagatctacataagttgtgcagttttgtgctaaaaacccatagggagctcctttgggatcatagaaaagaagatcatgcaaccagcattggtgaaggcacactcagattgcacttagggcctttctatgatgttgtcaaccctctgaggatggaaggcagtgtcttttgatgttatctagcctagaaatgacacagaactattgctaatgtataaaacacttcattatataagcttcagtggtacagatgaaccagaatgaatgtttatcttctcagaaacactccttcaatattatattggatcatgctgctaatgtaacttgggctacaactcttcatggtgctacaaacttctctgtctcattcagtcgtatttttttatccatagaaaaaggactacattaggtgtaaaagtgtacaatatatttttatactgtgacttaatttgtcattaacaaacttttacaccaccacaatgtattcatgtgcacttgcaaaaggagatctcggacatgcaaatgttaccagaacaaacccagcttttgtccacaaggtgactgtaactcagaatggaaagtgggctttataatagggtgtggagtgaagaacatgctgtatgttactaacagccctttgaatttaacaaaaactgggaatccattaggaaacggattgcatcatacctgaacataagctggactgctgaaattgtatttttagctaatgaaaaagtgtttggactagtactctaaaaatgttctaatgataaagttttgagtcaaaatagaaaagaaaaaaatctgcattccaggccgaattttgtatatttttattgcatttaaaattgctattctgtaatattgggaaatcaagtggcttatcatgtatatcgtgtacttaaaatgtattcacaaactactgttgtatttgtataaaatatagacaaagatcatattttttgtgtgtgtataagctctgtaaaatagcaatcacattatgaagctgcagtgatactacattttaaacattcacatccaaagaagcagactatttattgtccatataccagatttaaaatattaatttgctgctaattaaataatagtactgcagcttcttgtggcctacagtgttatgtttgctgtaagaataagatatgtgaattccacaaaatatatgaataaaattatagaatggctttagataa

SEQ ID NO: 15795 - DNA, 2163 bp, Homo sapiens
  ENST00000522009
atcacaaattgctatttatctaggtaatactttttatttatgcatttatttggtcacgtaaatgtgcttagacctaataaacatatgtagttggtgaaaattaatgcatgactcgtaagcagagtatggaatgtaagcatgtgccatgaaactgcaattcttttatcctgtattttccatcatttacataccggttccatttagaggatagtccattttcacttttttttcatagattggccaaaatgggaaggattggattccactctcttccacgaagagtcaatgggactggctaagatcaaagtctgaggctttttccatcagtaatcagtccctttttgctttcttttacgaccacatgaaacttgagaagccacctaaagctatatcatttagtggagttgggcagttcccaagtgtccaacaagaaggcctggtttaggctgcgatggccactgtcattcctggtgatttgtcagaagtaagagatacccagaaagtcccttcagggaaacgtaagcgtggtgaaaccaaaccaagaaaaaactttccttgccaactgtgtgacaaggcctttaacagtgttgagaaattaaaggttcactcctactctcacacaggagagaggccctacaagtgcatacaacaagactgcaccaaggcctttgtttctaagtacaaattacaaaggcacatggctactcattctcctgagaaaacccacaagtgtaattattgtgagaaaatgtttcaccggaaagatcatctgaagaatcacctccatacacacgaccctaacaaagagacgtttaagtgcgaagaatgtggcaagaactacaataccaagcttggatttaaacgtcacttggccttgcatgccgcaacaagtggtgacctcacctgtaaggtatgtttgcaaacttttgaaagcacgggagtgcttctggagcaccttaaatctcatgcaggcaagtcgtctggtggggttaaagaaaaaaagcaccagtgcgaacattgtgatcgccggttctacacccgaaaggatgtccggagacacatggtggtgcacactggaagaaaggacttcctctgtcagtattgtgcacagagatttgggcgaaaggatcacctgactcgacatatgaagaagagtcacaatcaagagcttctgaaggtcaaaacagaaccagtggatttccttgacccatttacctgcaatgtgtctgtgcctataaaagacgagctccttccggtgatgtccttaccttccagtgaactgttatcaaagccattcacaaacactttgcagttaaacctctacaacactccatttcagtccatgcagagctcgggatctgcccaccaaatgatcacaactttacctttgggaatgacatgcccaatagatatggacactgttcatccctctcaccacctttctttcaaatatccgttcagttctacctcatatgcaatttctattcctgaaaaagaacagccattaaagggggaaattgagagttacctgatggagttacaaggtggcgtgccctcttcatcccaagattctcaagcatcgtcatcatctaagctagggttggatcctcagattgggtccctagatgatggtgcaggagacctctccctatccaaaagctctatctccatcagtgaccccctaaacacaccagcattggatttttctcagttgtttaatttcatacctttaaatggtcctccctataatcctctatcagtggggagccttggaatgagctattcccaggaagaagcacattcttctgtttcccagctccccccacaaacacaggatcttcaggatcctgcaaacactatagggcttgggtctctgcactcactgtcagcagctttcaccagcagtttaagcacaagtaccaccctcccacgtttccatcaagcttttcagtaggattctgggacatggattcattacagaaatgtatgtgtagctgtgccctagatgaccatttttattttagtgcctactttaaaacagtataaaaatttctgcttttgtataatacaaattttcattaagccagtataaaatagaaactagcttttaaactgagctttggaaccatttgtgttcagttaagtttacctgggtattttgtc

SEQ ID NO: 15796 - DNA, 1684 bp, Homo sapiens
  ENST00000423799
agctgcaagttgggctgcaggggcagcgcatacactacaatggctgctggaaagaggcgtaaggaaacaatttccaggcccgccgcgtccagcccgaaatatgagaaaaaaattattagaaattccgcgggcggtgtagaggcggcggacgggccggagggaggatgttaaagccccgcgattggccaaaatgggaaggattggattccactctcttccacgaagagtcaatgggactggctaagatcaaagtctgaggctttttccatcagtaatcaggcacatggctactcattctcctgagaaaacccacaagtgtaattattgtgagaaaatgtttcaccggaaagatcatctgaagaatcacctccatacacacgaccctaacaaagagacgtttaagtgcgaagaatgtggcaagaactacaataccaagcttggatttaaacgtcacttggccttgcatgccgcaacaagtggtgacctcacctgtaaggtatgtttgcaaacttttgaaagcacgggagtgcttctggagcaccttaaatctcatgcaggcaagtcgtctggtggggttaaagaaaaaaagcaccagtgcgaacattgtgatcgccggttctacacccgaaaggatgtccggagacacatggtggtgcacactggaagaaaggacttcctctgtcagtattgtgcacagagatttgggcgaaaggatcacctgactcgacatatgaagaagagtcacaatcaagagcttctgaaggtcaaaacagaaccagtggatttccttgacccatttacctgcaatgtgtctgtgcctataaaagacgagctccttccggtgatgtccttaccttccagtgaactgttatcaaagccattcacaaacactttgcagttaaacctctacaacactccatttcagtccatgcagagctcgggatctgcccaccaaatgatcacaactttacctttgggaatgacatgcccaatagatatggacactgttcatccctctcaccacctttctttcaaatatccgttcagttctacctcatatgcaatttctattcctgaaaaagaacagccattaaagggggaaattgagagttacctgatggagttacaaggtggcgtgccctcttcatcccaagattctcaagcatcgtcatcatctaagctagggttggatcctcagattgggtccctagatgatggtgcaggagacctctccctatccaaaagctctatctccatcagtgaccccctaaacacaccagcattggatttttctcagttgtttaatttcatacctttaaatggtcctccctataatcctctatcagtggggagccttggaatgagctattcccaggaagaagcacattcttctgtttcccagctccccccacaaacacaggatcttcaggatcctgcaaacactatagggcttgggtctctgcactcactgtcagcagctttcaccagcagtttaagcacaagtaccaccctcccacgtttccatcaagcttttcagtaggattctgggacatggattcattacagaaatgtatgtgtagctgtgccctagatgaccatttttattttagtgcctactttaaaacagtataaaaatttctgcttttgtataatacaaattttcattaagccagtataaaataga

SEQ ID NO: 15797 - DNA, 1899 bp, Homo sapiens
  ENST00000429357
agctgcaagttgggctgcaggggcagcgcatacactacaatggctgctggaaagaggcgtaaggaaacaatttccaggcccgccgcgtccagcccgaaatatgagaaaaaaattattagaaattccgcgggcggtgtagaggcggcggacgggccggagggaggatgttaaagccccgcgattggccaaaatgggaaggattggattccactctcttccacgaagagtcaatgggactggctaagatcaaagtctgaggctttttccatcagtaatcagtccctttttgctttcttttacgaccacatgaaacttgagaagccacctaaagctatatcatttagtggagttgggcagttcccaagtgtccaacaagaaggcctggtttaggctgcgatggccactgtcattcctggtgatttgtcagaagtaagagatacccagaaagtcccttcagggaaacgtaagcgtggtgaaaccaaaccaagaaaaaactttccttgccaactgtgtgacaaggcctttaacagtgttgagaaattaaaggttcactcctactctcacacaggagagaggccctacaagtgcatacaacaagactgcaccaaggcctttgtttctaagtacaaattacaaaggcacatggctactcattctcctgagaaaacccacaagtgtaattattgtgagaaaatgtttcaccggaaagatcatctgaagaatcacctccatacacacgaccctaacaaagagacgtttaagtgcgaagaatgtggcaagaactacaataccaagcttggatttaaacgtcacttggccttgcatgccgcaacaagtggtgacctcacctgtaaggtatgtttgcaaacttttgaaagcacgggagtgcttctggagcaccttaaatctcatgcaggcaagtcgtctggtggggttaaagaaaaaaagcaccagtgcgaacattgtgatcgccggttctacacccgaaaggatgtccggagacacatggtggtgcacactggaagaaaggacttcctctgtcagtattgtgcacagagatttgggcgaaaggatcacctgactcgacatatgaagaagagtcacaatcaagagcttctgaaggtcaaaacagaaccagtggatttccttgacccatttacctgcaatgtgtctgtgcctataaaagacgagctccttccggtgatgtccttaccttccagtgaactgttatcaaagccattcacaaacactttgcagttaaacctctacaacactccatttcagtccatgcagagctcgggatctgcccaccaaatgatcacaactttacctttgggaatgacatgcccaatagatatggacactgttcatccctctcaccacctttctttcaaatatccgttcagttctacctcatatgcaatttctattcctgaaaaagaacagccattaaagggggaaattgagagttacctgatggagttacaaggtggcgtgccctcttcatcccaagattctcaagcatcgtcatcatctaagctagggttggatcctcagattgggtccctagatgatggtgcaggagacctctccctatccaaaagctctatctccatcagtgaccccctaaacacaccagcattggatttttctcagttgtttaatttcatacctttaaatggtcctccctataatcctctatcagtggggagccttggaatgagctattcccaggaagaagcacattcttctgtttcccagctccccccacaaacacaggatcttcaggatcctgcaaacactatagggcttgggtctctgcactcactgtcagcagctttcaccagcagtttaagcacaagtaccaccctcccacgtttccatcaagcttttcagtag

SEQ ID NO: 15798 - DNA, 435 bp, Homo sapiens
  ENST00000519027
ggcggcggcggcggcggcggcggcagctgcaagttgggctgcaggggcagcgcatacactacaatggctgctggaaagaggcgtaaggaaacaatttccaggcccgccgcgtccagcccgaaatatgagaaaaaaattattagaaattccgcgggcggtgtagaggcggcggacgggccggagggaggatgttaaagccccgcgaatcactgtctgaggaccaaaagcagaggtgctgggagggtgtggtgatggaagagccttccctttctgttactccagtgcacccacccataggagtgatggagggacaggagggataaacagcctcaaccgaagatggatatgtgtatagtttgtatccaaactgttcctttgtgtaacaagccctcccaggaacttttcatgttacattgctttgctttggaagctgat

SEQ ID NO: 15799 - DNA, 2599 bp, Homo sapiens
  ENST00000429089
agagctgagatcctacaggagtccagggctggagagaaaacctctgcgaggaaagggaaggagcaagccgtgggagggagagaggaagggagggagggaagacgaaaacacgccgaggtcccagaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttccaaaa

SEQ ID NO: 15800 - DNA, 2706 bp, Homo sapiens
  ENST00000220809
gaacttcctccccctgctttataaaaacaggcctgcctcagctccctcatggccctgtccactgagcatcctcccgccacacagaaacccgcccagccggggccaccgaccccaccccctgcctggaaacttaaaggaggccggagctgtggggagctcagagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttccaaaa

SEQ ID NO: 15801 - DNA, 2516 bp, Homo sapiens
  ENST00000352041
atggccctgtccactgagcatcctcccgccacacagaaacccgcccagccggggccaccgaccccaccccctgcctggaaacttaaaggaggccggagctgtggggagctcagagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaaggttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttcc

SEQ ID NO: 15802 - DNA, 2030 bp, Homo sapiens
  ENST00000519510
agagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtata

SEQ ID NO: 15803 - DNA, 1655 bp, Homo sapiens
  ENST00000429710
agagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctct

SEQ ID NO: 15804 - DNA, 1613 bp, Homo sapiens
  ENST00000524009
agagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaataggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttct

SEQ ID NO: 15805 - DNA, 571 bp, Homo sapiens
  ENST00000522812
gctgatggcctcctcactctacctacacacgtgcaggaggcctgtgggactgactgcctcctcgtcctttcctccccagccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattggtaagagctcgtcattcccggctccagttcatacagatcacacaacacacccacatgcactcacctatgtttacacacacgggcctcctcctccagcccctgcccctcctgcgtgttcctcccctcccggggacgcggccctcacgccagctcactcct

SEQ ID NO: 15806 - DNA, 604 bp, Homo sapiens
  ENST00000521042
gatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaa

SEQ ID NO: 15807 - DNA, 584 bp, Homo sapiens
  ENST00000524261
cagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggtaggtagcacaggggtggggggttcaggtcttggcagaacgtgggattagggtgtgagacgggggaagatccaatgtctcaagttgcatgacagacccagtgcgtgggaagcacccatggatattatctaatccaacctcttcacttgctagaataacacatattgtgaaaagcaaggtctaccagttttccaacctaaatcccaagttaagggtcctggcctgtaaccatttagtcctcagctgttctcctgacatctttattgcaatgatttgtaagagttccgtaacaggacagctcacagttctgtctgacaaccctatgagattagaacactacattactgactgggtaacaaagttaaagagaagttctcct

SEQ ID NO: 15808 - DNA, 3462 bp, Homo sapiens
  ENST00000521647
cggccttaggcggaggtgaaggtacaagcagaaaagggagcaagaccaagtgaccttgggcaaatgcccgcttgcctcagtttcctcatctataaagaggtgggaataacagtacacacttcatggtttgctgtgaggattaaattagctaatttttgtagactgtacaacagcgcctggcacatagagcacattcttaatattttaactcacatcatccttggagctgctttgaaaatacaggggacccttgaacaacacttgtctgacctgcagggtccacttatgtatggatttttttcaaccaaaggcaggatgaaaacagtatttgtaggatgcagaactggtatacgcgtgttccacgctgcaggacttgagtgtgtgtggattgtggtagacagggctcctggaaccatggcctgagcacacagaaggaggctgtcattaggggcttccttttttatacttgacaggttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcaggtgagggcacatccccaaggagggattccccctgtgagaagctgctacagctggggaaagattctgtcagatccgtcagggttctcccaagaaacataaccaatacaggatggatagatggatagatgatagacagataatagatgataggtgatagatgatagattgatagatgatagatgataggtgatagattagataaatagatgatacatacatgatagatagatgataaatagacggtagatggatgacagatagacagatgataggtgatagatagatgatagattgatagatgattgatagataaatagatgatagatacatagatgatagatggtagatagatgatagatggatagatgatagatgataggtggtagatgatagacagatgattagaaagatagatgatagatacatagatgatagacacatagatgatagacagattgacagatgatagatgattgatagatgattaaatagatgatacatagatgataatgataaatagatgatagatgatagatgataggtgatagatagattgatagatgatagaagattgatagatgatagatacataggtgatagtagatgtaagatgatagatgatagatagatagatgatagacagattgatagatgatagagagatagagatagagaaagaggagagagaaatagagagagagagagaatgtgtgtgaacccaaagtatctgagacaggtctcaatcgatttagaaagttgattttgccaaggttaaggacacccccgtgacacagcctcaggaggtcctgaggacatgtgcccaaggttgtcagggcacagcttgcctttagacgttttagggagtcatgagacatcaatcaacatgtgtgagatgtacatcggtttggtcgggaaagttgggataactcgaagcaagggcttccaggccataggtagataagagacaaaaggctgtattctgagtccttgatcagcttttcactgaacacacaattgagtctggctcagttcatctgcatttttacataaaaaatagggcagaggaagcaatcagatacgcatttgtctcagatgagcagagggatgattttctgtcctgcacctgggaagataagctatccatttacaatgccaaggtgaaagtcaacagaactgttttagggtaaagatctttaggcctgcaaggaatgtccttgtagagaattaaaaaaaaaaaaaaaaaactttgcagctatcttattgaggaataaatgagaggcaggtttgcctgacgtagttcccggcttgacatttcccttggctcatgacgttggggtcctgagatttattttcctttcacactagatagatagacatttatgttaaggaactggctgacaggatcgtgggggctggcaagtccgaaacatcttggtaagccaggctggaagtgcaggcagaagctgaggctgctctcttaaggcagaatttcttattcaggaaacctcatatttgctcttaaggcctttaagtgattggacgaggcccaactacattatctaggacaatttccttttctaaagtcaactggctgtagatattaaccacatctataaaacactttcacaactcctagatgaatgtttggttaactgactgggtgccacagcctggccaagttgacatataagactattccagtccacaccttgtcaatttggcacccatgtgcatctccttaaaccatccttcacctccaagtaaacacaggaacaaaatcatactcctgcctaacatgatagaactaccagtgtacaaccaaaaacgcactcccggctgggcgtggtggctcacgcctgtaatcccagcactttgggaagccaaggcaggtggatcacctgaggtcaggagttcaagaccagcctggccaacatggtgaaaccctgtctctactaaaaatacaaaaattagccaggcatggtggcaggcacctgtaatcccagctactcgggaagctgaggctgaagaattgcccaaatccaggaaacggaggttgcagtgagaggagatgcgccgctgcactccagcctgggataaacagcgagactctgtcaaaaaaaaaagcaccccccattcctccagaaaaggataccaaagtccttgggtcctaaaggagaggcttcacctttgacctaccctggcccttcccttggctgatttttcagaaacccagatcgagactcaaagccctggtgctacgtctttaaggcggggaagtacagctcagagttctgcagcacccctgcctgctctgagggtaagtggcagccaccccgcctttccctgaatgtccctgggggaggaaagtccaggaggacaggccgatagccctcctgcacctgaggggagaaagggggaggccaggagtgagtcattttggttgcagagggaagaaagacaggacttaggtctgtgcctgggcttggcctctgactggctatttgtctgacctggagctgatctcctcacactctgaccctcaatttcctcctctatggaggagaggatggggctgaatcagtggttttcagtccttttgagaatgaatggagattctcccttttttgattaatgggtgaatggggctttgtctctctttcgctccctctcaaactttttaatgcaaaaaaaaaaaaaaaaaaa

SEQ ID NO: 15809 - DNA, 670 bp, Homo sapiens
  ENST00000520523
aaaaaaaaaaaaggacatgctacagcatggatgcaccttgaagacatttgcaaagtgaaacaaaccagtcgcaaaagaagaaacactgtctcattccacttctaggataatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactg

SEQ ID NO: 15810 - DNA, 549 bp, Homo sapiens
  ENST00000521694
agttttgagaaacaggaaatttgaggaaagctgagaaagagaagatctggaaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggccc

SEQ ID NO: 15811 - DNA, 5074 bp, Homo sapiens
  ENST00000637919
aggacggaatttatcagaagcaggcctattgcgtacttggaaaagataactaaggactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagggggaaggttcctcctcattcttgtcggaaacttgccatgaggatccctctgtttcccccaactttactccccccaaccctcaagctctcaagtggtgaccaccgtccttccggccagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtgaatgctcctgccaggccttcagaaattgcatggccactccagcgtcatcggactctctcttattacaaagatcactgcccaggaccatcttcccgagaagcatcccttagcctaaaatccacaccaaagggagagttccagaggaatccatgaagaattcccatgcccaggctccatgtgtcatgtggaaacctccacaggtctgctagtgaagaatgcatgtatgtgagatttttgttttctttccaatagcaaattcaaagcaagcaacttgcaggctccatggaacttttaatgaaggacagtgtcttctttgaagaaaatcaagctcgtgtttttattcgaagctctggtgtaaaatatttcaaagtcatagaaatagtttgagaaatgcatagcattatttaacactattgaacagccgactttgagcattgtttcttctaactgcccctcaactaccattatcttcaagtcaacatgcatattacattttcatcctttgctttgcaagcactggtggcttgcagtttgctaatttatttatcatagagtcatcaatgtatttgttgctgacatggttttattagatactgtagtgattcaaataagttttctatttgaaaaaaaaaatcacttgattgtatccttgcccagtgaagccatcctaagacttagcaatatggattgtacatttggctgcatgagcaagtcggccgcacacttccagacagtgtgctgtttgaattgactatttgcactcaaagtctgggtattcattggttattggcctgaaatgatcaaataactacaaatgatctgttgaataaaaatagttgagctgatatatgttaagcagatattcaatcagaatgaacaggttccggtggttattttgccgtttgacattttttatggttcatttatttttaatatagagaggaagattgaatatttatctagagaatacaaagacccacatgtaaatgataggtattatctccatgtatatatgtacccacttagtcatgtaagtgcatatacacatacacacacatgagtgtagacatgtgtttattaattgacaatgacccaaatctcttccacaagacttaaaaccaaattcagggacaaatggatagagaagaaaagggtcaaacatcgagattacatggatgttaaattatatggagacgctaagaaataattgatggagccattgatgcaaaccgaagtagatttagaacttatatgaatttgatttatattttgcaagatcaaaaattagatgttaagtatcagattttaagcttgttttaatggtcaaaaaattaggacagaaataatatgg

SEQ ID NO: 15812 - DNA, 3206 bp, Homo sapiens
  ENST00000625874
aatcaagcctgggcaatggcgggcgcccctcccccagcctcgctgccgccttgcagtttgatctcagactgctgtgctagcaaccagcgagactccgtgggcgtaggaccctccgagccaggactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtg

SEQ ID NO: 15813 - DNA, 759 bp, Homo sapiens
  ENST00000630495
agtttgatctcagactgctgtgctagcaaccagcgagactccgtgggcgtaggaccctccgagccaggcttgtcccatggcctctcatagaaatcatggaccatggaagaacaagaatatggtagacatgaaggaaatgtagagggactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaacc

SEQ ID NO: 15814 - DNA, 7323 bp, Homo sapiens
  ENST00000378641
gcaaagttgggctgggagccgcggggggaaggaaggacccagcgagcgagggtggcggggaaggggggcgggggggaggaggagggaggagggaaaagagcggttagggggggcgccgggcgtgtgtcactcgctctctccctctgtgtatagaggatgtgctgaatggtgcgctttgaggcggcggcggcggaggagcagaatccgccgcgactggcagcctcggctgaccggctcggcttctcttcgccttccgaggctcctcatccaccgcgggctccagacctcgcgtcccgcccggggcatggccgggcgctgcgcccccgcgcgctctgcctgctgagcggcgccggagggaggtgcggaggccgggaggccggggaggccggcggggagcagagtcgagcgcctccggagcagagaaaggagcccgcgccccgcgccccgcgccccgcgcacggtccccagtccctgccgcgctcgcccgggccgcccggagcccagatgagcccagatggccggggctcaacccggagtgcacgccttgcaactcaagcccgtgtgcgtgtccgacagcctcaagaagggcaccaaattcgtcaagtgggatgatgactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagggggaaggttcctcctcattcttgtcggaaacttgccatgaggatccctctgtttcccccaactttactccccccaaccctcaagctctcaagtggtgaccaccgtccttccggccagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtgaatgctcctgccaggccttcagaaattgcatggccactccagcgtcatcggactctctcttattacaaagatcactgcccaggaccatcttcccgagaagcatcccttagcctaaaatccacaccaaagggagagttccagaggaatccatgaagaattcccatgcccaggctccatgtgtcatgtggaaacctccacaggtctgctagtgaagaatgcatgtatgtgagatttttgttttctttccaatagcaaattcaaagcaagcaacttgcaggctccatggaacttttaatgaaggacagtgtcttctttgaagaaaatcaagctcgtgtttttattcgaagctctggtgtaaaatatttcaaagtcatagaaatagtttgagaaatgcatagcattatttaacactattgaacagccgactttgagcattgtttcttctaactgcccctcaactaccattatcttcaagtcaacatgcatattacattttcatcctttgctttgcaagcactggtggcttgcagtttgctaatttatttatcatagagtcatcaatgtatttgttgctgacatggttttattagatactgtagtgattcaaataagttttctatttgaaaaaaaaaatcacttgattgtatccttgcccagtgaagccatcctaagacttagcaatatggattgtacatttggctgcatgagcaagtcggccgcacacttccagacagtgtgctgtttgaattgactatttgcactcaaagtctgggtattcattggttattggcctgaaatgatcaaataactacaaatgatctgttgaataaaaatagttgagctgatatatgttaagcagatattcaatcagaatgaacaggttccggtggttattttgccgtttgacattttttatggttcatttatttttaatatagagaggaagattgaatatttatctagagaatacaaagacccacatgtaaatgataggtattatctccatgtatatatgtacccacttagtcatgtaagtgcatatacacatacacacacatgagtgtagacatgtgtttattaattgacaatgacccaaatctcttccacaagacttaaaaccaaattcagggacaaatggatagagaagaaaagggtcaaacatcgagattacatggatgttaaattatatggagacgctaagaaataattgatggagccattgatgcaaaccgaagtagatttagaacttatatgaatttgatttatattttgcaagatcaaaaattagatgttaagtatcagattttaagcttgttttaatggtcaaaaaattaggacagaaataatatggacatttattagtatcttccataatttttaagtctgacacatttctattttattctaacataaaaaaacttccattatatatttactaagtatatttaattcacttaactctgtctttataagttcctattttagatggaataagagaaacaaattatatcaaggtaaaactgatcaaaagcataattgaaagttctgaaaaaagaaaaataataatatgtagaaaaatgtaacttagagagtaacacatgaacattgaagttaaaacccagaagccagatgctcacagttttattttactttaaaataaacctgtctgactgtagctttgtgaaatatcttaaaacgcaaaaaccaattgtgtcctgaaaattgtttcaagaatttaatatttttatgaaaattattttatttaactttaagcaataactagagattacaattaaattttaatcaaaatgaaggcttagttcaaacataaggaaacagtgtttgattaaaaaaaacacatctagtaagacgtaaggggaaaatcacatcctctttggagatgattatattttgatctgaagggtttggggtgttcattagacacttaataaaacttaacttccaatgaaaaagaaatcttttgtaaatcattctacttttgcactttgaaagaaaggcgttaatcataaagaagcaagaatggtcaaaatcgaatgctgcatttttataaacaaaattacagactgtctgaaattgaagaagaatgaactaataatagcattcataaccaaacacaatgatgattattgcagaacattgtatcacattttagtccagagatagaataaagttgaataaccttgacttacacaaaactgttttggtagttggatttcattatcttagtgaatttagtcattttacaatatgtttgtatttggccatttactgtaatcacatttttatatctgtacaatgacactttttgcagttgtggggtagtgtgtaacactgtccatcttgcatcattgaaactactacaatgatactatcatttaataatattaatattacttgaaatagactaagataaagaaaaggggtctgtatgatgtgcagttttgtgcctttatgtatttgccttgttctttgtcgaatgtgtgaaattccgtactgtggtttttcctataatagaaagtagagctgtgtattaaattagactgtgtctctctgatacctttacactactgagaatagcatggttttggccatgtaaaccaattttcaaagttctaatgacatagccatgtgtttttggttttttatatttcattttaaaatttgagtatcaccatacattaattaatactcctgtagtagataagctgtcattaagtaattcccaaaaaaagggccatttgcttgcattactttgaatttaatgttgcgcttgtgcactgtgttaatattgtttgtgatggattggacgttgtgactcttgccttttaagaagaaaaaaaagataggacaaagtatttgaagctcttaaaatgtacatattttggttcttctatctcaaattatttaaaatgcataattcacatttttgtaataattctatgcaattttgtggcatgatgtttcttccacttgtaattttatgtgctttcatcacaaatccaaaggaaagaataaaaatt

SEQ ID NO: 15815 - DNA, 7092 bp, Homo sapiens
  ENST00000338037
cactcgctctctccctctgtgtatagaggatgtgctgaatggtgcgctttgaggcggcggcggcggaggagcagaatccgccgcgactggcagcctcggctgaccggctcggcttctcttcgccttccgaggctcctcatccaccgcgggctccagacctcgcgtcccgcccggggcatggccgggcgctgcgcccccgcgcgctctgcctgctgagcggcgccggagggaggtgcggaggccgggaggccggggaggccggcggggagcagagtcgagcgcctccggagcagagaaaggagcccgcgccccgcgccccgcgccccgcgcacggtccccagtccctgccgcgctcgcccgggccgcccggagcccagatgagcccagatggccggggctcaacccggagtgcacgccttgcaactcaagcccgtgtgcgtgtccgacagcctcaagaagggcaccaaattcgtcaagtgggatgatgactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtgaatgctcctgccaggccttcagaaattgcatggccactccagcgtcatcggactctctcttattacaaagatcactgcccaggaccatcttcccgagaagcatcccttagcctaaaatccacaccaaagggagagttccagaggaatccatgaagaattcccatgcccaggctccatgtgtcatgtggaaacctccacaggtctgctagtgaagaatgcatgtatgtgagatttttgttttctttccaatagcaaattcaaagcaagcaacttgcaggctccatggaacttttaatgaaggacagtgtcttctttgaagaaaatcaagctcgtgtttttattcgaagctctggtgtaaaatatttcaaagtcatagaaatagtttgagaaatgcatagcattatttaacactattgaacagccgactttgagcattgtttcttctaactgcccctcaactaccattatcttcaagtcaacatgcatattacattttcatcctttgctttgcaagcactggtggcttgcagtttgctaatttatttatcatagagtcatcaatgtatttgttgctgacatggttttattagatactgtagtgattcaaataagttttctatttgaaaaaaaaaatcacttgattgtatccttgcccagtgaagccatcctaagacttagcaatatggattgtacatttggctgcatgagcaagtcggccgcacacttccagacagtgtgctgtttgaattgactatttgcactcaaagtctgggtattcattggttattggcctgaaatgatcaaataactacaaatgatctgttgaataaaaatagttgagctgatatatgttaagcagatattcaatcagaatgaacaggttccggtggttattttgccgtttgacattttttatggttcatttatttttaatatagagaggaagattgaatatttatctagagaatacaaagacccacatgtaaatgataggtattatctccatgtatatatgtacccacttagtcatgtaagtgcatatacacatacacacacatgagtgtagacatgtgtttattaattgacaatgacccaaatctcttccacaagacttaaaaccaaattcagggacaaatggatagagaagaaaagggtcaaacatcgagattacatggatgttaaattatatggagacgctaagaaataattgatggagccattgatgcaaaccgaagtagatttagaacttatatgaatttgatttatattttgcaagatcaaaaattagatgttaagtatcagattttaagcttgttttaatggtcaaaaaattaggacagaaataatatggacatttattagtatcttccataatttttaagtctgacacatttctattttattctaacataaaaaaacttccattatatatttactaagtatatttaattcacttaactctgtctttataagttcctattttagatggaataagagaaacaaattatatcaaggtaaaactgatcaaaagcataattgaaagttctgaaaaaagaaaaataataatatgtagaaaaatgtaacttagagagtaacacatgaacattgaagttaaaacccagaagccagatgctcacagttttattttactttaaaataaacctgtctgactgtagctttgtgaaatatcttaaaacgcaaaaaccaattgtgtcctgaaaattgtttcaagaatttaatatttttatgaaaattattttatttaactttaagcaataactagagattacaattaaattttaatcaaaatgaaggcttagttcaaacataaggaaacagtgtttgattaaaaaaaacacatctagtaagacgtaaggggaaaatcacatcctctttggagatgattatattttgatctgaagggtttggggtgttcattagacacttaataaaacttaacttccaatgaaaaagaaatcttttgtaaatcattctacttttgcactttgaaagaaaggcgttaatcataaagaagcaagaatggtcaaaatcgaatgctgcatttttataaacaaaattacagactgtctgaaattgaagaagaatgaactaataatagcattcataaccaaacacaatgatgattattgcagaacattgtatcacattttagtccagagatagaataaagttgaataaccttgacttacacaaaactgttttggtagttggatttcattatcttagtgaatttagtcattttacaatatgtttgtatttggccatttactgtaatcacatttttatatctgtacaatgacactttttgcagttgtggggtagtgtgtaacactgtccatcttgcatcattgaaactactacaatgatactatcatttaataatattaatattacttgaaatagactaagataaagaaaaggggtctgtatgatgtgcagttttgtgcctttatgtatttgccttgttctttgtcgaatgtgtgaaattccgtactgtggtttttcctataatagaaagtagagctgtgtattaaattagactgtgtctctctgatacctttacactactgagaatagcatggttttggccatgtaaaccaattttcaaagttctaatgacatagccatgtgtttttggttttttatatttcattttaaaatttgagtatcaccatacattaattaatactcctgtagtagataagctgtcattaagtaattcccaaaaaaagggccatttgcttgcattactttgaatttaatgttgcgcttgtgcactgtgttaatattgtttgtgatggattggacgttgtgactcttgccttttaagaagaaaaaaaagataggacaaagtatttgaagctcttaaaatgtacatattttggttcttctatctcaaattatttaaaatgcataattcacatttttgtaataattctatgcaattttgtggcatgatgtttcttccacttgtaattttatgtgctttcatcacaaatccaaaggaaagaataaaaatttcttaacacaaccc

SEQ ID NO: 15816 - DNA, 3095 bp, Homo sapiens
  ENST00000629992
gctctctccctctgtgtatagaggatgtgctgaatggtgcgctttgaggcggcggcggcggaggagcagaatccgccgcgactggcagcctcggctgaccggctcggcttctcttcgccttccgaggctcctcatccaccgcgggctccagacctcgcgtcccgcccggggcatggccgggcgctgcgcccccgcgcgctctgcctgctgagcggcgccggagggaggtgcggaggccgggaggccggggaggccggcggggagcagagtcgagcgcctccggagcagagaaaggagcccgcgccccgcgccccgcgccccgcgcacggtccccagtccctgccgcgctcgcccgggccgcccggagcccagatgagcccagatggccggggctcaacccggagtgcacgccttgcaactcaagcccgtgtgcgtgtccgacagcctcaagaagggcaccaaattcgtcaagtgggatgatgactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaagggtggaaaaagctaatgaggctgcgaaaagtgagcagagctgtggaaaggctcccccaaaacattttcaccttcattttataaagcaaaataaaatgcttgaacctgcttgctattgcttttttgttagatgctttggaataggaaaaatataacaattaaggtcctgtccccgacttcaacaaatatttcttgagctcttactatgtgcccataggcattgagaatatggtggtgaagaaaatgaaactcaaggtttcaaggacaatagagtcttctggggaaactagccaataagcatgccaacaaatgcgtctgtaaactgggggaagtgctataaaaagaaagactggagaactactattgagaagaagggaagctcattccagaaaaagaaaacaatgctcgcaaatccctgaggctggaaataatttccctactggatttaagcaactgagaaaagaccaccgcattcaagcataaagagaaaacatgagagatggatttgcaaagacatgcaaagaatttttttccttttgcaatcacttctgattttaccttttctggataacctctggtaaaatataataatcaaaatatttaacttatgaatctagctaagggaaagaaggaatagaaaattaaatgtatgaaccaattccccgtaaattgtaattttctaaacaactggattctgagcagtcaataaatacacattgagtaatctactatgtttattatatgttcaaactttcagaccaatgtcaattgcaggcaaatttaaaaggaaaatgagattcaaataacatgagttatgtttaaattagaaaaaattatctctaacaaattaaatgtaatgataattatctgaagttggagaaaactttaaaaaacctctatgctaaaactttgaaaaattattattcatagtaaagtataatttacttggatgacttatagaattagaatgctttttaaaaatctaaaaaccaaagactgtttcagagctaggaaataaatgtttctgtgaactgactatgatgtatcaaaactctgttttaaatctctgtgataatttcattcctacataacaatgactctagaaaatatccactaattagcaaaaaattttggccatattcacaagaggtattttaaacaagccacggaagaaaagggttatataaatcatagttggttctgcgtaaatgggagcatattttgtagccaagtcatttaagctagatttaattgtgctctgtaaatagatatattaccagaaacacagtggatgtcctgttgagatttctttttaaaacatgatattactgcacattgttggggataaataaggcacttgaacttgtatcctggctgacgtgatccactagaataacatattcctttagaagatgctactctttagaaatcacagttgctagcctgaagttaccctaattgttaaaaggtagtactgtatccaaagagagagacaaagcaattactgtccttctgttaacaacccaagcatattttccagtgagacccttgaaaactgttccgtgttcaaaaaattaccactttacccacaaactttctgagaactgaaaatagtttatttgcaccaaattcccttgatttaaggcttattaacttgaaaagagctcagtgacatctggaattgtataatagtcttgccacagcactggcatacggagttgcattttaacgaagaagatcaggaataaacccatgtatttgtttcaaataataaagtttactgtagttggtgggcacacatgtaatacaaagagaaattaattattttaaatttgaagaattgtataaattttactaaatactatgaataaaatgtataaaataacttctgtgtgtaacttattagtatgttgcctttcttctgtgccttacatcctgaatataaatcagaagcaatcacttttgtagttgtgattcttaatatgactaatatcaaaattctactttaaaaccaaattaagtattccgttcattatgagtgatttacttgtagttatttcatgtattccatggctaattcaatgttttatttatagtttcagaataaaaatattgacagta

SEQ ID NO: 15817 - DNA, 2930 bp, Homo sapiens
  ENST00000636319
gaggcggcggcggcggaggagcagaatccgccgcgactggcagcctcggctgaccggctcggcttctcttcgccttccgaggctcctcatccaccgcgggctccagacctcgcgtcccgcccggggcatggccgggcgctgcgcccccgcgcgctctgcctgctgagcggcgccggagggaggtgcggaggccgggaggccggggaggccggcggggagcagagtcgagcgcctccggagcagagaaaggagcccgcgccccgcgccccgcgccccgcgcacggtccccagtccctgccgcgctcgcccgggccgcccggagcccagatgagcccagatggccggggctcaacccggagtgcacgccttgcaactcaagcccgtgtgcgtgtccgacagcctcaagaagggcaccaaattcgtcaagtgggatgatgactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatgggtaagtacatgcttgttcccattctgctatgaactcacattgccaagtgtccaaaaaccattcttacataattgggggagagaaaattgccagacttcactgaaaaaataaataaaagcaaatttcaatgaagggaatatcaatgcataaaaaaagtgaattttgaaaatcgagacatgttcttcaattattctgtaaatggatctttatttctacaggctttgcattatttttcaaacaaaaatttttatgctttttaagataatacatatttattttgaaaataatggaaaattcagtaagtattttaaaaacaaactgccaggaatgctaccaactcagagattccacagtgttgacttttagctttgtaatctatgtcttttttgtctacatataaatgctttttttatgtaactactcatttaaaataaatacatatatattcatatatacatatataaacacacactcacctaagtgccatagagagacatgaatttcaatagctgcatactaagcatatttcacaattcgctaaaaacttatttctattccctaaatttcttttggaaaatattttaaaaacagaattactaacgttaaaagatgtgaacagtttaagtacctttatgaatattgccaaattgtctgtaaaaaatgttgtgctacattactccgctgtcagcaatgtttaatatgacgtggcctctcatttgcgatct

SEQ ID NO: 15818 - DNA, 706 bp, Homo sapiens
  ENST00000626161
ggggaggccggcggggagcagagtcgagcgcctccggagcagagaaaggagcccgcgccccgcgccccgcgccccgcgcacggtccccagtccctgccgcgctcgcccgggccgcccggagcccagatgagcccagatggccggggctcaacccggagtgcacgccttgcaactcaagcccgtgtgcgtgtccgacagcctcaagaagggcaccaaattcgtcaagtgggatgatgactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggtatggtggatggaaattgctaaagcttatcatcatgatctgaatccttgagctatcatactaatgcctgcaaaagactgaatttttgtcatatttagcatgtgttaaaatttcacctaaaaataattcagctgccaagtataagtgcaattaaaatacttctaaataatggcatcaacttaagaa

SEQ ID NO: 15819 - DNA, 1260 bp, Homo sapiens
  ENST00000404098
gcggggagcagagtcgagcgcctccggagcagagaaaggagcccgcgccccgcgccccgcgccccgcgcacggtccccagtccctgccgcgctcgcccgggccgcccggagcccagatgagcccagatggccggggctcaacccggagtgcacgccttgcaactcaagcccgtgtgcgtgtccgacagcctcaagaagggcaccaaattcgtcaagtgggatgatgactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaagggtgagcatgtgtgttatgctatagtttgaatgttcagcccctccaaaactcatgttgaaacttaatccccaatatgacagttttgagaggtagggcctttaagaggaaattaagagcttccatgattaatgggttaatgaattaatggattatcatcggagaggaactggtggctttataagaagagaaaaacagacctgagctagcatgttcttccccctcaccatctgattccctgtgccacctctgccaaagtggagagtccccactagcaagaagacttttgccagatgtgccctctccaccttggacttcccagcctttgtaactgtaggaaatacattttgattcctatatattatacagtttcaagtattctgctatatgcatcagaaaacagagtaagactgaaaattggtaccaagaggtggggtttttgctgataacaaatatctgaaaatgtagaagcagctttggaactgggtaatgaacagaggctgaaaaaagtttatagagctagctagaaacagccaagacttg

SEQ ID NO: 15820 - DNA, 3864 bp, Homo sapiens
  ENST00000378637
cagatggccggggctcaacccggagtgcacgccttgcaactcaagcccgtgtgcgtgtccgacagcctcaagaagggcaccaaattcgtcaagtgggatgatgactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagggggaaggttcctcctcattcttgtcggaaacttgccatgaggatccctctgtttcccccaactttactccccccaaccctcaagctctcaagtggtgaccaccgtccttccggccaggtaggactggatgggaggggtcgcttttgagagaagggtggtgtgtagccatccagttttcaggcatcacggacttgctcgtttgtccttcatcctccctttctctacattcccatcttttttttctgctaaagttcccagccacacccatgatcatttcctcatcctttctgccttcctctggtattaatttctccatcattgtgctctctcttcctgacataaatctcattcttccatattgtcttcttcctctttctccattttgtttctctattggcaaatttggcttcctttttaatctggattttctctcttgc

SEQ ID NO: 15821 - DNA, 857 bp, Homo sapiens
  ENST00000630757
actattgttactccaattattttgaggactgaccctcagggatttttcttttactggacagatcaaaacaaggagacagagctactggatctcagccttgtcaaagatgccagatgtgggagacacgccaaagctcccaaggtaggaggttgagtgttgtgcatgcaccagatgctgccttgattgtttggctgtgtcacaatatcaattaattgccccaattaaaagtttctatgttatagatgttgtaaaacacaatagccagtatgccctaaacactttcacttttattaaaagacggaaacaatgaacaaatatgtgggctcttggacagaggggcttgctttatgtcctctaattttgcctttgtttgaaaaaaaaagacaacgacaacaatgcccaagttactgggtaattctaaatgattaaaaagtacttgaaattatttgaaaaaatctttgaacctcgtaaacatatgggaactaaccgttagacatgatgaatagaactcccatatagctgaaatgctctgcaattgaaatgattccatccacaatgccaaaaggtgtatagtcttaattctgcaaatgttactagtaaagatcagcatactttgggatgaattgtgtgcagtgtcatttgttttggtttgaaaaacttactgaagaaatattcaaagaagtgtttgcagtctgtttattttttgaagataatttttaaatattggatgaagaacataattttttaagcttagatgatctggtaggatatagtagcaggatatgttgtcttgccatcaaagttaaaagctattcttcattttatttaaaatttagtactttacatacttcatttct

SEQ ID NO: 15822 - DNA, 100 bp, Homo sapiens
  ENST00000637204
ggactgaccctcagggatttttcttttactggacagatcaaaacaaggtaagaaatgaggagacagagctactggatctcagccttgtcaaagatgccag

SEQ ID NO: 15823 - DNA, 3020 bp, Homo sapiens
  ENST00000636825
atgatttgacttgaggcattcggaggctaaacatccacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaat

SEQ ID NO: 15824 - DNA, 3237 bp, Homo sapiens
  ENST00000635830
gaggcattcggaggctaaacatccacaaggttagttccctgaacccctataaaccttgctatttatatctcttcctcaactctgaggccctcaccctacatcggctgcagtacagattcagcctttagcgacggaattatgtactgaaacactcatttctgtgccgctgcagtggttagctttgatttttatagagatgcacatgagaaaacagtctgagcctggagagtgacttgtgggctgctaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaaga

SEQ ID NO: 15825 - DNA, 100 bp, Homo sapiens
  ENST00000636784
tgccacctgcaggagacagagctactggatctcagccttgtcaaagatgccagatgtgggagacacgccaaagctcccaaggaccccaaattacgtgaac

SEQ ID NO: 15826 - DNA, 598 bp, Homo sapiens
  ENST00000626114
attcaaaagtaagaacaagaagacctgattcatcatgatttaggaatggcttgtaggatagactggggacataaccacacactttttgctttcaaaatgtataactgagcagttagcagttagctgtcttttgtttccaacctaattcaattgagaagtgatataagaggaaagaaatatcccaactgcagagaagtcttcagtcaagtctcaagataatttttttaagtgatgtcaatgacataaaacaaagaggaaaggtctgtgtcgttgcttaacgatttcacgtttttgccttccaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaa

SEQ ID NO: 15827 - DNA, 560 bp, Homo sapiens
  ENST00000628900
agtttgatctcagactgctgtgctagcaaccagcgagactccgtgggcgtaggaccctccgagccaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggtggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaaccc

SEQ ID NO: 15828 - DNA, 2996 bp, Homo sapiens
  ENST00000626966
agactgctgtgctagcaaccagcgagactccgtgggcgtaggaccctccgagccaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgag

SEQ ID NO: 15829 - DNA, 100 bp, Homo sapiens
  ENST00000637000
cttcatcacactcatatataaaagaaagaaaccttgaaaatgagaggaccccaaattacgtgaacttttggatgtggggaacatcgggcgcctggagcag

SEQ ID NO: 15830 - DNA, 118 bp, Homo sapiens
  ENST00000635850
ctctttgtgtattctctgaaagtctgaaaacaactgaggacaacttgaaggaccccaaattacgtgaacttttggatgtggggaacatcgggcgcctggagcagcgcatgatcacagt

SEQ ID NO: 15831 - DNA, 443 bp, Homo sapiens
  ENST00000475958
cagcagatcggaagcgagttgaaactgctttagaggcttgtagtcttccatcttcaagggcattgagaatatggtggtgaagaaaatgaaactcaaggtttcaaggacaatagagtcttctggggaaactagccaataagcatgccaacaaatgcgtctgtaaactgggggaagtgctataaaaagaaagactggagaactactattgagaagaagggaagctcattccagaaaaagaaaacaatgctcgcaaatccctgaggctggaaataatttccctactggatttaagcaactgagaaaagaccaccgcattcaagcataaagagaaaacatgagagatggatttgcaaagacatgcaaagaatttttttccttttgcaatcacttctgattttaccttttctggataacctctggtaaaatataataatcaaaatatt

SEQ ID NO: 15832 - DNA, 4781 bp, Homo sapiens
  ENST00000487210
aaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagggggaaggttcctcctcattcttgtcggaaacttgccatgaggatccctctgtttcccccaactttactccccccaaccctcaagctctcaagtggtgaccaccgtccttccggccagtcatgacaagaaataattggcttgtgagaatcaacattgaagctggaaaaatgatggcatccgaacaagtagacacagccctagtcaaggcaataaactacactaaagacagaggagaaagactcaaagttgttctaacatgtgagtacctaggggtgctgcatgccgttgtgtggtttgtgtactgcatagttgtactcagccaaggaagtggatgaggccacagctttaacatgggctgctgtctgcccagaaggataatcttttccttattttatatctcatttcaggggttctccaacttctgaaatccatccagaaactccctgtatttgggtaacagtattataactttttgcaccagggcttttttgtttgtttgttaatattaattgatttttcttatgttctttatgaaagaataactcatccattaatgaaaccaaatgtgaacttagtgccttctgtgtagaaaaggctaggaatacatattgtgggagattcattacatcactggccttaatactacaccttctcatgttcccccttggctgtgtaactttctagtgtccatatgctctctcttggggtggccagtgtgacttgctttggccaatgggatattagcaaccatgacataacccgaggcttataaagttgcctgctcattgggacttgtttcactgttgcatcccagttattcacatcactccagctgacagccaaccaacaaacagccagacacgtgagcccaaccaagatcagaagaactgtcccactgagcatagtctaaattgctaacatgcaaatgcatgaaacagaccacagcaaggtaatcttacagcccaggactcagctgctgcaatctctgtgaaaggttctgctcatgaaacagagacaaccatgtgtggtgcctgcattcttggcctgcggggagtggaaaggagacaaagagtaaaacacggtgggaaagaagaaaaagaggttaagaaaagcaaatgtgcctactccaggtaattttgacttagggaccctgattaacttacacactaattaaaccatttccagattttgtgcagtctgaaagcagcccattttccccaacaccaggtcgctcaagatgaccacaggaaggttgtcatcttcatgtctaaaagccagttgacactcaagggtgtcatttcacttcagtgaaatgagaagcttcacagatgtgtagactctgaaaaatctaactggaaaacaatacagggaaatagcaatactaggcatcaaagcagcaaaaaaactactcaattatctgatatggggattatcaatggaataaatgtggggtttgttgtttgttgttgggattgttgtgggttttgtttcattttttagggtctcacttttctccaccaattagatctgtgctgtgagccacacaggttttgagtacatgttttgggactttatatcggtcagactttgccatggtaacactgtgtaacgagcagccccaaaaatctcagtggtggtcaaaagcaaacctttatttctcattcatgggttttcagtttgttcaggctaaaagtaaaatacacagattcttcacctgtctttcattccatgctgaaggagcaattgactgcctgggacatacttttctcataacagaggcaagggtgaaaaacaccaagtcatcttgattatgcaatcccatttttaatgtaaacaatgtcatgtctgcttctatttcattgagcaaagcaagtcatataggcaagcccaacatcagtggggtgataaagcacactctccaatggaaggaggaggggagcatgatcatttgctgaacagtaatgcaagatagcacaagacttgtctggggtgagagagagatcaaagctgtggatcccacccagtcttcaaccaaagcaatgtggctttgacctgttttctgtcttggacttgaataatactttatttgaaagaagtgttaaattgtttattaaaaaaaaagacaagtttgaaaa

SEQ ID NO: 15833 - DNA, 2338 bp, Homo sapiens
  ENST00000494924
ttacaaatttcacttgataatttacatggaaatatgaaagggttctttctccaagtgtcttgcaattgacttggaatcagcgagttaaacaaaagggactgagcctctaactctgggaatttcaaggctccagttacagcaaatgacatgctgtcccctccacctatgtctatgcaggtctgccttgggaaccacctcacacatcagtgccttcgctgtccatctgtgtatgttattcaaattcacataagttaagataaagatccaggatgataaaaaccaatcctgatgggtgggattagagaattacttctttctgtagttaataacacaaagcaatcctgttcaggttctttggataagcctccctactttccttcttctgttcttgttctcccttagcccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgag

SEQ ID NO: 15834 - DNA, 100 bp, Homo sapiens
  ENST00000636711
ggaaaattttgaccagtaacctttgtccactggaaaagagtctatgtagaattagatgttaattacctggctatgcaaataaatatggggatgtatgaat

SEQ ID NO: 15835 - DNA, 1819 bp, Homo sapiens
  ENST00000439627
attatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagagggtggatttctgcatgatgaaattatgagactcacccgtaatacgctggaaaaactgatggccttacctcttacccatgtggtgcccatccaaagcaagatgctgtcataagttttagtagagacgggatttcaccatgttagccaggatggtctcgatctcctgacctcgggatccacccgcctcggcctcccaaagtgctgggattacaggcatgagccaccgcgcccggccggaactgcactcttcagatgactcagacaaggaaagcatgatccaacacctctaatagcccagtaatacatatgatatttgaaaggcccttcacttaccatgttaaccattcagttaaatcctccaaatcctaattctctgctgctcaaccatcagatccaaactttcaatgcccaggacggaaatcttttcaaccagcacatcaaatggcttttcctccttctatagaacttataaaaatgatcttttcagttaccattttactggtccatctgtattctattttcagtgcacttctgttcattttggaattaggaagcgtacaaattctttttatatttaattttaacattcaagttaggcatattttgaagaaaaagatattgcaatgattgcatttgtccactagagggcaggaacttacttctgtggttcattctgcactttttttttcactacccacctaagaaaaatctagtcaatgcgactgaagtactaccaccttctgaatcttctttccttgataattgcttaattggaatttaaatctttgaatcaaattaagaaactagacattcctagtttctgtttctatcacaatttccagtaccagatttttattcactcataaaaacaaataatgggggagaaataaaatattgacttctgctgattctcttgagtgggataaggaatttggtttttgcactttggcttacagatccatatagtggaattattcgatctttcaattataatatcagaaagttcaattttagtattgtactcctataggtgctttttttcatttttcagccattgttttgcttaacttatttaactttgtatgtacggatgcctttttagtgcaacagggtagttctttgagaattatgtttacatgtagacatctctatctcagcagcaagttaagttattattacggttccttaagctgctgttatcatagagtggactgctgtaatagaaaaatttagtctttagcatatagtccatattcaaatacttgttcacagtttcctgtgtgacctctggcaagttacatgacttttaataaagtttttagtaaagacttttaataaca

SEQ ID NO: 15836 - DNA, 830 bp, Homo sapiens
  ENST00000628239
agcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaaggttgctccatgaccatctttttgtgtctggatttgaaggttgcccatgaagattgttggttccatgtcaaactaaagcatttcttgagggtttttcttcatggcttaaaaacgttgtgccttaaagctgtgattttattaataaaat

SEQ ID NO: 15837 - DNA, 2291 bp, Homo sapiens
  ENST00000635929
tatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagtcatgacaagaaataattggcttgtgagaatcaacattgaagctggaaaaatgatggcatccgaacaagtagacacagccctagtcaaggcaataaactacactaaagacagaggagaaagactcaaagttgttctaacatttattcacatcactccagctgacagccaaccaacaaacagccagacacgtgagcccaaccaagatcagaagaactgtcccactgagcatagtctaaattgctaacatgcaaatgcatgaccacagcaaggtaatcttacagcccaggactcagctgctgcaatctctgtgaaaggtacttatgactaatgctgatgccaccatgaagctcaggaaacaatttacagggacatgggctgttctgagaccccacagccatgaatcgcctaatcattctgacagatttctgcagatgctgtgctcaggtcactgagtttcccagttgtcagtggtgaactggagcggaggcagaaggaaactcttcagacacactgttcccttcaggaaacaagggacaaaagggctgccctgaggagacttgggaaagtgacatttcctcaggctcgaggacatcccgaggttctgctcatgaaacagagacaaccatgtgtggtgcctgcattcttggcctgcggggagtggaaaggagacaaagagtaaaacacggtgggaaagaagaaaaagaggttaagaaaagcaaatgtgcctactccaggtaattttgacttagggaccctgattaacttacacactaattaaaccatttccagattttgtgcagtctgaaagcagcccattttccccaacaccaggtcgctcaagatgaccacaggaaggttgtcatcttcatgtctaaaagccagttgacactcaagggtgtcatttcacttcagtgaaatgagaagcttcacagatgtgtagactctgaaaaatctaactggaaaacaatacagggaaatagcaatactaggcatcaaagcagcaaaaaaactactcaattatctgatatggggattatcaatggaataaatgtggggtttgttgtttgttgttgggattgttgtgggttttgtttcattttttagggtctcacttttctccaccaattagatctgtgctgtgagccacacaggttttgagtacatgttttgggactttatatcggtcagactttgccatggtaacactgtgtaacgagcagccccaaaaatctcagtggtggtcaaaagcaaacctttatttctcattcatgggttttcagtttgttcaggctaaaagtaaaatacacagattcttcacctgtctttcattccatgctgaaggagcaattgactgcctgggacatacttttctcataacagaggcaagggtgaaaaacaccaagtcatcttgattatgcaatcccatttttaatgtaaacaatgtcatgtctgcttctatttcattgagcaaagcaagtcatataggcaagcccaacatcagtggggtgataaagcacactctccaatggaaggaggaggggagcatgatcatttgctgaacagtaatgcaagatagcacaagacttgtctggggtgagagagagatcaaagctgtggatcccacccagtcttcaaccaaagcaatgtggctttgacctgttttctgtcttggacttgaataatactttatttgaaaga

SEQ ID NO: 15838 - DNA, 321 bp, Homo sapiens
  ENST00000437439
atccaggaagtggtgcagtatatcaagaggctagaagaagcgcaaagtaaacggcaagaaaaactcgtagagaaacacaaggaaatacgtcagcagatcctggatgaaaagcccaaggtaccatgatgaattcctctgtgcttttcttccatgaggttgctccatgaccatctttttgtgtctggatttgaaggttgcccatgaagattgttggttccatgtcaaactaaagcatttcttgagggtttttcttcatggcttaaaaacgttgtgccttaaagctgtgattttattaataaaataataaatcatgactgttaa

SEQ ID NO: 15839 - DNA, 122 bp, Homo sapiens
  ENST00000637422
cggcaagaaaaactcgtagagaaacacaaggaaatacgtcagcagatcctggatgaaaagcccaagatccagaccgtgaactcagtcatgagatggctgccctagctccacacatcataacc

SEQ ID NO: 15840 - DNA, 3316 bp, Homo sapiens
  ENST00000637935
caaggaaatacgtcagcagatcctggatgaaaagcccaaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtgaatgctcctgccaggccttcagaaattgcatggccactccagcgtcatcggactctctcttattacaaagatcactgcccaggaccatcttcccgagaagcatcccttagcctaaaatccacaccaaagggagagttccagaggaatccatgaagaattcccatgcccaggctccatgtgtcatgtggaaacctccacaggtctgctagtgaagaatgcatgtatgtgagatttttgttttctttccaatagcaaattcaaagcaagcaacttgcaggctccatggaacttttaatgaaggacagtgtcttctttgaagaaaatcaagctcgtgtttttattcgaagctctggtgtaaaatatttcaaagtcatagaaatagtttgagaaatgcatagcattatttaacactattgaacagccgactttgagcattgtttcttctaactgcccctcaactaccattatcttcaagtcaacatgcatattacattttcatcctttgctttgcaagcactggtggcttgcagtttgctaatttatttatcatagagtcatcaatgtatttgttgctgacatggttttattagatactgtagtgattcaaataagttttctatttgaaaaaaaaaatcacttgattgtatccttgcccagtgaagccatcctaagacttagcaatatggattgtacatttggctgcatgagcaagtcggccgcacacttccagacagtgtgctgtttgaattgactatttgcactcaaagtctgggtattcattggttattggcctgaaatgatcaaataactacaaatgatctgttgaataaaaatagttgagctgatatatgttaagcagatattcaatcagaatgaacaggttccggtggttattttgccgtttgacattttttatggttcatttatttttaatatagagaggaagattgaatatttatctagagaatacaaagacccacatgtaaatgataggtattatctccatgtatatatgtacccacttagtcatgtaagtgcatatacacatacacacacatgagtgtagacatgtgtttattaattgacaatgacccaaatctcttccacaagacttaaaaccaaattcagggacaaatggatagagaagaaaagggtcaaacatcgagattacatggatgttaaattatatggagacgctaagaaataattgatggagccattgatgcaaaccgaagtagatttagaacttatatgaatttgatttatattttgcaagatcaaaaattagatgttaagtatcagattttaagcttgttttaatggtcaaaaaattaggacagaaataatatggacatttattagtatcttccataatttttaagtctgacacatttctattttattctaacataaaaaaacttccattatatatttactaagtatatttaattcacttaactctgtctttataagttcctattttagatggaataagagaaacaaattatatcaaggtaaaactgatcaaaagcataattgaaagttctgaaaaaagaaaaataataatatgtagaaaaatgtaacttagagagtaacacatgaacattgaagttaaaacccagaagccagatgctcacagttttattttactttaaaataaacctgtctgactgtagctttgtgaaatatcttaaaacgcaaaaaccaattgtgtcctgaaaattgtttcaagaatttaatatttttatgaaaattattttatttaactttaagcaataactagagattacaattaaattttaatcaaaatgaaggcttagttcaaacataaggaaacagtgtttgattaaaaaaaacacatctagtaagacgtaaggggaaaatcacatcctctttggagatgattatattttgatctgaagggtttggggtgttcattagacacttaataaaacttaacttccaatgaaaaagaaatcttttgtaaatcattctacttttgcactttgaaagaaaggcgttaatcataaagaagcaagaatggtcaaaatcgaatgctgcatttttataaacaaaattacagactgtctgaaattgaagaagaatgaactaataatagcattcataaccaaacacaatgatgattattgcagaacattgtatcacattttagtccagagatagaataaagttgaataaccttgacttacacaaaactgttttggtagttggatttcattatcttagtgaatttagtcattttacaatatgtttgtatttggccatttactgtaatcacatttttatatctgtacaatgacactttttgcagttgtggggtagtgtgtaacactgtccatcttgcatcattgaaactactacaatgatactatcatttaataatattaatattacttgaaatagactaagataaagaaaaggggtctgtatgatgtgcagttttgtgcctttatgtatttgccttgttctttgtcgaatgtgtgaaattccgtactgtggtttttcctataatagaaagtagagctgtgtattaaattagactgtgtctctctgatacctttacactactgagaatagcatggttttggccatgtaaaccaattttcaaagttctaatgacatagccatgtgtttttggttttttatatttcattttaaaatttgagtatcaccatacattaattaatactcctgtagtagataagctgtcattaagtaattcccaaaaaaagggccatttgcttgcattactttgaatttaatgttgcgcttgtgcactgtgttaatattgtttgtgatggattggacgttgtgactcttgccttttaagaagaaaaaaaagataggacaaagtatttgaagctcttaaaatgtacatattttggttcttctatctcaaattatttaaaatgcataattcacatttttgtaataattctatgcaattttgtggcatgatgtttcttccacttgtaattttatgtgctttcatcacaaatccaaaggaaagaataaaaatttcttaacacaaccc

SEQ ID NO: 15841 - DNA, 3351 bp, Homo sapiens
  ENST00000637254
tctgtcgcccagactggagtgcactggcgcgatctcagctcaccacaaccactgcctcctgggttcaagcgattctcctgccccagcctcccaactgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtgaatgctcctgccaggccttcagaaattgcatggccactccagcgtcatcggactctctcttattacaaagatcactgcccaggaccatcttcccgagaagcatcccttagcctaaaatccacaccaaagggagagttccagaggaatccatgaagaattcccatgcccaggctccatgtgtcatgtggaaacctccacaggtctgctagtgaagaatgcatgtatgtgagatttttgttttctttccaatagcaaattcaaagcaagcaacttgcaggctccatggaacttttaatgaaggacagtgtcttctttgaagaaaatcaagctcgtgtttttattcgaagctctggtgtaaaatatttcaaagtcatagaaatagtttgagaaatgcatagcattatttaacactattgaacagccgactttgagcattgtttcttctaactgcccctcaactaccattatcttcaagtcaacatgcatattacattttcatcctttgctttgcaagcactggtggcttgcagtttgctaatttatttatcatagagtcatcaatgtatttgttgctgacatggttttattagatactgtagtgattcaaataagttttctatttgaaaaaaaaaatcacttgattgtatccttgcccagtgaagccatcctaagacttagcaatatggattgtacatttggctgcatgagcaagtcggccgcacacttccagacagtgtgctgtttgaattgactatttgcactcaaagtctgggtattcattggttattggcctgaaatgatcaaataactacaaatgatctgttgaataaaaatagttgagctgatatatgttaagcagatattcaatcagaatgaacaggttccggtggttattttgccgtttgacattttttatggttcatttatttttaatatagagaggaagattgaatatttatctagagaatacaaagacccacatgtaaatgataggtattatctccatgtatatatgtacccacttagtcatgtaagtgcatatacacatacacacacatgagtgtagacatgtgtttattaattgacaatgacccaaatctcttccacaagacttaaaaccaaattcagggacaaatggatagagaagaaaagggtcaaacatcgagattacatggatgttaaattatatggagacgctaagaaataattgatggagccattgatgcaaaccgaagtagatttagaacttatatgaatttgatttatattttgcaagatcaaaaattagatgttaagtatcagattttaagcttgttttaatggtcaaaaaattaggacagaaataatatggacatttattagtatcttccataatttttaagtctgacacatttctattttattctaacataaaaaaacttccattatatatttactaagtatatttaattcacttaactctgtctttataagttcctattttagatggaataagagaaacaaattatatcaaggtaaaactgatcaaaagcataattgaaagttctgaaaaaagaaaaataataatatgtagaaaaatgtaacttagagagtaacacatgaacattgaagttaaaacccagaagccagatgctcacagttttattttactttaaaataaacctgtctgactgtagctttgtgaaatatcttaaaacgcaaaaaccaattgtgtcctgaaaattgtttcaagaatttaatatttttatgaaaattattttatttaactttaagcaataactagagattacaattaaattttaatcaaaatgaaggcttagttcaaacataaggaaacagtgtttgattaaaaaaaacacatctagtaagacgtaaggggaaaatcacatcctctttggagatgattatattttgatctgaagggtttggggtgttcattagacacttaataaaacttaacttccaatgaaaaagaaatcttttgtaaatcattctacttttgcactttgaaagaaaggcgttaatcataaagaagcaagaatggtcaaaatcgaatgctgcatttttataaacaaaattacagactgtctgaaattgaagaagaatgaactaataatagcattcataaccaaacacaatgatgattattgcagaacattgtatcacattttagtccagagatagaataaagttgaataaccttgacttacacaaaactgttttggtagttggatttcattatcttagtgaatttagtcattttacaatatgtttgtatttggccatttactgtaatcacatttttatatctgtacaatgacactttttgcagttgtggggtagtgtgtaacactgtccatcttgcatcattgaaactactacaatgatactatcatttaataatattaatattacttgaaatagactaagataaagaaaaggggtctgtatgatgtgcagttttgtgcctttatgtatttgccttgttctttgtcgaatgtgtgaaattccgtactgtggtttttcctataatagaaagtagagctgtgtattaaattagactgtgtctctctgatacctttacactactgagaatagcatggttttggccatgtaaaccaattttcaaagttctaatgacatagccatgtgtttttggttttttatatttcattttaaaatttgagtatcaccatacattaattaatactcctgtagtagataagctgtcattaagtaattcccaaaaaaagggccatttgcttgcattactttgaatttaatgttgcgcttgtgcactgtgttaatattgtttgtgatggattggacgttgtgactcttgccttttaagaagaaaaaaaagataggacaaagtatttgaagctcttaaaatgtacatattttggttcttctatctcaaattatttaaaatgcataattcacatttttgtaataattctatgcaattttgtggcatgatgtttcttccacttgtaattttatgtgctttcatcacaaatccaaaggaaa

SEQ ID NO: 15842 - DNA, 1669 bp, Homo sapiens
  ENST00000637273
aggagaaagactcaaagttgttctaacatgggttctccaacttctgaaatccatccagaaactccctgtatttgggtaacagtattataactttttgcaccagggcttttttgtttgtttgttaatattaattgatttttcttatgttctttatgaaagaataactcatccattaatgaaaccaaatgtgaacttagtgccttctgtgtagaaaaggctaggaatacatattgtgggagattcattacatcactggccttaatactacaccttctcatgttcccccttggctgtgtaactttctagtgtccatatgctctctcttggggtggccagtgtgacttgctttggccaatgggatattagcaaccatgacataacccgaggcttataaagttgcctgctcattgggacttgtttcactgttgcatcccagttattcacatcactccagctgacagccaaccaacaaacagccagacacgtgagcccaaccaagatcagaagaactgtcccactgagcatagtctaaattgctaacatgcaaatgcatgaccacagcaaggtaatcttacagcccaggactcagctgctgcaatctctgtgaaaggttctgctcatgaaacagagacaaccatgtgtggtgcctgcattcttggcctgcggggagtggaaaggagacaaagagtaaaacacggtgggaaagaagaaaaagaggttaagaaaagcaaatgtgcctactccaggtaattttgacttagggaccctgattaacttacacactaattaaaccatttccagattttgtgcagtctgaaagcagcccattttccccaacaccaggtcgctcaagatgaccacaggaaggttgtcatcttcatgtctaaaagccagttgacactcaagggtgtcatttcacttcagtgaaatgagaagcttcacagatgtgtagactctgaaaaatctaactggaaaacaatacagggaaatagcaatactaggcatcaaagcagcaaaaaaactactcaattatctgatatggggattatcaatggaataaatgtggggtttgttgtttgttgttgggattgttgtgggttttgtttcattttttagggtctcacttttctccaccaattagatctgtgctgtgagccacacaggttttgagtacatgttttgggactttatatcggtcagactttgccatggtaacactgtgtaacgagcagccccaaaaatctcagtggtggtcaaaagcaaacctttatttctcattcatgggttttcagtttgttcaggctaaaagtaaaatacacagattcttcacctgtctttcattccatgctgaaggagcaattgactgcctgggacatacttttctcataacagaggcaagggtgaaaaacaccaagtcatcttgattatgcaatcccatttttaatgtaaacaatgtcatgtctgcttctatttcattgagcaaagcaagtcatataggcaagcccaacatcagtggggtgataaagcacactctccaatggaaggaggaggggagcatgatcatttgctgaacagtaatgcaagatagcacaagacttgtctggggtgagagagagatcaaagctgtggatcccacccagtcttcaaccaaagcaatgtggctttgacc

SEQ ID NO: 15843 - DNA, 6458 bp, Homo sapiens
  ENST00000617005
acccaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtgaatgctcctgccaggccttcagaaattgcatggccactccagcgtcatcggactctctcttattacaaagatcactgcccaggaccatcttcccgagaagcatcccttagcctaaaatccacaccaaagggagagttccagaggaatccatgaagaattcccatgcccaggctccatgtgtcatgtggaaacctccacaggtctgctagtgaagaatgcatgtatgtgagatttttgttttctttccaatagcaaattcaaagcaagcaacttgcaggctccatggaacttttaatgaaggacagtgtcttctttgaagaaaatcaagctcgtgtttttattcgaagctctggtgtaaaatatttcaaagtcatagaaatagtttgagaaatgcatagcattatttaacactattgaacagccgactttgagcattgtttcttctaactgcccctcaactaccattatcttcaagtcaacatgcatattacattttcatcctttgctttgcaagcactggtggcttgcagtttgctaatttatttatcatagagtcatcaatgtatttgttgctgacatggttttattagatactgtagtgattcaaataagttttctatttgaaaaaaaaaatcacttgattgtatccttgcccagtgaagccatcctaagacttagcaatatggattgtacatttggctgcatgagcaagtcggccgcacacttccagacagtgtgctgtttgaattgactatttgcactcaaagtctgggtattcattggttattggcctgaaatgatcaaataactacaaatgatctgttgaataaaaatagttgagctgatatatgttaagcagatattcaatcagaatgaacaggttccggtggttattttgccgtttgacattttttatggttcatttatttttaatatagagaggaagattgaatatttatctagagaatacaaagacccacatgtaaatgataggtattatctccatgtatatatgtacccacttagtcatgtaagtgcatatacacatacacacacatgagtgtagacatgtgtttattaattgacaatgacccaaatctcttccacaagacttaaaaccaaattcagggacaaatggatagagaagaaaagggtcaaacatcgagattacatggatgttaaattatatggagacgctaagaaataattgatggagccattgatgcaaaccgaagtagatttagaacttatatgaatttgatttatattttgcaagatcaaaaattagatgttaagtatcagattttaagcttgttttaatggtcaaaaaattaggacagaaataatatggacatttattagtatcttccataatttttaagtctgacacatttctattttattctaacataaaaaaacttccattatatatttactaagtatatttaattcacttaactctgtctttataagttcctattttagatggaataagagaaacaaattatatcaaggtaaaactgatcaaaagcataattgaaagttctgaaaaaagaaaaataataatatgtagaaaaatgtaacttagagagtaacacatgaacattgaagttaaaacccagaagccagatgctcacagttttattttactttaaaataaacctgtctgactgtagctttgtgaaatatcttaaaacgcaaaaaccaattgtgtcctgaaaattgtttcaagaatttaatatttttatgaaaattattttatttaactttaagcaataactagagattacaattaaattttaatcaaaatgaaggcttagttcaaacataaggaaacagtgtttgattaaaaaaaacacatctagtaagacgtaaggggaaaatcacatcctctttggagatgattatattttgatctgaagggtttggggtgttcattagacacttaataaaacttaacttccaatgaaaaagaaatcttttgtaaatcattctacttttgcactttgaaagaaaggcgttaatcataaagaagcaagaatggtcaaaatcgaatgctgcatttttataaacaaaattacagactgtctgaaattgaagaagaatgaactaataatagcattcataaccaaacacaatgatgattattgcagaacattgtatcacattttagtccagagatagaataaagttgaataaccttgacttacacaaaactgttttggtagttggatttcattatcttagtgaatttagtcattttacaatatgtttgtatttggccatttactgtaatcacatttttatatctgtacaatgacactttttgcagttgtggggtagtgtgtaacactgtccatcttgcatcattgaaactactacaatgatactatcatttaataatattaatattacttgaaatagactaagataaagaaaaggggtctgtatgatgtgcagttttgtgcctttatgtatttgccttgttctttgtcgaatgtgtgaaattccgtactgtggtttttcctataatagaaagtagagctgtgtattaaattagactgtgtctctctgatacctttacactactgagaatagcatggttttggccatgtaaaccaattttcaaagttctaatgacatagccatgtgtttttggttttttatatttcattttaaaatttgagtatcaccatacattaattaatactcctgtagtagataagctgtcattaagtaattcccaaaaaaagggccatttgcttgcattactttgaatttaatgttgcgcttgtgcactgtgttaatattgtttgtgatggattggacgttgtgactcttgccttttaagaagaaaaaaaagataggacaaagtatttgaagctcttaaaatgtacatattttggttcttctatctcaaattatttaaaatgcataattcacatttttgtaataattctatgcaattttgtggcatgatgtttcttccacttgtaattttatgtgctttcatcacaaatccaaaggaaagaataaaaatttcttaac

SEQ ID NO: 15844 - DNA, 6576 bp, Homo sapiens
  ENST00000612075
acccaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagggggaaggttcctcctcattcttgtcggaaacttgccatgaggatccctctgtttcccccaactttactccccccaaccctcaagctctcaagtggtgaccaccgtccttccggccagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtgaatgctcctgccaggccttcagaaattgcatggccactccagcgtcatcggactctctcttattacaaagatcactgcccaggaccatcttcccgagaagcatcccttagcctaaaatccacaccaaagggagagttccagaggaatccatgaagaattcccatgcccaggctccatgtgtcatgtggaaacctccacaggtctgctagtgaagaatgcatgtatgtgagatttttgttttctttccaatagcaaattcaaagcaagcaacttgcaggctccatggaacttttaatgaaggacagtgtcttctttgaagaaaatcaagctcgtgtttttattcgaagctctggtgtaaaatatttcaaagtcatagaaatagtttgagaaatgcatagcattatttaacactattgaacagccgactttgagcattgtttcttctaactgcccctcaactaccattatcttcaagtcaacatgcatattacattttcatcctttgctttgcaagcactggtggcttgcagtttgctaatttatttatcatagagtcatcaatgtatttgttgctgacatggttttattagatactgtagtgattcaaataagttttctatttgaaaaaaaaaatcacttgattgtatccttgcccagtgaagccatcctaagacttagcaatatggattgtacatttggctgcatgagcaagtcggccgcacacttccagacagtgtgctgtttgaattgactatttgcactcaaagtctgggtattcattggttattggcctgaaatgatcaaataactacaaatgatctgttgaataaaaatagttgagctgatatatgttaagcagatattcaatcagaatgaacaggttccggtggttattttgccgtttgacattttttatggttcatttatttttaatatagagaggaagattgaatatttatctagagaatacaaagacccacatgtaaatgataggtattatctccatgtatatatgtacccacttagtcatgtaagtgcatatacacatacacacacatgagtgtagacatgtgtttattaattgacaatgacccaaatctcttccacaagacttaaaaccaaattcagggacaaatggatagagaagaaaagggtcaaacatcgagattacatggatgttaaattatatggagacgctaagaaataattgatggagccattgatgcaaaccgaagtagatttagaacttatatgaatttgatttatattttgcaagatcaaaaattagatgttaagtatcagattttaagcttgttttaatggtcaaaaaattaggacagaaataatatggacatttattagtatcttccataatttttaagtctgacacatttctattttattctaacataaaaaaacttccattatatatttactaagtatatttaattcacttaactctgtctttataagttcctattttagatggaataagagaaacaaattatatcaaggtaaaactgatcaaaagcataattgaaagttctgaaaaaagaaaaataataatatgtagaaaaatgtaacttagagagtaacacatgaacattgaagttaaaacccagaagccagatgctcacagttttattttactttaaaataaacctgtctgactgtagctttgtgaaatatcttaaaacgcaaaaaccaattgtgtcctgaaaattgtttcaagaatttaatatttttatgaaaattattttatttaactttaagcaataactagagattacaattaaattttaatcaaaatgaaggcttagttcaaacataaggaaacagtgtttgattaaaaaaaacacatctagtaagacgtaaggggaaaatcacatcctctttggagatgattatattttgatctgaagggtttggggtgttcattagacacttaataaaacttaacttccaatgaaaaagaaatcttttgtaaatcattctacttttgcactttgaaagaaaggcgttaatcataaagaagcaagaatggtcaaaatcgaatgctgcatttttataaacaaaattacagactgtctgaaattgaagaagaatgaactaataatagcattcataaccaaacacaatgatgattattgcagaacattgtatcacattttagtccagagatagaataaagttgaataaccttgacttacacaaaactgttttggtagttggatttcattatcttagtgaatttagtcattttacaatatgtttgtatttggccatttactgtaatcacatttttatatctgtacaatgacactttttgcagttgtggggtagtgtgtaacactgtccatcttgcatcattgaaactactacaatgatactatcatttaataatattaatattacttgaaatagactaagataaagaaaaggggtctgtatgatgtgcagttttgtgcctttatgtatttgccttgttctttgtcgaatgtgtgaaattccgtactgtggtttttcctataatagaaagtagagctgtgtattaaattagactgtgtctctctgatacctttacactactgagaatagcatggttttggccatgtaaaccaattttcaaagttctaatgacatagccatgtgtttttggttttttatatttcattttaaaatttgagtatcaccatacattaattaatactcctgtagtagataagctgtcattaagtaattcccaaaaaaagggccatttgcttgcattactttgaatttaatgttgcgcttgtgcactgtgttaatattgtttgtgatggattggacgttgtgactcttgccttttaagaagaaaaaaaagataggacaaagtatttgaagctcttaaaatgtacatattttggttcttctatctcaaattatttaaaatgcataattcacatttttgtaataattctatgcaattttgtggcatgatgtttcttccacttgtaattttatgtgctttcatcacaaatccaaaggaaagaataaaaatttcttaac

SEQ ID NO: 15845 - DNA, 12024 bp, Homo sapiens
  ENST00000371380
atctaccaccttaaaaccctgatctagaaaaaatatatattcatgataggaagttataactaagaaaatttatttgcctcttaatgctcctgaatgaaaggaattatccctttgttctttgggaggacttgtgtatctgagattgttgtaataatcagtcattttattaaaaccttgacatgatcaccagggaggaaaaatagagcaatagtcaaaacctgtgtgttagtccaagatgacttctgaagaaatgacagcttctgttctcatacctgtgactcagagaaaagtggtttctgcccagtcggctgcagatgaaagtagtgaaaaggtctcagacatcaatatttcaaaagcacatactgtcagacgaagtggggagacttctcataccatctcacaactgaacaaacttaaagaagaaccttctggaagcaacttgccaaagattctctcaatagcgagggagaaaatagtgagtgatgagaacagtaatgaaaaatgttgggagaaaatcatgccagattctgcgaaaaaccttaacattaactgcaacaacatattgagaaaccatcagcatggccttcctcagagacaattttatgaaatgtacaactctgttgctgaggaagacttgtgtttagaaactggaattccttctccactggaaagaaaggtgttccctggaattcaactggaactagacagaccttccatgggcattagtcctttaggaaatcagtcagtgatcatagagacaggcagagcacaccctgacagcagaagggcagtatttcattttcattatgaagttgacagaagaatgtcagacactttctgtaccctatcagaaaacttaattttagacgattgtggaaattgtgtaccactacctgggggtgaggagaagcaaaagaaaaactatgtggcatatacctgtaaactgatggaattggccaaaaattgtgataataagaatgagcagctgcagtgtgatcattgtgacaccttgaatgataaatacttttgctttgaaggctcttgtgagaaggttgacatggtatattcaggtgatagcttttgtaggaaagactttactgacagtcaagctgccaagacctttttgagccattttgaggacttccctgataattgtgatgatgtagaagaagacgcttttaaaagcaaaaaggagcgatccactttgttagtcaggagattctgtaaaaatgacagagaagttaagaaatctgtgtatactggaacaagagcaattgtgagaactctgccttctggccacattgggctgactgcatggagttacatagatcagaagagaaatggtcccttactgccttgtgggagagtaatggaacccccgtcaacagtggagataaggcaagatgggagccaacgtctgtcagaagcccagtggtatcctatctacaatgcagtgagaagagaagaaacagaaaatacagttggatctctactccatttcctcaccaagctcccagcctccgagacagcccatggaaggataagcgttggtccatgcttaaagcaatgtgtccgagacactgtatgtgagtatcgcgccaccctccaaaggacttcaatatcgcagtacatcaccggttctctcctagaagcaaccacgtctttgggagcaagaagtggccttctcagtacttttggaggatccactggacgaatgatgctgaaagaacgccagccaggcccctctgtggccaattccaatgccctcccttcaagttcagctgggatcagcaaggagctgatcgatctgcagcctctcatccagttcccagaggaagtcgccagcatcctgatggagcaagagcagactatttaccgcagggtcttgccagtcgactacctttgcttcttaacacgggacttgggcactcctgaatgccagagctccttgccctgcctcaaagcatccatctcagcgtcgattcttaccactcagaatggagagcacaatgcccttgaagatctggtgatgaggtttaatgaggtgagctcctgggtgacatggctgatcctcacggcaggctccatggaggagaagcgagaagtcttttcatatttggtgcatgtggccaaatgctgctggaacatgggcaactacaacgctgtcatggagttcttggctggcctcaggtcaagaaaagttttaaaaatgtggcagttcatggaccagtctgatattgagaccatgaggagcctgaaggatgctatggcccagcatgagtcctcttgtgagtacagaaaggtggtgacacgtgccctgcacatccctggctgtaaggtggttccattctgtggggtgtttctgaaggagctctgtgaagtgcttgacggcgcctccggtctcatgaagctttgcccgcggtacaattcccaagaagaaactttagagtttgtagcagattacagtggacaagataatttcttacaacgagtgggacaaaatggcttaaagaattcggagaaggagtccactgtcaacagcatctttcaggtcatccggagctgcaatcgaagtctggagacagacgaggaggacagccccagtgaaggaaacagctccaggaaaagctccttgaaggataaaagccgatggcagtttataattggagatttgttggattcagacaatgacatctttgagcaatccaaagaatacgactctcatggttcagaggactcacagaaggccttcgaccatgggacggagctcatcccttggtacgtgctgtccatccaagccgatgtgcaccagttcctgctgcagggggccacggtcatccactacgaccaggacacacacctctctgcccgctgcttcctccagcttcagcccgacaatagcaccttgacctgggtaaagcccacaactgcctccccagccagcagtaaagcaaaacttggtgtacttaataacacagctgagcctggaaaattcccactactgggtaatgctggattaagtagcctgacggaaggggtcttggatctttttgcagtgaaggctgtatacatgggccaccctggcattgatatacacactgtgtgtgttcagaacaaactgggtagcatgttcctgtcagagactggtgtgacattgctctatgggcttcagaccacagacaacagattattgcacttcgtggcaccaaagcacacagctaaaatgctcttcagcggattattggaactcactagagctgtgagaaagatgaggaaattccctgaccaaagacagcagtggctgcggaaacagtacgtcagcctttatcaggaggatggacggtatgaaggcccaactttggctcacgctgtggagttgtttggtggcagacggtggagtgctcgaaaccccagccccggaacatcagcaaagaatgctgagaagcccaatatgcagagaaacaataccctgggcataagcactaccaagaaaaagaagaaaatcctcatgaggggtgagagtggagaggtaactgacgatgagatggcaacccgaaaggccaagatgcacaaagagtgtcgaagccggagtggttctgatcctcaagacattaatgaacaagaagaatcagaggtgaatgccatcgctaaccctccaaaccccctcccttccagaagagcccactctttgaccacagctgggtcccccaacttggctgccgggacgtcatctcccatcaggccagtgtcctcccctgtgctgtcttcttcaaacaagagcccatccagtgcttggagcagtagtagctggcacgggcggatcaaaggcggcatgaagggatttcagagcttcatggtttcagatagcaacatgagttttgttgaatttgttgagctgttcaaatcattcagtgtcaggagccgcaaggacctgaaggatctgtttgatgtctatgcagtgccctgcaaccgatctggctccgagtcagccccactctacaccaacctgacaattgatgaaaacaccagcgatcttcagcctgacctagatctgttgaccagaaatgtctcggatttggggttgttcattaagagtaaacagcagctatcggacaaccagaggcagatatctgatgccattgctgctgcaagcattgtgacaaatggcactgggattgagagcacatctctgggcatttttggggtgggcatacttcagctcaacgatttcctcgtgaattgccaaggagaacactgcacttatgatgaaatcctcagcatcatccagaagttcgagcctagcatcagtatgtgtcatcagggactaatgtcatttgaagggtttgccaggtttctgatggataaagaaaattttgcctcaaaaaatgatgagtcacaggagaacattaaagaactgcagctacccctctcatactattacatcgaatcttcgcacaatacctacctcacgggccatcagctcaaaggagaatcctcggtagaactctacagccaggtccttttgcaaggctgtcgaagtgtagaattggactgctgggacggagacgatgggatgcccatcatttatcatggacatacgctgacaaccaagatccccttcaaggaagtggttgaagccattgatcgcagtgccttcatcaactctgacctgccaatcatcatatcgattgagaaccactgttcattgcctcagcaacgaaaaatggcagaaattttcaagactgtgtttggagaaaagctggtgactaaattcttatttgagactgatttctcagatgatccaatgcttccttcacctgaccaactcagaaagaaagttcttcttaaaaacaagaagctaaaagcccatcagacgccagtggatatcttaaagcaaaaggctcatcagttagcatctatgcaagtgcaggcttataatggtgggaatgccaacccccgacctgccaataatgaggaagaggaagatgaggaggacgaatatgattatgactatgaatccctttctgatgacaacattctggaagacagacctgaaaataaatcatgtaatgacaagcttcagtttgaatataatgaagaaatcccaaagaggataaagaaagcagataactctgcttgcaacaaaggaaaggtttatgatatggaactgggagaagaattttatcttgatcagaataaaaaggaaagcagacagattgcaccagagctttctgaccttgtaatctattgtcaagcagtaaaatttccaggactgtcaactctaaatgcatctggctctagcagaggaaaagaaaggaaaagcaggaagtccatttttggcaacaatccgggcagaatgagcccaggggagacagcatcatttaacaaaacatctggaaaaagttcctgtgaaggcattcgacagacctgggaggaatcttcttcccctctcaacccaaccacgtccctcagtgctatcattagaactcccaaatgttatcatatctcgtcgctgaatgaaaatgccgccaaacgtctgtgtcgcaggtattctcagaaactgacccagcacaccgcctgtcagctgctgagaacttaccctgctgccacccgcatcgactcttccaacccgaaccccctcatgttctggctccatgggatacagcttgtggcactcaactaccagactgatgatctccctttacatttaaatgctgcaatgtttgaggcaaatggtggttgtggttatgtattgaaacctccagttctgtgggacaagaactgccccatgtatcagaagttttctccactagaaagagatctggacagcatggatcctgcagtctattctttaactattgtctctggtcagaatgtgtgccccagtaatagcatgggaagcccgtgcattgaagtcgacgtcctgggcatgcctctggacagctgccatttccgcacaaagcccatccatcgaaacaccctgaaccccatgtggaacgagcagtttctgttccacgttcacttcgaagatcttgtatttcttcgttttgcagttgtggaaaacaatagttcagcggtaactgctcagagaatcattccactgaaagctttaaaacgaggatatcgacatcttcagctgcgaaaccttcacaatgaagtcttggagatttctagtttattcattaacagcagaaggatggaagaaaattcctctggcaataccatgtcagcctcttcgatgtttaatacagaagaaagaaaatgtttgcagactcacagagtcacggtgcatggggtcccagggccagagccctttaccgttttcactattaatggaggcaccaaggcaaagcagcttctgcagcaaattctgacaaatgaacaagacatcaaacctgttaccacagactattttttgatggaagaaaaatattttatatctaaagaaaagaatgaatgtaggaaacaaccattccagagagccattggtccagaagaggagatcatgcaaattttaagcagctggtttccagaagagggatacatgggcaggattgtcttaaaaacccagcaggaaaacctagaagagaaaaacattgttcaagatgacaaagaggtgatcttgagctcagaggaggagagtttctttgtccaagtgcatgatgtttctccagagcaacctcgaacagtcatcaaagcaccccgcgtcagcactgcacaggatgtcattcagcagaccttatgcaaagccaaatattcctacagcatcctgagcaaccccaatccaagcgactatgtgcttttggaagaggtggtgaaagacactaccaacaagaagactaccacaccaaagtcctctcagcgggtccttctggatcaggagtgtgtgtttcaagcccaaagcaagtggaaaggtgcaggaaaattcatccttaagctaaaggagcaggtgcaggcatctcgagaagataaaaagaaaggcatttctttcgcaagtgaactcaagaagctcaccaagtcaactaaacagccccgaggacttacatcaccttctcagctcttgacctcagaaagtatccaaaccaaggaggagaaacctgtgggtggcttgtcctccagtgacacaatggattaccgacagtgactaagggcagcatgtttaacccaggtgaagatctttaagcaagaagttaaagagtgaacatggtggaaaaaatataattattttcatcagacttaaactggaaattgatgatttctgaactgaagccttcacacatgtgagatccatgctgaggagaagcaaaatggcacagggctagttgccaccaaccaatttactgatgaatgaagcccaggggactgccattttataaatgtcagcagttggaaaaatcgtcacgaattgacttagagcaagggtcagcaagcttgtctgtaaagggccaaacagtaaatattttagggctgggggccataaaatatgttgcaaccacccaattctgccattgtagtgcaaaagcagccatagacaacacatacatgaacgaacgtggctgtattccaataaaactttatttatggacactgaaattggaatttcatatatttttcacatgtcacaaatactcttgttttgactttttttcaaccatttaaaaacttaaaaactattcttaattcaggggccatacaaaaacaggtggcaggctagatttggcccaaggaccttaatttgccaacacaactaagagaagagaactgggaacaaggagcacaaagatctgaaaacaggaaaggaagtttagccatacattttatggccgagaattagaagcttagaattagaagctttggggcatttcaagtgtaaatatgtcctataacataagagtcattaaaattcaatttagttcctgtattgtgtaccacagtgcactcctctttaggatttttttacatatagaaataatattgggttttttttaaggttattgcctattcagttaatagggttgctttaaaaaaggttattgcttaatcatagattagattactcatttttggttttcaaaatgaatttagaatgacgtataatttaatatctactgaattgcaatgtcttaacaagaaacctaacaattttttaaagcaaaagtagattgagttggcgtttaaatttattttgcaaggtttgtactgacactatacttatatatttattatacatcgctctcttgatattgccatggattagaagcattagttctcagtacttgaagacaaacttctaaaaagaaaatatatgctctgaacatctgaaatgggctagactttcaagtaaaattgcttcatttctcattaactgaagagctattgatccaagtcatacttgccatttaatgtaaattatttttaaactttgctgtacaaaaccattaagtgtaaaggattcttcatattcttagtatgaagcaaattatgaattttaaaaatgaaatatgtattcctctaaaacccaaacttttatctttccattggtatctttgaattttaagacacttttcttcaaattacaaaacactaaaactcactcctaaacttcactttgagaaacttttttaaccaattataaaaataaaaccatccccatgtgtttcttgcatattctaaaaacagaagtgttaaaaatacaccacacaggctgggcagagtggctcacgcctgtaactccagcactttgggaggccaagatgggcggatcaggacagagaatgaggccatcctggccaacatggtgaaacccaatctctactaaaagtacaaaaattagctgagcgtggtggcacgtgcctgtaatcccagctactcgggaggctgaggcaggagaatcacttgaacctgggaggtggaggctgcagtgagccaagatcgcaccaccacgctccagcctggtgacagagcgagactccgtctcaaaaaaaaaaaaaaaaaaaaaaaaaaaaaaaaaaacaccatacagctttcatgtcattgaaagttcttactgggtcaaagccttaaggctagaactaccattttcttgtcaacagaattcaggctattccagtttgatgtaatctatacagtagtacagttttaagtcaaatattcattctaacaaatgcacaatgctgctccattttaaaaatattccggaaacactttatcaagcctctataagtgaacatgccaaacagtttgccctaccacgtgttgaaaactgagttgctggtctaagtggctagaggccaaatgaaaactgtgcagagtaacaagatgaaaagactcgtctctttaggtttatcacatttgattctgatgctaagcgctgccccactcctcctccatgacctttaacacaggtgtatgttttacaacataaatctgagactgaagttgagaccaggttgtttagcaagtgagagaatccagcctactgcctaggttgcatcccaatttagttgtttatcacattttgaggtgaaagtacatacttcattgtatttgagtctttgggattacagaaagaacacattgtttcaaaatgtaaagagttggctgggcacagtggctcatgcctgtaatcccaacactctgggaggctgaggtgggtggatcacctgaggtctggagttcgaggccaacatggtgaaacccgtctctactaaaaatacaaaaattagctgggtactaaaaatacaaaaattagtggtggtgggcacctgtaaatcccagctattggggaggctgaggcaggagagaattgcctgaactcaagacgcagaggttgcagtgagtggagactgtgccactgcactccagcctgggtacaagagtgagactccatctcaaaaaaaaaaaaaaaaagtaaagagtctagtctactattatacacaaatggccagcacaatctgatgttggctgaaaatatttaagttttatttaaagctttctgaattaaacagctatattatgccaagtgaaagaaattatcctaaatagccactatgactatacccattaccatttcacactttttaggccaccagaaatctgggtagcaaactcttctcattaaagttgatgtggacaagaatctaaatatgcaagttggggtcattacaaaattttaagaagcatcactgaaagtgaagagaaaggagcatgaattctgtcactctattcagtgatgccaaatctgtaggaatgatcctatctgggtagaaagtgccctttgaggggtaaagcttcttttcatgtcatcattagcaagtaaaagttatttacaaattctccagttgggagtcaatatgaagtctagactcaacaaaagttgagttacaagtgacttgtttttaatcaaacttgctttcttttatgggaggcttttatgcctcccatctcaatacctctggagacactggaagctcattaatgaaagtgggccctctatgatatgtatcaatttaccttttgctaactacatcgtccccttcctttcttctctcctcttccaatatctctatagacttctgtcctctgcccagagacccacaggccttgcttaattctggaaagttatcagggcttgcttactggcccaataaaattgaattaactctaaaacacaaaactccacatctatgctcccatgctagtaaagaagagtaggattttcctggctggtgtctttgatcttacattggcagcctgcagggaaagtgctctcatggtgaaagtctctgaccccttttcagttgcttatatatcagcagtgaggccagaaaagatatacctgggaccccaaaaaagttagagagaaaagggagattgtctcttatacagagtctagacttgggtcaatattccccatgatccattgttaataatttatgtgttctctgccatccttatgtagcagcttcctaaaagcaatccttggctgatggctatggattctgacataggaatacctgaaatgagtccctttgaaacacatactgagtctctatgattaccaagttattcttttttttttttttttttttgaggcaaagtctcactctgttgcccagcctggagtgcagtggtacgatctcgactcaccacaacctccacctcccaggttcaagtgattctcctgcctcagcctcccaagtagctgggactacaggtgtgcgccatgtccgtctaattttttttattttcagtagagacgggggtttcactatgttggtaaggctggtctcgaactcctgacctcgtgatccacccgcctcagcctcccaaagtgctgggattacaggcgtgagccaccacacctggcctacctactcttatacatctcttagattcaaaacatactatgcacaagcctgtcaccaaacagatctctgaaaccttccctattgcagatgacataggtctctaaacttttgacacaagtaattctaacactgaattgggtactgtcgcatttttcaaaagcgttatgtggatgatttgactcagcatggaagactgaggttgtcttacacccattatttcccaccccactcttaagtgccagcatagtgctaaacacacagtaggtgctcattatttgtctagttaaaaaacaaattaaggctgtagcttaatatagcctcaggatatgtgtgtgcctgtgtgtgtgtgtgtgtgtgtgtgtgtgtgtgtgtgtgtgtgtttaaacataagcttacatataagcgtatgtaagttaatgcacaaatatatttcctcaaattcacataggatactcaaatatagatgtataattttgtagtcccactgtgattctccatatgtataacaagaaaattaaaggcataatacagctgtgaaatagctgatgagtttctattttaagctgatttttcaccagaagtatagtttctgctgccaaagtaaagtataaatgtatttgtatatgtgtggaaaataaataatttgtgacatgta

SEQ ID NO: 15846 - DNA, 6514 bp, Homo sapiens
  ENST00000371375
atggtttcagaaggaagtgcagcaggaagagactttgcaggaatggaagaggtgaggcagctccacgtgagattctgcaaagggattaagatttggcaccaggcttggtttctgtgcagcctcttaggcagagagccccaggagagggaagcaggctgtcagctgtggctttgcacgctctcagctgtcttgaaggttggttggctcttcccgctctctgaggtacccaattttaccttgttaaaggatggatgtggatgctggaggcttaaagaagaccagatctacaatgcagtgagaagagaagaaacagaaaatacagttggatctctactccatttcctcaccaagctcccagcctccgagacagcccatggaaggataagcgttggtccatgcttaaagcaatgtgtccgagacactgtatgtgagtatcgcgccaccctccaaaggacttcaatatcgcagtacatcaccggttctctcctagaagcaaccacgtctttgggagcaagaagtggccttctcagtacttttggaggatccactggacgaatgatgctgaaagaacgccagccaggcccctctgtggccaattccaatgccctcccttcaagttcagctgggatcagcaaggagctgatcgatctgcagcctctcatccagttcccagaggaagtcgccagcatcctgatggagcaagagcagactatttaccgcagggtcttgccagtcgactacctttgcttcttaacacgggacttgggcactcctgaatgccagagctccttgccctgcctcaaagcatccatctcagcgtcgattcttaccactcagaatggagagcacaatgcccttgaagatctggtgatgaggtttaatgaggtgagctcctgggtgacatggctgatcctcacggcaggctccatggaggagaagcgagaagtcttttcatatttggtgcatgtggccaaatgctgctggaacatgggcaactacaacgctgtcatggagttcttggctggcctcaggtcaagaaaagttttaaaaatgtggcagttcatggaccagtctgatattgagaccatgaggagcctgaaggatgctatggcccagcatgagtcctcttgtgagtacagaaaggtggtgacacgtgccctgcacatccctggctgtaaggtggttccattctgtggggtgtttctgaaggagctctgtgaagtgcttgacggcgcctccggtctcatgaagctttgcccgcggtacaattcccaagaagaaactttagagtttgtagcagattacagtggacaagataatttcttacaacgagtgggacaaaatggcttaaagaattcggagaaggagtccactgtcaacagcatctttcaggtcatccggagctgcaatcgaagtctggagacagacgaggaggacagccccagtgaaggaaacagctccaggaaaagctccttgaaggataaaagccgatggcagtttataattggagatttgttggattcagacaatgacatctttgagcaatccaaagaatacgactctcatggttcagaggactcacagaaggccttcgaccatgggacggagctcatcccttggtacgtgctgtccatccaagccgatgtgcaccagttcctgctgcagggggccacggtcatccactacgaccaggacacacacctctctgcccgctgcttcctccagcttcagcccgacaatagcaccttgacctgggtaaagcccacaactgcctccccagccagcagtaaagcaaaacttggtgtacttaataacacagctgagcctggaaaattcccactactgggtaatgctggattaagtagcctgacggaaggggtcttggatctttttgcagtgaaggctgtatacatgggccaccctggcattgatatacacactgtgtgtgttcagaacaaactgggtagcatgttcctgtcagagactggtgtgacattgctctatgggcttcagaccacagacaacagattattgcacttcgtggcaccaaagcacacagctaaaatgctcttcagcggattattggaactcactagagctgtgagaaagatgaggaaattccctgaccaaagacagcagtggctgcggaaacagtacgtcagcctttatcaggaggatggacggtatgaaggcccaactttggctcacgctgtggagttgtttggtggcagacggtggagtgctcgaaaccccagccccggaacatcagcaaagaatgctgagaagcccaatatgcagagaaacaataccctgggcataagcactaccaagaaaaagaagaaaatcctcatgaggggtgagagtggagaggtaactgacgatgagatggcaacccgaaaggccaagatgcacaaagagtgtcgaagccggagtggttctgatcctcaagacattaatgaacaagaagaatcagaggtgaatgccatcgctaaccctccaaaccccctcccttccagaagagcccactctttgaccacagctgggtcccccaacttggctgccgggacgtcatctcccatcaggccagtgtcctcccctgtgctgtcttcttcaaacaagagcccatccagtgcttggagcagtagtagctggcacgggcggatcaaaggcggcatgaagggatttcagagcttcatggtttcagatagcaacatgagttttgttgaatttgttgagctgttcaaatcattcagtgtcaggagccgcaaggacctgaaggatctgtttgatgtctatgcagtgccctgcaaccgatctggctccgagtcagccccactctacaccaacctgacaattgatgaaaacaccagcgatcttcagcctgacctagatctgttgaccagaaatgtctcggatttggggttgttcattaagagtaaacagcagctatcggacaaccagaggcagatatctgatgccattgctgctgcaagcattgtgacaaatggcactgggattgagagcacatctctgggcatttttggggtgggcatacttcagctcaacgatttcctcgtgaattgccaaggagaacactgcacttatgatgaaatcctcagcatcatccagaagttcgagcctagcatcagtatgtgtcatcagggactaatgtcatttgaagggtttgccaggtttctgatggataaagaaaattttgcctcaaaaaatgatgagtcacaggagaacattaaagaactgcagctacccctctcatactattacatcgaatcttcgcacaatacctacctcacgggccatcagctcaaaggagaatcctcggtagaactctacagccaggtccttttgcaaggctgtcgaagtgtagaattggactgctgggacggagacgatgggatgcccatcatttatcatggacatacgctgacaaccaagatccccttcaaggaagtggttgaagccattgatcgcagtgccttcatcaactctgacctgccaatcatcatatcgattgagaaccactgttcattgcctcagcaacgaaaaatggcagaaattttcaagactgtgtttggagaaaagctggtgactaaattcttatttgagactgatttctcagatgatccaatgcttccttcacctgaccaactcagaaagaaagttcttcttaaaaacaagaagctaaaagcccatcagacgccagtggatatcttaaagcaaaaggctcatcagttagcatctatgcaagtgcaggcttataatggtgggaatgccaacccccgacctgccaataatgaggaagaggaagatgaggaggacgaatatgattatgactatgaatccctttctgatgacaacattctggaagacagacctgaaaataaatcatgtaatgacaagcttcagtttgaatataatgaagaaatcccaaagaggataaagaaagcagataactctgcttgcaacaaaggaaaggtttatgatatggaactgggagaagaattttatcttgatcagaataaaaaggaaagcagacagattgcaccagagctttctgaccttgtaatctattgtcaagcagtaaaatttccaggactgtcaactctaaatgcatctggctctagcagaggaaaagaaaggaaaagcaggaagtccatttttggcaacaatccgggcagaatgagcccaggggagacagcatcatttaacaaaacatctggaaaaagttcctgtgaaggcattcgacagacctgggaggaatcttcttcccctctcaacccaaccacgtccctcagtgctatcattagaactcccaaatgttatcatatctcgtcgctgaatgaaaatgccgccaaacgtctgtgtcgcaggtattctcagaaactgacccagcacaccgcctgtcagctgctgagaacttaccctgctgccacccgcatcgactcttccaacccgaaccccctcatgttctggctccatgggatacagcttgtggcactcaactaccagactgatgatctccctttacatttaaatgctgcaatgtttgaggcaaatggtggttgtggttatgtattgaaacctccagttctgtgggacaagaactgccccatgtatcagaagttttctccactagaaagagatctggacagcatggatcctgcagtctattctttaactattgtctctggtcagaatgtgtgccccagtaatagcatgggaagcccgtgcattgaagtcgacgtcctgggcatgcctctggacagctgccatttccgcacaaagcccatccatcgaaacaccctgaaccccatgtggaacgagcagtttctgttccacgttcacttcgaagatcttgtatttcttcgttttgcagttgtggaaaacaatagttcagcggtaactgctcagagaatcattccactgaaagctttaaaacgaggatatcgacatcttcagctgcgaaaccttcacaatgaagtcttggagatttctagtttattcattaacagcagaaggatggaagaaaattcctctggcaataccatgtcagcctcttcgatgtttaatacagaagaaagaaaatgtttgcagactcacagagtcacggtgcatggggtcccagggccagagccctttaccgttttcactattaatggaggcaccaaggcaaagcagcttctgcagcaaattctgacaaatgaacaagacatcaaacctgttaccacagactattttttgatggaagaaaaatattttatatctaaagaaaagaatgaatgtaggaaacaaccattccagagagccattggtccagaagaggagatcatgcaaattttaagcagctggtttccagaagagggatacatgggcaggattgtcttaaaaacccagcaggaaaacctagaagagaaaaacattgttcaagatgacaaagaggtgatcttgagctcagaggaggagagtttctttgtccaagtgcatgatgtttctccagagcaacctcgaacagtcatcaaagcaccccgcgtcagcactgcacaggatgtcattcagcagaccttatgcaaagccaaatattcctacagcatcctgagcaaccccaatccaagcgactatgtgcttttggaagaggtggtgaaagacactaccaacaagaagactaccacaccaaagtcctctcagcgggtccttctggatcaggagtgtgtgtttcaagcccaaagcaagtggaaaggtgcaggaaaattcatccttaagctaaaggagcaggtgcaggcatctcgagaagataaaaagaaaggcatttctttcgcaagtgaactcaagaagctcaccaagtcaactaaacagccccgaggacttacatcaccttctcagctcttgacctcagaaagtatccaaaccaaggaggagaaacctgtgggtggcttgtcctccagtgacacaatggattaccgacagtgactaagggcagcatgtttaacccaggtatagtaagtcattgcaccatcctggaacagggcttaacttaaactactttgtaaggaaggcataattagtacaatgtcttttatcttttccaacaggaggatgtcccttgaaggcaggtaggaatgggaccttaaaacaggaaaagggctctgaagatatgtgtaacatgatatgctattgaacaccgcctataaagaaaaagggaaagaggctgggcgtggtggcgcatgcctgtaatcccagcactttgggaggccaaggcaggcagatcacctgaggtcagttcaagaccagcctgaccaacatggagaaaccccgtctctactaaaaatacaaaattagctgggcatggtggtgcatgcctataatcccagctactggggaggctgaggcaggagaatcacttgaacttggaaggcagaggttgcagtgagctgagatcacaccattgcactccagcctgggcaatgagagtgaaaactccgtctcaaaaaaaaaaaaa

SEQ ID NO: 15847 - DNA, 670 bp, Homo sapiens
  ENST00000464214
caggcatctcgagaagataaaaagaaaggcatttctttcgcaagtgaactcaagaagctcaccaagtcaactaaacagccccgaggacttacatcaccttctcagctcttgacctcagaaagtatccaaaccaaggaggagaaacctgtgggtggcttgtcctccagtgacacaatggattaccgacagtgactaagggcagcatgtttaacccaggaggatgtcccttgaaggcaggtaggaatgggaccttaaaacaggaaaagggctctgaagatatgtgtaacatgatatgctattgaacaccgcctataaagaaaaagggaaagaggctgggcgtggtggcgcatgcctgtaatcccagcactttgggaggccaaggcaggcagatcacctgaggtcagttcaagaccagcctgaccaacatggagaaaccccgtctctactaaaaatacaaaattagctgggcatggtggtgcatgcctataatcccagctactggggaggctgaggcaggagaatcacttgaacttggaaggcagaggttgcagtgagctgagatcacaccattgcactccagcctgggcaatgagagtgaaaactccgtctcaaaaaaaaaaaaagaaaaaaaaaaatatatatatgtaacttgagcttttgtaattttaga

SEQ ID NO: 15848 - DNA, 6500 bp, Homo sapiens
  ENST00000371385
accctgcacgttgcaggatttttcactgtgatttgagattgggcttcattcagtgggtcgtggtgattaatggtttcagaaggaagtgcagcaggaagagactttgcaggaatggaagaggtgaggcagctccacgtgagattctgcaaagggattaagatttggcaccaggcttggtttctgtgcagcctcttaggcagagagccccaggagagggaagcaggctgtcagctgtggctttgcacgctctcagctgtcttgaaggttggttggctcttcccgctctctgaggtacccaattttaccttgttaaaggatggatgtggatgctggaggcttaaagaagaccagatctacaatgcagtgagaagagaagaaacagaaaatacagttggatctctactccatttcctcaccaagctcccagcctccgagacagcccatggaaggataagcgttggtccatgcttaaagcaatgtgtccgagacactgtatgtgagtatcgcgccaccctccaaaggacttcaatatcgcagtacatcaccggttctctcctagaagcaaccacgtctttgggagcaagaagtggccttctcagtacttttggaggatccactggacgaatgatgctgaaagaacgccagccaggcccctctgtggccaattccaatgccctcccttcaagttcagctgggatcagcaaggagctgatcgatctgcagcctctcatccagttcccagaggaagtcgccagcatcctgatggagcaagagcagactatttaccgcagggtcttgccagtcgactacctttgcttcttaacacgggacttgggcactcctgaatgccagagctccttgccctgcctcaaagcatccatctcagcgtcgattcttaccactcagaatggagagcacaatgcccttgaagatctggtgatgaggtttaatgaggtgagctcctgggtgacatggctgatcctcacggcaggctccatggaggagaagcgagaagtcttttcatatttggtgcatgtggccaaatgctgctggaacatgggcaactacaacgctgtcatggagttcttggctggcctcaggtcaagaaaagttttaaaaatgtggcagttcatggaccagtctgatattgagaccatgaggagcctgaaggatgctatggcccagcatgagtcctcttgtgagtacagaaaggtggtgacacgtgccctgcacatccctggctgtaaggtggttccattctgtggggtgtttctgaaggagctctgtgaagtgcttgacggcgcctccggtctcatgaagctttgcccgcggtacaattcccaagaagaaactttagagtttgtagcagattacagtggacaagataatttcttacaacgagtgggacaaaatggcttaaagaattcggagaaggagtccactgtcaacagcatctttcaggtcatccggagctgcaatcgaagtctggagacagacgaggaggacagccccagtgaaggaaacagctccaggaaaagctccttgaaggataaaagccgatggcagtttataattggagatttgttggattcagacaatgacatctttgagcaatccaaagaatacgactctcatggttcagaggactcacagaaggccttcgaccatgggacggagctcatcccttggtacgtgctgtccatccaagccgatgtgcaccagttcctgctgcagggggccacggtcatccactacgaccaggacacacacctctctgcccgctgcttcctccagcttcagcccgacaatagcaccttgacctgggtaaagcccacaactgcctccccagccagcagtaaagcaaaacttggtgtacttaataacacagctgagcctggaaaattcccactactgggtaatgctggattaagtagcctgacggaaggggtcttggatctttttgcagtgaaggctgtatacatgggccaccctggcattgatatacacactgtgtgtgttcagaacaaactgggtagcatgttcctgtcagagactggtgtgacattgctctatgggcttcagaccacagacaacagattattgcacttcgtggcaccaaagcacacagctaaaatgctcttcagcggattattggaactcactagagctgtgagaaagatgaggaaattccctgaccaaagacagcagtggctgcggaaacagtacgtcagcctttatcaggaggatggacggtatgaaggcccaactttggctcacgctgtggagttgtttggtggcagacggtggagtgctcgaaaccccagccccggaacatcagcaaagaatgctgagaagcccaatatgcagagaaacaataccctgggcataagcactaccaagaaaaagaagaaaatcctcatgaggggtgagagtggagaggtaactgacgatgagatggcaacccgaaaggccaagatgcacaaagagtgtcgaagccggagtggttctgatcctcaagacattaatgaacaagaagaatcagaggtgaatgccatcgctaaccctccaaaccccctcccttccagaagagcccactctttgaccacagctgggtcccccaacttggctgccgggacgtcatctcccatcaggccagtgtcctcccctgtgctgtcttcttcaaacaagagcccatccagtgcttggagcagtagtagctggcacgggcggatcaaaggcggcatgaagggatttcagagcttcatggtttcagatagcaacatgagttttgttgaatttgttgagctgttcaaatcattcagtgtcaggagccgcaaggacctgaaggatctgtttgatgtctatgcagtgccctgcaaccgatctggctccgagtcagccccactctacaccaacctgacaattgatgaaaacaccagcgatcttcagcctgacctagatctgttgaccagaaatgtctcggatttggggttgttcattaagagtaaacagcagctatcggacaaccagaggcagatatctgatgccattgctgctgcaagcattgtgacaaatggcactgggattgagagcacatctctgggcatttttggggtgggcatacttcagctcaacgatttcctcgtgaattgccaaggagaacactgcacttatgatgaaatcctcagcatcatccagaagttcgagcctagcatcagtatgtgtcatcagggactaatgtcatttgaagggtttgccaggtttctgatggataaagaaaattttgcctcaaaaaatgatgagtcacaggagaacattaaagaactgcagctacccctctcatactattacatcgaatcttcgcacaatacctacctcacgggccatcagctcaaaggagaatcctcggtagaactctacagccaggtccttttgcaaggctgtcgaagtgtagaattggactgctgggacggagacgatgggatgcccatcatttatcatggacatacgctgacaaccaagatccccttcaaggaagtggttgaagccattgatcgcagtgccttcatcaactctgacctgccaatcatcatatcgattgagaaccactgttcattgcctcagcaacgaaaaatggcagaaattttcaagactgtgtttggagaaaagctggtgactaaattcttatttgagactgatttctcagatgatccaatgcttccttcacctgaccaactcagaaagaaagttcttcttaaaaacaagaagctaaaagcccatcagacgccagtggatatcttaaagcaaaaggctcatcagttagcatctatgcaagtgcaggcttataatggtgggaatgccaacccccgacctgccaataatgaggaagaggaagatgaggaggacgaatatgattatgactatgaatccctttctgatgacaacattctggaagacagacctgaaaataaatcatgtaatgacaagcttcagtttgaatataatgaagaaatcccaaagaggataaagaaagcagataactctgcttgcaacaaaggaaaggtttatgatatggaactgggagaagaattttatcttgatcagaataaaaaggaaagcagacagattgcaccagagctttctgaccttgtaatctattgtcaagcagtaaaatttccaggactgtcaactctaaatgcatctggctctagcagaggaaaagaaaggaaaagcaggaagtccatttttggcaacaatccgggcagaatgagcccaggggagacagcatcatttaacaaaacatctggaaaaagttcctgtgaaggcattcgacagacctgggaggaatcttcttcccctctcaacccaaccacgtccctcagtgctatcattagaactcccaaatgttatcatatctcgtcgctgaatgaaaatgccgccaaacgtctgtgtcgcaggtattctcagaaactgacccagcacaccgcctgtcagctgctgagaacttaccctgctgccacccgcatcgactcttccaacccgaaccccctcatgttctggctccatgggatacagcttgtggcactcaactaccagactgatgatctccctttacatttaaatgctgcaatgtttgaggcaaatggtggttgtggttatgtattgaaacctccagttctgtgggacaagaactgccccatgtatcagaagttttctccactagaaagagatctggacagcatggatcctgcagtctattctttaactattgtctctggtcagaatgtgtgccccagtaatagcatgggaagcccgtgcattgaagtcgacgtcctgggcatgcctctggacagctgccatttccgcacaaagcccatccatcgaaacaccctgaaccccatgtggaacgagcagtttctgttccacgttcacttcgaagatcttgtatttcttcgttttgcagttgtggaaaacaatagttcagcggtaactgctcagagaatcattccactgaaagctttaaaacgaggatatcgacatcttcagctgcgaaaccttcacaatgaagtcttggagatttctagtttattcattaacagcagaaggatggaagaaaattcctctggcaataccatgtcagcctcttcgatgtttaatacagaagaaagaaaatgtttgcagactcacagagtcacggtgcatggggtcccagggccagagccctttaccgttttcactattaatggaggcaccaaggcaaagcagcttctgcagcaaattctgacaaatgaacaagacatcaaacctgttaccacagactattttttgatggaagaaaaatattttatatctaaagaaaagaatgaatgtaggaaacaaccattccagagagccattggtccagaagaggagatcatgcaaattttaagcagctggtttccagaagagggatacatgggcaggattgtcttaaaaacccagcaggaaaacctagaagagaaaaacattgttcaagatgacaaagaggtgatcttgagctcagaggaggagagtttctttgtccaagtgcatgatgtttctccagagcaacctcgaacagtcatcaaagcaccccgcgtcagcactgcacaggatgtcattcagcagaccttatgcaaagccaaatattcctacagcatcctgagcaaccccaatccaagcgactatgtgcttttggaagaggtggtgaaagacactaccaacaagaagactaccacaccaaagtcctctcagcgggtccttctggatcaggagtgtgtgtttcaagcccaaagcaagtggaaaggtgcaggaaaattcatccttaagctaaaggagcaggtgcaggcatctcgagaagataaaaagaaaggcatttctttcgcaagtgaactcaagaagctcaccaagtcaactaaacagccccgaggacttacatcaccttctcagctcttgacctcagaaagtatccaaaccaaggaggagaaacctgtgggtggcttgtcctccagtgacacaatggattaccgacagtgactaagggcagcatgtttaacccaggtgaagatctttaagcaagaagttaaagagtgaacatggtggaaaaaatataattattttcatcagacttaaactggaaattgatgatttctgaactgaagccttcacacatgtgagatccatgctgaggagaagcaaaatggcacagggctagttgccaccaaccaatttactgatgaatgaagcccaggggactgccattttataaatgtcagcagttggaaaaatcgtcacgaattgacttagagcaagggtcagcaagcttgtctgtaaagggccaaacagtaaatattttagggctgggggccataaaatatgttgcaaccacccaattctgccattgtagtgcaaaagcagccatagacaacacatacatgaacgaacgtggctgtattccaataaaactttatttatggacactg

SEQ ID NO: 15849 - DNA, 3525 bp, Homo sapiens
  ENST00000494598
ataatgccttgagggctttaacgcgctgcacgaagcatgcatgtctcatacccaaagtagccacagcgcctgcattcccacaatagcggcagccccgagcagatgcttccagcgtgcttatctggctgtgcttttcactttgggacaaagttctataatcatatctcatggatttattttctccacactataaagcctgaattgtgaagatctcatcatgccataaagggcagcatgagccaagttctgggggctgctaaggatttctttgccttttttccccccaccctttttggaaatgtgtatcaggaaaaggctttgcctttagagagaaattgtactgctcttgccaataatgtgtaatagtattaaatttaatggcagaccttgaagtgtataaaaacttaagtccagaaaaagttgaaagatgcatgagtgtgatgcagtccgggacacagatgatcaagctgaaacgtggaaccaaagggcttgtccgcctcttttacctggatgagcaccggacacgcctccgatggcgaccctctaggaagagtgagaaggcaaaaatacttattgattccatttacaaagtgactgagggccggcagtctgaaatattccacagacaagctgaggggaacttcgaccccagctgctgcttcaccatctaccatggcaaccacatggagtccctggacctcatcacctccaaccccgaggaggcccgcacctggatcacaggcctcaagtacctgatggctggcatcagtgatgaagactcccttgccaaaaggcagaggacccatgaccaatgggtgaagcagacctttgaggaagctgataagaatggtgacggcttgctgaatattgaagagatacatcagctgatgcataaactgaatgttaatctgccccgaagaaaagtcagacaaatgtttcaggaagccgacacagatgagaatcagggaactttgacatttgaagagttctgtgttttttacaaaatgatgtctttgagacgagacctttatttgttacttttgagctacagtgacaagaaagatcacctaactgtggaagaactggctcagtttttgaaggtggagcaaaagatgaataatgtgacaacggactattgtcttgacatcataaagaagtttgaagtttcagaagaaaataaggtgaaaaatgttcttggcatagaaggcttcacgaacttcatgcgtagtcctgcctgtgacatatttaacccattgcaccatgaagtgtaccaagacatggatcagcccctctgcaactactacattgcttcctctcacaatacatacctgactggagaccagctcctttctcagtccaaagtggatatgtatgcacgggtgctgcaagagggctgtcgctgtgtggaagttgactgttgggatggcccagatggagagccagtagtacatcatggttacactctcacttcaaaaattctcttcagagatgttgtggagaccatcaacaagcatgcctttgtgaagaatgagtttcctgttatattgtctatcgagaatcactgcagtatccagcagcaaaggaagattgctcagtacctgaaaggaatattcggagacaaactggacctgtcatctgttgatacaggggagtgcaagcagcttccaagccctcaaagtttgaaaggcaaaattctagtgaagggtaagaagttgccttatcaccttggggatgatgcagaggaaggggaagtttctgatgaggacagtgcagatgaaattgaagacgagtgcaaattcaagctccattatagtaatgggaccactgagcatcaggtggaatctttcataaggaaaaaactggagtcactgttaaaagaatctcaaattcgagataaagaagatcctgatagtttcacagtgcgggcactactgaaggccacgcatgaaggcttaaatgcacacctgaagcagagtccagatgtaaaggaaagtggaaagaaatcacatggacgatccctcatgaccaactttggaaaacataagaaaactacaaaatcacggtctaaatcttacagtactgatgatgaggaagacacacagcagagtactggcaaggagggtggccagctgtacagattgggtcgccgaaggaaaaccatgaagctctgccgagaactctctgatttggttgtgtacacaaactccgtggccgctcaggacattgtggatgacggaaccacaggaaatgtgttatcattcagtgaaacaagagcacatcaggttgttcagcaaaaatcagagcagttcatgatttataatcaaaagcaactcacgaggatttacccctctgcctaccgcattgattccagtaacttcaaccctctcccctactggaacgcaggctgccagctagtggcactgaattatcaatctgaaggacgaatgatgcagttaaaccgagccaaattcaaggcaaatggcaattgtggctatgtcctcaaaccccagcaaatgtgcaaaggtactttcaaccctttctctggtgaccctcttcctgccaaccccaaaaagcagctcatcctgaaagttatcagtggacagcaactccccaaacctccagactccatgtttggagatcgaggcgagatcattgacccttttgttgaagttgaaattattggattgccagtagattgttgtaaagatcaaacccgtgtggtagatgacaatggatttaaccctgtgtgggaagaaacactgacatttacagtacacatgccagaaatagctttggttcggttccttgtgtgggatcacgatcccattggacgagactttgttggacaaagaactgtgaccttcagcagcttagtgcctggctaccggcatgtctatttggaaggactgacagaagcatccatatttgtacacataaccatcaatgaaatctatggaaagaacagacaactccagggtctgaagggactgttcaataagaatcctaggcacagttcttcagaaaacaattcccattatgtacggaagcgatccattggagatagaattctgcgacgcacagctagcgccccagccaaaggcaggaaaaagagcaaaatgggcttccaagaaatggtggagataaaggattctgtgtccgaggccacaagagatcaagatggcgtgctgaggaggaccacacgcagtttgcaagcacgccctgtctctatgcctgttgacagaaaccttctgggagctttgtcgctgcctgtatctgaaacagcaaaagacattgaaggaaaagaaaactctctagactctagcttttgcaggccgactgagcaggctaaagcagaaatgtgcaaagtgcctttccccagacagttagaatgtgtaatgaagatggaaatttccgagacctgaatccccaaacccagactgatctctcttctcttcttgaatataaaagtaagctggcaagatttaaaaaactgaacccaaataaatattcatcatttttttcttc

SEQ ID NO: 15850 - DNA, 6413 bp, Homo sapiens
  ENST00000460012
gagaaagcaggttgtggcggcggcgccctgctcttccccgctcgtctggggcttctgctggctagtggggagaagtgctcttctaggggggcttttctggcccttggcaggggtttggagttggagtcacaggggccaataactcatcaccccagcacttcggaggtggctccttgtgccacggactccgaggagtccttcagctactgaacactcaaagctgaggagggcaatttggttttgatgctgtgccagaaatcttctgacaatgagttactggaacttggaaaaaaggaactgtgtgcagtaccgcaggcattttctggtggacaacagtgtgtttcatgttgaaagatgcatgagtgtgatgcagtccgggacacagatgatcaagctgaaacgtggaaccaaagggcttgtccgcctcttttacctggatgagcaccggacacgcctccgatggcgaccctctaggaagagtgagaaggcaaaaatacttattgattccatttacaaagtgactgagggccggcagtctgaaatattccacagacaagctgaggggaacttcgaccccagctgctgcttcaccatctaccatggcaaccacatggagtccctggacctcatcacctccaaccccgaggaggcccgcacctggatcacaggcctcaagtacctgatggctggcatcagtgatgaagactcccttgccaaaaggcagaggacccatgaccaatgggtgaagcagacctttgaggaagctgataagaatggtgacggcttgctgaatattgaagagatacatcagctgatgcataaactgaatgttaatctgccccgaagaaaagtcagacaaatgtttcaggaagccgacacagatgagaatcagggaactttgacatttgaagagttctgtgttttttacaaaatgatgtctttgagacgagacctttatttgttacttttgagctacagtgacaagaaagatcacctaactgtggaagaactggctcagtttttgaaggtggagcaaaagatgaataatgtgacaacggactattgtcttgacatcataaagaagtttgaagtttcagaagaaaataaggtgaaaaatgttcttggcatagaaggcttcacgaacttcatgcgtagtcctgcctgtgacatatttaacccattgcaccatgaagtgtaccaagacatggatcagcccctctgcaactactacattgcttcctctcacaatacatacctgactggagaccagctcctttctcagtccaaagtggatatgtatgcacgggtgctgcaagagggctgtcgctgtgtggaagttgactgttgggatggcccagatggagagccagtagtacatcatggttacactctcacttcaaaaattctcttcagagatgttgtggagaccatcaacaagcatgcctttgtgaagaatgagtttcctgttatattgtctatcgagaatcactgcagtatccagcagcaaaggaagattgctcagtacctgaaaggaatattcggagacaaactggacctgtcatctgttgatacaggggagtgcaagcagcttccaagccctcaaagtttgaaaggcaaaattctagtgaagggtaagaagttgccttatcaccttggggatgatgcagaggaaggggaagtttctgatgaggacagtgcagatgaaattgaagacgagtgcaaattcaagctccattatagtaatgggaccactgagcatcaggtggaatctttcataaggaaaaaactggagtcactgttaaaagaatctcaaattcgagataaagaagatcctgatagtttcacagtgcgggcactactgaaggccacgcatgaaggcttaaatgcacacctgaagcagagtccagatgtaaaggaaagtggaaagaaatcacatggacgatccctcatgaccaactttggaaaacataagaaaactacaaaatcacggtctaaatcttacagtactgatgatgaggaagacacacagcagagtactggcaaggagggtggccagctgtacagattgggtcgccgaaggaaaaccatgaagctctgccgagaactctctgatttggttgtgtacacaaactccgtggccgctcaggacattgtggatgacggaaccacaggaaatgtgttatcattcagtgaaacaagagcacatcaggttgttcagcaaaaatcagagcagttcatgatttataatcaaaagcaactcacgaggatttacccctctgcctaccgcattgattccagtaacttcaaccctctcccctactggaacgcaggctgccagctagtggcactgaattatcaatctgaaggacgaatgatgcagttaaaccgagccaaattcaaggcaaatggcaattgtggctatgtcctcaaaccccagcaaatgtgcaaaggtactttcaaccctttctctggtgaccctcttcctgccaaccccaaaaagcagctcatcctgaaagttatcagtggacagcaactccccaaacctccagactccatgtttggagatcgaggcgagatcattgacccttttgttgaagttgaaattattggattgccagtagattgttgtaaagatcaaacccgtgtggtagatgacaatggatttaaccctgtgtgggaagaaacactgacatttacagtacacatgccagaaatagctttggttcggttccttgtgtgggatcacgatcccattggacgagactttgttggacaaagaactgtgaccttcagcagcttagtgcctggctaccggcatgtctatttggaaggactgacagaagcatccatatttgtacacataaccatcaatgaaatctatggaaagaacagacaactccagggtctgaagggactgttcaataagaatcctaggcacagttcttcagaaaacaattcccattatgtacggaagcgatccattggagatagaattctgcgacgcacagctagcgccccagccaaaggcaggaaaaagagcaaaatgggcttccaagaaatggtggagataaaggattctgtgtccgaggccacaagagatcaagatggcgtgctgaggaggaccacacgcagtttgcaagcacgccctgtctctatgcctgttgacagaaaccttctgggagctttgtcgctgcctgtatctgaaacagcaaaagacattgaaggaaaagaaaactctctagcagaagataaagatggcagaagaaaagggaaagcaagtataaaagatccacattttctaaatttcaacaaaaagttatcatcctcctccagtgctctgctccacaaagataccagccaaggggacaccattgtatctactgcccacatgtcagtcacaggagaacagctgggcatgtcaagtcctaggggtgggagaaccacatcaaatgccacaagcaattgccaggaaaacccctgtcccagcaagtctctctccccaaagcagcatttggctcccgatcctgtagttaaccccacacaagatctgcatggtgtgaaaatcaaggaaaagggtaatcctgaggactttgtggaagggaaaagcatcttgtcaggaagcgtcctttctcatagcaacctagaaattaagaacctggaaggtaataggggtaagggccgagctgcaacatccttttctttgtcagacgtctccatgctctgttctgacatacctgacctacattcaactgcaattctgcaggagagtgtaatttcccatcttattgacaatgtcactttaacaaatgagaatgagccgggcagttccatctcagccctgattggccagtttgatgagaccaacaatcaggctctcacagttgtttctcatcttcataataccagtgtgatgtcaggccattgtcccttgcctagcctgggcctaaaaatgcccatcaagcatggtttttgcaagggaaaatccaagtcttccttcctgtgctcatctccggagctgatagcactctcgagttctgagaccaccaaacatgcaacgaacacagtttatgaaactacctgcactcccatctctaaaaccaaaccagatgatgacctttctagtaaggccaagacagcggccttagaaagcaacctgcctggatcccctaatacttctcgtggctggttaccaaaaagtcctaccaagggagaagactgggaaacactgaagagctgcagccctgcctcttcccctgatttgaccctggaggatgtaatagctgatcccactctctgtttcaattctggggagagcagccttgtggaaattgatggagaatcagaaaatctttctctaacaacctgtgaatataggagagagggcacaagtcaacttgcttctcctttaaaactcaagtacaatcagggtgtggtagaacactttcaaagaggtttgagaaacggctactgtaaagagaccctccgcccttctgtccctgaaatattcaacaatattcaagatgtcaaaactcaaagtatttcttatctagcctatcagggtgctggctttgtgcataatcatttctcagattcagatgcaaaaatgttccagacctgtgtgccccagcaatctagtgctcaagatatgcatgtccctgtacccaagcagttggcacatcttcctttgcctgctctgaaactgcctagtccttgcaaatccaaaagtctgggggacttaacatcagaggacattgcctgcaattttgagagcaagtaccagtgtattagtaagagttttgttacaactggcattagagacaagaagggcgtgactgtgaagacaaagtcgttagagcctatagatgccctgaccgagcagcttcggaagcttgtgtcctttgaccaggaagacaactgccaagtgctatattcaaagcaggatgccaatcagctcccccgggcactggtcaggaagttgtcatccagaagtcagagcagagtgcgcaatattgctagtcgtgccaaggagaaacaggaagccaacaagcagaaagttccaaaccccagcaatggggcaggagtggttcttagaaacaaaccctcagcacccacccctgcagtgaatcgccactccaccggctcctacatcgcaggctacctgaagaacacgaaagggggtggccttgaaggccggggcatcccagagggggcatgcacggctcttcactatggccacgttgaccagttttgttcagataattctgttttgcagactgagccaagcagtgatgataaaccagaaatttattttcttttgagactgtgaattatttaaaactgcattcttaaggttttcaaggtattctgtagaatgtcagagttttcagtaaataagttccttggctttggaatgattttcaaatgtatttttaaacttgtatttgggtctccctttgacttcatgtgttctccctgttaatgcgtttgtatatagatttggtgacatttcccatgtacctattatgatctttctcccttgagttgttgtaaactgtatcagtatgaaatatgtgcatgccctagatgtgaaactcctcagcagctcgggttataatgtgtgtgtgtttcaccaagatgtcctttactgtgtcctcagattgcagtcacaaatgtagtcatttttactctctaactgttgagttgattaagagactttgcaaacgacaaagggatgaattccttactttaatctgttatcatttttcctatgtttccctctttgttcagaagcccagatgcatttttataactcagttttaaaaactttaaaatagttaccttgccttttaggatgttcttatcccacccataatgagagttgaaaggggatggatagctgctccccatgcccttcccactttttggaataggccgtgagggtgtgaggaagaaggctgtcttttgtacataaggacaaaattgtttgttttacataaattttgttacatatttttgctaatggctttgtatgtaacaagaagcgagttgccaaactacctgttgtacttttgaattttctgattgaattacagactgcgaacaacggctttcagaatgagggacttccatcagactctaatgataatagtagcacaaattgaaaacttccccaaagctttcacagaatattttctcataataaaatccaagtgaacagataattagaagaaacccttttccttcagggaaccaagcaactctattttagtactgacatgcattattttcactgtgaattcacttttttattgcatgttcagatgtccctctttgttttttttttttgtaacattaactgcaatgatgttcttcctggaattcatgaaaatataattaaaacacatttttaaaca

SEQ ID NO: 15851 - DNA, 6196 bp, Homo sapiens
  ENST00000447496
atggcagaccttgaagtgtataaaaacttaagtccagaaaaagttgaaagatgcatgagtgtgatgcagtccgggacacagatgatcaagctgaaacgtggaaccaaagggcttgtccgcctcttttacctggatgagcaccggacacgcctccgatggcgaccctctaggaagagtgagaaggcaaaaatacttattgattccatttacaaagtgactgagggccggcagtctgaaatattccacagacaagctgaggggaacttcgaccccagctgctgcttcaccatctaccatggcaaccacatggagtccctggacctcatcacctccaaccccgaggaggcccgcacctggatcacaggcctcaagtacctgatggctggcatcagtgatgaagactcccttgccaaaaggcagaggacccatgaccaatgggtgaagcagacctttgaggaagctgataagaatggtgacggcttgctgaatattgaagagatacatcagctgatgcataaactgaatgttaatctgccccgaagaaaagtcagacaaatgtttcaggaagccgacacagatgagaatcagggaactttgacatttgaagagttctgtgttttttacaaaatgatgtctttgagacgagacctttatttgttacttttgagctacagtgacaagaaagatcacctaactgtggaagaactggctcagtttttgaaggtggagcaaaagatgaataatgtgacaacggactattgtcttgacatcataaagaagtttgaagtttcagaagaaaataaggtgaaaaatgttcttggcatagaaggcttcacgaacttcatgcgtagtcctgcctgtgacatatttaacccattgcaccatgaagtgtaccaagacatggatcagcccctctgcaactactacattgcttcctctcacaatacatacctgactggagaccagctcctttctcagtccaaagtggatatgtatgcacgggtgctgcaagagggctgtcgctgtgtggaagttgactgttgggatggcccagatggagagccagtagtacatcatggttacactctcacttcaaaaattctcttcagagatgttgtggagaccatcaacaagcatgcctttgtgaagaatgagtttcctgttatattgtctatcgagaatcactgcagtatccagcagcaaaggaagattgctcagtacctgaaaggaatattcggagacaaactggacctgtcatctgttgatacaggggagtgcaagcagcttccaagccctcaaagtttgaaaggcaaaattctagtgaagggtaagaagttgccttatcaccttggggatgatgcagaggaaggggaagtttctgatgaggacagtgcagatgaaattgaagacgagtgcaaattcaagctccattatagtaatgggaccactgagcatcaggtggaatctttcataaggaaaaaactggagtcactgttaaaagaatctcaaattcgagataaagaagatcctgatagtttcacagtgcgggcactactgaaggccacgcatgaaggcttaaatgcacacctgaagcagagtccagatgtaaaggaaagtggaaagaaatcacatggacgatccctcatgaccaactttggaaaacataagaaaactacaaaatcacggtctaaatcttacagtactgatgatgaggaagacacacagcagagtactggcaaggagggtggccagctgtacagattgggtcgccgaaggaaaaccatgaagctctgccgagaactctctgatttggttgtgtacacaaactccgtggccgctcaggacattgtggatgacggaaccacaggaaatgtgttatcattcagtgaaacaagagcacatcaggttgttcagcaaaaatcagagcagttcatgatttataatcaaaagcaactcacgaggatttacccctctgcctaccgcattgattccagtaacttcaaccctctcccctactggaacgcaggctgccagctagtggcactgaattatcaatctgaaggacgaatgatgcagttaaaccgagccaaattcaaggcaaatggcaattgtggctatgtcctcaaaccccagcaaatgtgcaaaggtactttcaaccctttctctggtgaccctcttcctgccaaccccaaaaagcagctcatcctgaaagttatcagtggacagcaactccccaaacctccagactccatgtttggagatcgaggcgagatcattgacccttttgttgaagttgaaattattggattgccagtagattgttgtaaagatcaaacccgtgtggtagatgacaatggatttaaccctgtgtgggaagaaacactgacatttacagtacacatgccagaaatagctttggttcggttccttgtgtgggatcacgatcccattggacgagactttgttggacaaagaactgtgaccttcagcagcttagtgcctggctaccggcatgtctatttggaaggactgacagaagcatccatatttgtacacataaccatcaatgaaatctatggaaagtggagccctttaatactcaaccccagttatactatattgcactttctaggagctacaaagaacagacaactccagggtctgaagggactgttcaataagaatcctaggcacagttcttcagaaaacaattcccattatgtacggaagcgatccattggagatagaattctgcgacgcacagctagcgccccagccaaaggcaggaaaaagagcaaaatgggcttccaagaaatggtggagataaaggattctgtgtccgaggccacaagagatcaagatggcgtgctgaggaggaccacacgcagtttgcaagcacgccctgtctctatgcctgttgacagaaaccttctgggagctttgtcgctgcctgtatctgaaacagcaaaagacattgaaggaaaagaaaactctctagtacaaatctgaataggaaacaacttaagcagaagataaagatggcagaagaaaagggaaagcaagtataaaagatccacattttctaaatttcaacaaaaagttatcatcctcctccagtgctctgctccacaaagataccagccaaggggacaccattgtatctactgcccacatgtcagtcacaggagaacagctgggcatgtcaagtcctaggggtgggagaaccacatcaaatgccacaagcaattgccaggaaaacccctgtcccagcaagtctctctccccaaagcagcatttggctcccgatcctgtagttaaccccacacaagatctgcatggtgtgaaaatcaaggaaaagggtaatcctgaggactttgtggaagggaaaagcatcttgtcaggaagcgtcctttctcatagcaacctagaaattaagaacctggaaggtaataggggtaagggccgagctgcaacatccttttctttgtcagacgtctccatgctctgttctgacatacctgacctacattcaactgcaattctgcaggagagtgtaatttcccatcttattgacaatgtcactttaacaaatgagaatgagccgggcagttccatctcagccctgattggccagtttgatgagaccaacaatcaggctctcacagttgtttctcatcttcataataccagtgtgatgtcaggccattgtcccttgcctagcctgggcctaaaaatgcccatcaagcatggtttttgcaagggaaaatccaagtcttccttcctgtgctcatctccggagctgatagcactctcgagttctgagaccaccaaacatgcaacgaacacagtttatgaaactacctgcactcccatctctaaaaccaaaccagatgatgacctttctagtaaggccaagacagcggccttagaaagcaacctgcctggatcccctaatacttctcgtggctggttaccaaaaagtcctaccaagggagaagactgggaaacactgaagagctgcagccctgcctcttcccctgatttgaccctggaggatgtaatagctgatcccactctctgtttcaattctggggagagcagccttgtggaaattgatggagaatcagaaaatctttctctaacaacctgtgaatataggagagagggcacaagtcaacttgcttctcctttaaaactcaagtacaatcagggtgtggtagaacactttcaaagaggtttgagaaacggctactgtaaagagaccctccgcccttctgtccctgaaatattcaacaatattcaagatgtcaaaactcaaagtatttcttatctagcctatcagggtgctggctttgtgcataatcatttctcagattcagatgcaaaaatgttccagacctgtgtgccccagcaatctagtgctcaagatatgcatgtccctgtacccaagcagttggcacatcttcctttgcctgctctgaaactgcctagtccttgcaaatccaaaagtctgggggacttaacatcagaggacattgcctgcaattttgagagcaagtaccagtgtattagtaagagttttgttacaactggcattagagacaagaagggcgtgactgtgaagacaaagtcgttagagcctatagatgccctgaccgagcagcttcggaagcttgtgtcctttgaccaggaagacaactgccaagtgctatattcaaagcaggatgccaatcagctcccccgggcactggtcaggaagttgtcatccagaagtcagagcagagtgcgcaatattgctagtcgtgccaaggagaaacaggaagccaacaagcagaaagttccaaaccccagcaatggggcaggagtggttcttagaaacaaaccctcagcacccacccctgcagtgaatcgccactccaccggctcctacatcgcaggctacctgaagaacacgaaagggggtggccttgaaggccggggcatcccagagggggcatgcacggctcttcactatggccacgttgaccagttttgttcagataattctgttttgcagactgagccaagcagtgatgataaaccagaaatttattttcttttgagactgtgaattatttaaaactgcattcttaaggttttcaaggtattctgtagaatgtcagagttttcagtaaataagttccttggctttggaatgattttcaaatgtatttttaaacttgtatttgggtctccctttgacttcatgtgttctccctgttaatgcgtttgtatatagatttggtgacatttcccatgtacctattatgatctttctcccttgagttgttgtaaactgtatcagtatgaaatatgtgcatgccctagatgtgaaactcctcagcagctcgggttataatgtgtgtgtgtttcaccaagatgtcctttactgtgtcctcagattgcagtcacaaatgtagtcatttttactctctaactgttgagttgattaagagactttgcaaacgacaaagggatgaattccttactttaatctgttatcatttttcctatgtttccctctttgttcagaagcccagatgcatttttataactcagttttaaaaactttaaaatagttaccttgccttttaggatgttcttatcccacccataatgagagttgaaaggggatggatagctgctccccatgcccttcccactttttggaataggccgtgagggtgtgaggaagaaggctgtcttttgtacataaggacaaaattgtttgttttacataaattttgttacatatttttgctaatggctttgtatgtaacaagaagcgagttgccaaactacctgttgtacttttgaattttctgattgaattacagactgcgaacaacggctttcagaatgagggacttccatcagactctaatgataatagtagcacaaattgaaaacttccccaaagctttcacagaatattttctcataataaaatccaagtgaacagataattagaagaaacccttttccttcagggaaccaagcaactctattttagtactgacatgcattattttcactgtgaattcacttttttattgcatgttcagatgtccctctttgttttttttttttgtaacattaactgcaatgatgttcttcctggaattcatgaaaatataattaaaacacatttttaaac

SEQ ID NO: 15852 - DNA, 6168 bp, Homo sapiens
  ENST00000340059
atggcagaccttgaagtgtataaaaacttaagtccagaaaaagttgaaagatgcatgagtgtgatgcagtccgggacacagatgatcaagctgaaacgtggaaccaaagggcttgtccgcctcttttacctggatgagcaccggacacgcctccgatggcgaccctctaggaagagtgagaaggcaaaaatacttattgattccatttacaaagtgactgagggccggcagtctgaaatattccacagacaagctgaggggaacttcgaccccagctgctgcttcaccatctaccatggcaaccacatggagtccctggacctcatcacctccaaccccgaggaggcccgcacctggatcacaggcctcaagtacctgatggctggcatcagtgatgaagactcccttgccaaaaggcagaggacccatgaccaatgggtgaagcagacctttgaggaagctgataagaatggtgacggcttgctgaatattgaagagatacatcagctgatgcataaactgaatgttaatctgccccgaagaaaagtcagacaaatgtttcaggaagccgacacagatgagaatcagggaactttgacatttgaagagttctgtgttttttacaaaatgatgtctttgagacgagacctttatttgttacttttgagctacagtgacaagaaagatcacctaactgtggaagaactggctcagtttttgaaggtggagcaaaagatgaataatgtgacaacggactattgtcttgacatcataaagaagtttgaagtttcagaagaaaataaggtgaaaaatgttcttggcatagaaggcttcacgaacttcatgcgtagtcctgcctgtgacatatttaacccattgcaccatgaagtgtaccaagacatggatcagcccctctgcaactactacattgcttcctctcacaatacatacctgactggagaccagctcctttctcagtccaaagtggatatgtatgcacgggtgctgcaagagggctgtcgctgtgtggaagttgactgttgggatggcccagatggagagccagtagtacatcatggttacactctcacttcaaaaattctcttcagagatgttgtggagaccatcaacaagcatgcctttgtgaagaatgagtttcctgttatattgtctatcgagaatcactgcagtatccagcagcaaaggaagattgctcagtacctgaaaggaatattcggagacaaactggacctgtcatctgttgatacaggggagtgcaagcagcttccaagccctcaaagtttgaaaggcaaaattctagtgaagggtaagaagttgccttatcaccttggggatgatgcagaggaaggggaagtttctgatgaggacagtgcagatgaaattgaagacgagtgcaaattcaagctccattatagtaatgggaccactgagcatcaggtggaatctttcataaggaaaaaactggagtcactgttaaaagaatctcaaattcgagataaagaagatcctgatagtttcacagtgcgggcactactgaaggccacgcatgaaggcttaaatgcacacctgaagcagagtccagatgtaaaggaaagtggaaagaaatcacatggacgatccctcatgaccaactttggaaaacataagaaaactacaaaatcacggtctaaatcttacagtactgatgatgaggaagacacacagcagagtactggcaaggagggtggccagctgtacagattgggtcgccgaaggaaaaccatgaagctctgccgagaactctctgatttggttgtgtacacaaactccgtggccgctcaggacattgtggatgacggaaccacaggaaatgtgttatcattcagtgaaacaagagcacatcaggttgttcagcaaaaatcagagcagttcatgatttataatcaaaagcaactcacgaggatttacccctctgcctaccgcattgattccagtaacttcaaccctctcccctactggaacgcaggctgccagctagtggcactgaattatcaatctgaaggacgaatgatgcagttaaaccgagccaaattcaaggcaaatggcaattgtggctatgtcctcaaaccccagcaaatgtgcaaaggtactttcaaccctttctctggtgaccctcttcctgccaaccccaaaaagcagctcatcctgaaagttatcagtggacagcaactccccaaacctccagactccatgtttggagatcgaggcgagatcattgacccttttgttgaagttgaaattattggattgccagtagattgttgtaaagatcaaacccgtgtggtagatgacaatggatttaaccctgtgtgggaagaaacactgacatttacagtacacatgccagaaatagctttggttcggttccttgtgtgggatcacgatcccattggacgagactttgttggacaaagaactgtgaccttcagcagcttagtgcctggctaccggcatgtctatttggaaggactgacagaagcatccatatttgtacacataaccatcaatgaaatctatggaaagtggagccctttaatactcaaccccagttatactatattgcactttctaggagctacaaagaacagacaactccagggtctgaagggactgttcaataagaatcctaggcacagttcttcagaaaacaattcccattatgtacggaagcgatccattggagatagaattctgcgacgcacagctagcgccccagccaaaggcaggaaaaagagcaaaatgggcttccaagaaatggtggagataaaggattctgtgtccgaggccacaagagatcaagatggcgtgctgaggaggaccacacgcagtttgcaagcacgccctgtctctatgcctgttgacagaaaccttctgggagctttgtcgctgcctgtatctgaaacagcaaaagacattgaaggaaaagaaaactctctagcagaagataaagatggcagaagaaaagggaaagcaagtataaaagatccacattttctaaatttcaacaaaaagttatcatcctcctccagtgctctgctccacaaagataccagccaaggggacaccattgtatctactgcccacatgtcagtcacaggagaacagctgggcatgtcaagtcctaggggtgggagaaccacatcaaatgccacaagcaattgccaggaaaacccctgtcccagcaagtctctctccccaaagcagcatttggctcccgatcctgtagttaaccccacacaagatctgcatggtgtgaaaatcaaggaaaagggtaatcctgaggactttgtggaagggaaaagcatcttgtcaggaagcgtcctttctcatagcaacctagaaattaagaacctggaaggtaataggggtaagggccgagctgcaacatccttttctttgtcagacgtctccatgctctgttctgacatacctgacctacattcaactgcaattctgcaggagagtgtaatttcccatcttattgacaatgtcactttaacaaatgagaatgagccgggcagttccatctcagccctgattggccagtttgatgagaccaacaatcaggctctcacagttgtttctcatcttcataataccagtgtgatgtcaggccattgtcccttgcctagcctgggcctaaaaatgcccatcaagcatggtttttgcaagggaaaatccaagtcttccttcctgtgctcatctccggagctgatagcactctcgagttctgagaccaccaaacatgcaacgaacacagtttatgaaactacctgcactcccatctctaaaaccaaaccagatgatgacctttctagtaaggccaagacagcggccttagaaagcaacctgcctggatcccctaatacttctcgtggctggttaccaaaaagtcctaccaagggagaagactgggaaacactgaagagctgcagccctgcctcttcccctgatttgaccctggaggatgtaatagctgatcccactctctgtttcaattctggggagagcagccttgtggaaattgatggagaatcagaaaatctttctctaacaacctgtgaatataggagagagggcacaagtcaacttgcttctcctttaaaactcaagtacaatcagggtgtggtagaacactttcaaagaggtttgagaaacggctactgtaaagagaccctccgcccttctgtccctgaaatattcaacaatattcaagatgtcaaaactcaaagtatttcttatctagcctatcagggtgctggctttgtgcataatcatttctcagattcagatgcaaaaatgttccagacctgtgtgccccagcaatctagtgctcaagatatgcatgtccctgtacccaagcagttggcacatcttcctttgcctgctctgaaactgcctagtccttgcaaatccaaaagtctgggggacttaacatcagaggacattgcctgcaattttgagagcaagtaccagtgtattagtaagagttttgttacaactggcattagagacaagaagggcgtgactgtgaagacaaagtcgttagagcctatagatgccctgaccgagcagcttcggaagcttgtgtcctttgaccaggaagacaactgccaagtgctatattcaaagcaggatgccaatcagctcccccgggcactggtcaggaagttgtcatccagaagtcagagcagagtgcgcaatattgctagtcgtgccaaggagaaacaggaagccaacaagcagaaagttccaaaccccagcaatggggcaggagtggttcttagaaacaaaccctcagcacccacccctgcagtgaatcgccactccaccggctcctacatcgcaggctacctgaagaacacgaaagggggtggccttgaaggccggggcatcccagagggggcatgcacggctcttcactatggccacgttgaccagttttgttcagataattctgttttgcagactgagccaagcagtgatgataaaccagaaatttattttcttttgagactgtgaattatttaaaactgcattcttaaggttttcaaggtattctgtagaatgtcagagttttcagtaaataagttccttggctttggaatgattttcaaatgtatttttaaacttgtatttgggtctccctttgacttcatgtgttctccctgttaatgcgtttgtatatagatttggtgacatttcccatgtacctattatgatctttctcccttgagttgttgtaaactgtatcagtatgaaatatgtgcatgccctagatgtgaaactcctcagcagctcgggttataatgtgtgtgtgtttcaccaagatgtcctttactgtgtcctcagattgcagtcacaaatgtagtcatttttactctctaactgttgagttgattaagagactttgcaaacgacaaagggatgaattccttactttaatctgttatcatttttcctatgtttccctctttgttcagaagcccagatgcatttttataactcagttttaaaaactttaaaatagttaccttgccttttaggatgttcttatcccacccataatgagagttgaaaggggatggatagctgctccccatgcccttcccactttttggaataggccgtgagggtgtgaggaagaaggctgtcttttgtacataaggacaaaattgtttgttttacataaattttgttacatatttttgctaatggctttgtatgtaacaagaagcgagttgccaaactacctgttgtacttttgaattttctgattgaattacagactgcgaacaacggctttcagaatgagggacttccatcagactctaatgataatagtagcacaaattgaaaacttccccaaagctttcacagaatattttctcataataaaatccaagtgaacagataattagaagaaacccttttccttcagggaaccaagcaactctattttagtactgacatgcattattttcactgtgaattcacttttttattgcatgttcagatgtccctctttgttttttttttttgtaacattaactgcaatgatgttcttcctggaattcatgaaaatataattaaaacacatttttaaac

SEQ ID NO: 15853 - DNA, 748 bp, Homo sapiens
  ENST00000469040
aactttggaaaacataagaaaactacaaaatcacggtctaaatcttacagtactgatgatgaggaagacacacagcagagtactggcaaggagggtggccagctgtacagattgggtcgccgaaggaaaaccatgaagctctgccgagaactctctgatttggttgtgtacacaaactccgtggccgctcaggacattgtggatgacggaaccacaggaaatgtgttatcattcagtgaaacaagagcacatcaggttgttcagcaaaaatcagagcagttcatgatttataatcaaaagcaactcacgaggatttacccctctgcctaccgcattgattccagtaacttcaaccctctcccctactggaacgcaggctgccagctagtggcactgaattatcaatctgaaggacgaatgatgcagttaaaccgagccaaattcaaggcaaatggcaattgtggctatgtcctcaaaccccagcaaatgtgcaaaggtactttcaaccctttctctggtgaccctcttcctgccaaccccaaaaagcagctcatcctgaaagttatcagtggacagcaactccccaaacctccagactccatgtttggagatcgaggcgagatcattgacccttttgttgaagttgaaattattggattgccagtagattgttgtaaagatcaaacccgtgtggtagatgacaatggtaagatggtaatctgtgttcactttttaatgaagatggtct

SEQ ID NO: 15854 - DNA, 6128 bp, Homo sapiens
  ENST00000334686
tggaaaaaaggaactgtgtgcagtaccgcaggcattttctggtggacaacagtgtgtttcatgttgaaagatgcatgagtgtgatgcagtccgggacacagatgatcaagctgaaacgtggaaccaaagggcttgtccgcctcttttacctggatgagcaccggacacgcctccgatggcgaccctctaggaagagtgagaaggcaaaaatacttattgattccatttacaaagtgactgagggccggcagtctgaaatattccacagacaagctgaggggaacttcgaccccagctgctgcttcaccatctaccatggcaaccacatggagtccctggacctcatcacctccaaccccgaggaggcccgcacctggatcacaggcctcaagtacctgatggctggcatcagtgatgaagactcccttgccaaaaggcagaggacccatgaccaatgggtgaagcagacctttgaggaagctgataagaatggtgacggcttgctgaatattgaagagatacatcagctgatgcataaactgaatgttaatctgccccgaagaaaagtcagacaaatgtttcaggaagccgacacagatgagaatcagggaactttgacatttgaagagttctgtgttttttacaaaatgatgtctttgagacgagacctttatttgttacttttgagctacagtgacaagaaagatcacctaactgtggaagaactggctcagtttttgaaggtggagcaaaagatgaataatgtgacaacggactattgtcttgacatcataaagaagtttgaagtttcagaagaaaataaggtgaaaaatgttcttggcatagaaggcttcacgaacttcatgcgtagtcctgcctgtgacatatttaacccattgcaccatgaagtgtaccaagacatggatcagcccctctgcaactactacattgcttcctctcacaatacatacctgactggagaccagctcctttctcagtccaaagtggatatgtatgcacgggtgctgcaagagggctgtcgctgtgtggaagttgactgttgggatggcccagatggagagccagtagtacatcatggttacactctcacttcaaaaattctcttcagagatgttgtggagaccatcaacaagcatgcctttgtgaagaatgagtttcctgttatattgtctatcgagaatcactgcagtatccagcagcaaaggaagattgctcagtacctgaaaggaatattcggagacaaactggacctgtcatctgttgatacaggggagtgcaagcagcttccaagccctcaaagtttgaaaggcaaaattctagtgaagggtaagaagttgccttatcaccttggggatgatgcagaggaaggggaagtttctgatgaggacagtgcagatgaaattgaagacgagtgcaaattcaagctccattatagtaatgggaccactgagcatcaggtggaatctttcataaggaaaaaactggagtcactgttaaaagaatctcaaattcgagataaagaagatcctgatagtttcacagtgcgggcactactgaaggccacgcatgaaggcttaaatgcacacctgaagcagagtccagatgtaaaggaaagtggaaagaaatcacatggacgatccctcatgaccaactttggaaaacataagaaaactacaaaatcacggtctaaatcttacagtactgatgatgaggaagacacacagcagagtactggcaaggagggtggccagctgtacagattgggtcgccgaaggaaaaccatgaagctctgccgagaactctctgatttggttgtgtacacaaactccgtggccgctcaggacattgtggatgacggaaccacaggaaatgtgttatcattcagtgaaacaagagcacatcaggttgttcagcaaaaatcagagcagttcatgatttataatcaaaagcaactcacgaggatttacccctctgcctaccgcattgattccagtaacttcaaccctctcccctactggaacgcaggctgccagctagtggcactgaattatcaatctgaaggacgaatgatgcagttaaaccgagccaaattcaaggcaaatggcaattgtggctatgtcctcaaaccccagcaaatgtgcaaaggtactttcaaccctttctctggtgaccctcttcctgccaaccccaaaaagcagctcatcctgaaagttatcagtggacagcaactccccaaacctccagactccatgtttggagatcgaggcgagatcattgacccttttgttgaagttgaaattattggattgccagtagattgttgtaaagatcaaacccgtgtggtagatgacaatggatttaaccctgtgtgggaagaaacactgacatttacagtacacatgccagaaatagctttggttcggttccttgtgtgggatcacgatcccattggacgagactttgttggacaaagaactgtgaccttcagcagcttagtgcctggctaccggcatgtctatttggaaggactgacagaagcatccatatttgtacacataaccatcaatgaaatctatggaaagaacagacaactccagggtctgaagggactgttcaataagaatcctaggcacagttcttcagaaaacaattcccattatgtacggaagcgatccattggagatagaattctgcgacgcacagctagcgccccagccaaaggcaggaaaaagagcaaaatgggcttccaagaaatggtggagataaaggattctgtgtccgaggccacaagagatcaagatggcgtgctgaggaggaccacacgcagtttgcaagcacgccctgtctctatgcctgttgacagaaaccttctgggagctttgtcgctgcctgtatctgaaacagcaaaagacattgaaggaaaagaaaactctctagcagaagataaagatggcagaagaaaagggaaagcaagtataaaagatccacattttctaaatttcaacaaaaagttatcatcctcctccagtgctctgctccacaaagataccagccaaggggacaccattgtatctactgcccacatgtcagtcacaggagaacagctgggcatgtcaagtcctaggggtgggagaaccacatcaaatgccacaagcaattgccaggaaaacccctgtcccagcaagtctctctccccaaagcagcatttggctcccgatcctgtagttaaccccacacaagatctgcatggtgtgaaaatcaaggaaaagggtaatcctgaggactttgtggaagggaaaagcatcttgtcaggaagcgtcctttctcatagcaacctagaaattaagaacctggaaggtaataggggtaagggccgagctgcaacatccttttctttgtcagacgtctccatgctctgttctgacatacctgacctacattcaactgcaattctgcaggagagtgtaatttcccatcttattgacaatgtcactttaacaaatgagaatgagccgggcagttccatctcagccctgattggccagtttgatgagaccaacaatcaggctctcacagttgtttctcatcttcataataccagtgtgatgtcaggccattgtcccttgcctagcctgggcctaaaaatgcccatcaagcatggtttttgcaagggaaaatccaagtcttccttcctgtgctcatctccggagctgatagcactctcgagttctgagaccaccaaacatgcaacgaacacagtttatgaaactacctgcactcccatctctaaaaccaaaccagatgatgacctttctagtaaggccaagacagcggccttagaaagcaacctgcctggatcccctaatacttctcgtggctggttaccaaaaagtcctaccaagggagaagactgggaaacactgaagagctgcagccctgcctcttcccctgatttgaccctggaggatgtaatagctgatcccactctctgtttcaattctggggagagcagccttgtggaaattgatggagaatcagaaaatctttctctaacaacctgtgaatataggagagagggcacaagtcaacttgcttctcctttaaaactcaagtacaatcagggtgtggtagaacactttcaaagaggtttgagaaacggctactgtaaagagaccctccgcccttctgtccctgaaatattcaacaatattcaagatgtcaaaactcaaagtatttcttatctagcctatcagggtgctggctttgtgcataatcatttctcagattcagatgcaaaaatgttccagacctgtgtgccccagcaatctagtgctcaagatatgcatgtccctgtacccaagcagttggcacatcttcctttgcctgctctgaaactgcctagtccttgcaaatccaaaagtctgggggacttaacatcagaggacattgcctgcaattttgagagcaagtaccagtgtattagtaagagttttgttacaactggcattagagacaagaagggcgtgactgtgaagacaaagtcgttagagcctatagatgccctgaccgagcagcttcggaagcttgtgtcctttgaccaggaagacaactgccaagtgctatattcaaagcaggatgccaatcagctcccccgggcactggtcaggaagttgtcatccagaagtcagagcagagtgcgcaatattgctagtcgtgccaaggagaaacaggaagccaacaagcagaaagttccaaaccccagcaatggggcaggagtggttcttagaaacaaaccctcagcacccacccctgcagtgaatcgccactccaccggctcctacatcgcaggctacctgaagaacacgaaagggggtggccttgaaggccggggcatcccagagggggcatgcacggctcttcactatggccacgttgaccagttttgttcagataattctgttttgcagactgagccaagcagtgatgataaaccagaaatttattttcttttgagactgtgaattatttaaaactgcattcttaaggttttcaaggtattctgtagaatgtcagagttttcagtaaataagttccttggctttggaatgattttcaaatgtatttttaaacttgtatttgggtctccctttgacttcatgtgttctccctgttaatgcgtttgtatatagatttggtgacatttcccatgtacctattatgatctttctcccttgagttgttgtaaactgtatcagtatgaaatatgtgcatgccctagatgtgaaactcctcagcagctcgggttataatgtgtgtgtgtttcaccaagatgtcctttactgtgtcctcagattgcagtcacaaatgtagtcatttttactctctaactgttgagttgattaagagactttgcaaacgacaaagggatgaattccttactttaatctgttatcatttttcctatgtttccctctttgttcagaagcccagatgcatttttataactcagttttaaaaactttaaaatagttaccttgccttttaggatgttcttatcccacccataatgagagttgaaaggggatggatagctgctccccatgcccttcccactttttggaataggccgtgagggtgtgaggaagaaggctgtcttttgtacataaggacaaaattgtttgttttacataaattttgttacatatttttgctaatggctttgtatgtaacaagaagcgagttgccaaactacctgttgtacttttgaattttctgattgaattacagactgcgaacaacggctttcagaatgagggacttccatcagactctaatgataatagtagcacaaattgaaaacttccccaaagctttcacagaatattttctcataataaaatccaagtgaacagataattagaagaaacccttttccttcagggaaccaagcaactctattttagtactgacatgcattattttcactgtgaattcacttttttattgcatgttcagatgtccctctttgttttttttttttgtaacattaactgcaatgatgttcttcctggaattcatgaaaatataattaaaacacatttttaaac

SEQ ID NO: 15855 - DNA, 5450 bp, Homo sapiens
  ENST00000627854
cacgggcgggcgcggcagggcagcgtgtggggctgcgatcggcatgggctctgcgcgcggggtgcccctgctcgggctggggctcaggggacgccgggggccagcacagggcccggtgtccctcgggccgtgccggtaactgggattggcacccgccggccatggaagagcctgggcccccaggtgggctcagccaagaccaagtggagcggtgcatgggtgccatgcaagaggggatgcagatggtgaagctgcgtggcggctccaagggcctggtccgcttctactacctggacgagcaccgctcctgcatccgctggaggccctcacgcaagaacgagaaggccaagatctccatcgactccatccaggaggtgagtgaggggcggcagtcggaggtcttccagcgctaccctgacggcagcttcgaccccaactgctgcttcagcatctaccacggcagccaccgcgagtcgctggacctggtctccaccagcagcgaggtggcgcgcacctgggtcactggcctgcgctacctcatggccggcatcagcgacgaggacagcctggctcgccgccagcgcaccagggaccaatggctgaagcagacgtttgacgaggccgacaagaacggggatggcagcctgagcattggcgaggtcctgcagctgctgcacaagctcaacgtgaacctgccccggcagagggtgaagcagatgttcagggaagcggacacggatgaccaccaagggacgctgggttttgaagagttctgtgccttctacaagatgatgtccacccgccgggacctctacctgctcatgctgacctacagcaaccacaaggaccacctggatgccgccagcctgcagcgcttcctgcaggtggagcagaagatggcgggtgtgaccctcgagagctgccaggacatcatcgagcagtttgagccatgcccagaaaacaagagtaaggggctgctgggcattgatggcttcaccaactacaccaggagccctgctggtgacatcttcaaccctgagcaccaccatgtgcaccaggacatgacgcagccgctgagccactacttcatcacctcgtcccacaacacctacctcgtgggtgaccagctcatgtcccagtcacgggtggacatgtatgcttgggtcctgcaggctggctgccgctgcgtggaggtggactgctgggatgggcccgacggggagcccattgtgcaccatggctacactctgacttccaagatcctcttcaaagacgtcattgaaaccatcaacaaatatgccttcatcaagaatgagtacccagtgatcctgtccatcgaaaaccactgcagtgtcatccagcagaagaaaatggcccagtatctgactgacatccttggggacaagctggacctgtcatcagtgagcagtgaagatgccaccacactcccctctccacagatgctcaagggcaagatcctcgtgaaggggaagaagctcccagccaacatcagcgaggatgcggaggaaggcgaggtgtctgatgaggacagtgctgatgagattgacgatgactgcaagctcctcaatggggatgcatccaccaatcgaaagcgtgtagaaaacactgctaagaggaaactggattccctcatcaaagagtcgaagattcgggactgtgaggaccccaacaacttctccgtctccacactgtccccatctggaaagctcggacgcaagagcaaggctgaagaggacgtggagtctggggaggatgccggggccagcagacgcaatggccgcctcgtcgtgggaagcttctccaggcgcaagaagaagggcagcaagctgaagaaggcggccagcgtggaggagggagatgagggtcaggactccccgggaggccagagccgaggggcgacccggcagaagaagaccatgaagctgtcccgggccctctctgacctggtgaagtacaccaagtccgtggccacccacgacatagagatggaggcggcgtccagctggcaggtgtcgtccttcagcgagaccaaggcccaccagattctgcagcagaagccggcgcagtacctacgcttcaaccagcagcagctctcccgcatctacccctcctcctaccgtgtggactccagcaactacaacccgcagcccttctggaacgccggctgccaaatggttgccctgaactaccagtcagaggggcggatgctgcagctgaaccgagccaagttcagcgccaacggtggctgcggctacgtactcaagcctgggtgcatgtgccagggcgtgttcaaccccaactcggaggaccccctgcccgggcagctcaagaagcagctggtgctccggatcatcagtggccagcagcttcccaagccgcgcgactccatgctgggggaccgtggggagatcatcgacccctttgtggaggtggagatcattgggctccctgtggactgcagcagggagcagacccgcgtggtggacgacaacgggttcaaccccacctgggaggagaccctggttttcatggtgcacatgccggagatcgcgctggtccgcttcctcgtctgggaccacgatcccatcgggcgtgacttcattggccagaggacgctggccttcagcagcatgatgccaggctacagacacgtgtacctagaagggatggaagaggcctccatcttcgtgcatgtggctgtcagtgacatcagcggtaaggtcaagcaggctctgggcctaaaaggcctcttcctccgaggcccaaagcccggctcgctggacagtcatgctgctgggcggcccccggcccggccctccgttagccagcggatcctgcggcgcacggccagcgccccgaccaagagccagaagccgggccgcaggggcttcccggagctggtcctgggtacacgggacacaggctccaagggggtggcagacgatgtggtgccccccgggcccggacctgctccggaagccccagcccaggaggggcccggcagcggcagcccccgaggtaaggcgccagctgcggtggcagagaagagccctgtgcgagtgcggcccccgcgtgtcctggacggccccgggcctgctgggatggccgccacatgcatgaagtgtgtggtgggatcctgcgccggcgtgaacaccgggggcctgcagagggagcggccacccagcccggggcctgcaagcaggcaggcagccattcgccagcagccccgggcccgggctgactcactgggggccccctgctgtggcctggaccctcacgctatcccggggagaagcagagaggcccccaagggtcctggggcctggaggcagggtccaggcggtagcggctccatgtcctcggactccagcagcccagacagcccgggcatccccgaaaggtccccccgctggcctgagggtgcctgcaggcaaccgggggccctgcagggagagatgagtgccttgtttgctcaaaagctggaggagatcaggagtaaatcccccatgttctccgccgttaggaactgagagcggcgagtgacaggtaacggggcccagccccggtgtcccgtgctgtcccagcccaaggagggccccgtgtgcggcacagggcgtggactgggccccagcagcagcagggtggggacaccgagtgtgccgcgcccgggggatgcctcggggtgggagctgggcctggcgaccctcggcacagggcaccggggacaccaccctgatccgactcctctccgcctctctccctgcctccctctctctcttctgcttctccctctggctctctctcactcccccacctccccacagacacccgccccctctccacgcagcggccactccccccactgtgcagcctggaaaccatcgctgaggagcccgccccaggccctggtcccccgccaccagcggctgtccccaccagctcttctcagggacggcccccataccccacaggacccggagccaatgtggcaagccccctagaggacactgaggagccccgagacagcaggcctcggccgtgcaacggcgagggcgccggcggggcatacgagagggcccccggcagccagacggacggcaggagccagccccggaccctgggccacctgcccgtgattagaagggtgaagagtgaggggcaggtgcccacggagcccctgggagggtggcggcccctggccgctccctttccagctcctgccgtgtactccgatgccacgggcagtgacccgctgtggcagcggctggagccatgtggccaccgagacagcgtttcctcctcctccagcatgtcatccagcgacactgtcattgacctctccctgcccagcctgggcctgggccgcagccgtgagaacctcgctggagcccacatgggacgcctgccccccaggccccactcggcttcggctgcccgcccagacctgccacctgtgaccaagagcaaatccaaccccaaccttcgggctacaggccagcggcctcccatacctgacgaactgcagcccaggtccctggccccaaggatggctggcctccccttccggcctccctggggctgcctttccctggtgggcgtgcaggactgccccgtggctgccaagtccaagagcctgggcgacctcactgctgatgactttgcccctagctttgagggcggctcccgcagactgagccacagcctgggcctcccgggagggacacggcgggtgtcggggccaggggtgagacgggacaccctgacagagcagctgcgctggctcactgtcttccagcaggcaggagacatcacgtcacccaccagcctgggcccggctggggagggggtggcagggggccctggttttgtgcggcgctcctcctcccgcagccacagccgcgtgcgtgccattgccagccgggcccgccaggcccaggagcggcagcagagactgcagggcctgggccggcagggacccccagaagaggagcggggcacccccgagggcgcctgctccgtgggccacgagggcagtgtggatgcaccagcaccctccaagggagccctcgggccagcatccgcggctgctgaaaacctggtcctgctccgcctctgaccgtcagtggtgggaacctgggcggctctggaggcccagggcaggggtgggcgtgttgtttgctcaggaaacagggcagccaggcccccaaaactgtgtccccctggctgccctgtgtcccctccacccctgcctccctcctgcccctgctcccggggaggaaaggctaaagctgctggcccggggcccacaggaggggcttcgaggctggccctgccaggcagttttcccggcgttttaggatctgtacatagagaaatatttaaatttttagaagcaaaacttatacaacattaaaatgataccaagtccc

SEQ ID NO: 15856 - DNA, 4837 bp, Homo sapiens
  ENST00000626246
gcggctgcgtcagggattccttggtggccctggagggtggataggctggcctgggggccatcaggacagcaggtgacggtcaggccaatgccagccgggcctgggcacagccctgtgggggcttcggagggccctgaggaggaggaggaagaggcagaggagagaaggccccacggaggtcctgtcgccagcgctgccactgcctgacctccgctgcccgaaggccggtgggcctctgtggcctccgtgaagcaggcccggctgtcgtcaggccatgtctggtccatggccctcccccgacagccggaccaagggaacggtggcctggctggcggaggtactcctctgggttggagggagtgtggtgctgtcttcagagtggcagctcggccccctggtggagcggtgcatgggtgccatgcaagaggggatgcagatggtgaagctgcgtggcggctccaagggcctggtccgcttctactacctggacgagcaccgctcctgcatccgctggaggccctcacgcaagaacgagaaggccaagatctccatcgactccatccaggaggtgagtgaggggcggcagtcggaggtcttccagcgctaccctgacggcagcttcgaccccaactgctgcttcagcatctaccacggcagccaccgcgagtcgctggacctggtctccaccagcagcgaggtggcgcgcacctgggtcactggcctgcgctacctcatggccggcatcagcgacgaggacagcctggctcgccgccagcgcaccagggaccaatggctgaagcagacgtttgacgaggccgacaagaacggggatggcagcctgagcattggcgaggtcctgcagctgctgcacaagctcaacgtgaacctgccccggcagagggtgaagcagatgttcagggaagcggacacggatgaccaccaagggacgctgggttttgaagagttctgtgccttctacaagatgatgtccacccgccgggacctctacctgctcatgctgacctacagcaaccacaaggaccacctggatgccgccagcctgcagcgcttcctgcaggtggagcagaagatggcgggtgtgaccctcgagagctgccaggacatcatcgagcagtttgagccatgcccagaaaacaagagtaaggggctgctgggcattgatggcttcaccaactacaccaggagccctgctggtgacatcttcaaccctgagcaccaccatgtgcaccaggacatgacgcagccgctgagccactacttcatcacctcgtcccacaacacctacctcgtgggtgaccagctcatgtcccagtcacgggtggacatgtatgcttgggtcctgcaggctggctgccgctgcgtggaggtggactgctgggatgggcccgacggggagcccattgtgcaccatggctacactctgacttccaagatcctcttcaaagacgtcattgaaaccatcaacaaatatgccttcatcaagaatgagtacccagtgatcctgtccatcgaaaaccactgcagtgtcatccagcagaagaaaatggcccagtatctgactgacatccttggggacaagctggacctgtcatcagtgagcagtgaagatgccaccacactcccctctccacagatgctcaagggcaagatcctcgtgaaggggaagaagctcccagccaacatcagcgaggatgcggaggaaggcgaggtgtctgatgaggacagtgctgatgagattgacgatgactgcaagctcctcaatggggatgcatccaccaatcgaaagcgtgtagaaaacactgctaagaggaaactggattccctcatcaaagagtcgaagattcgggactgtgaggaccccaacaacttctccgtctccacactgtccccatctggaaagctcggacgcaagagcaaggctgaagaggacgtggagtctggggaggatgccggggccagcagacgcaatggccgcctcgtcgtgggaagcttctccaggcgcaagaagaagggcagcaagctgaagaaggcggccagcgtggaggagggagatgagggtcaggactccccgggaggccagagccgaggggcgacccggcagaagaagaccatgaagctgtcccgggccctctctgacctggtgaagtacaccaagtccgtggccacccacgacatagagatggaggcggcgtccagctggcaggtgtcgtccttcagcgagaccaaggcccaccagattctgcagcagaagccggcgcagtacctacgcttcaaccagcagcagctctcccgcatctacccctcctcctaccgtgtggactccagcaactacaacccgcagcccttctggaacgccggctgccaaatggttgccctgaactaccagtcagaggggcggatgctgcagctgaaccgagccaagttcagcgccaacggtggctgcggctacgtactcaagcctgggtgcatgtgccagggcgtgttcaaccccaactcggaggaccccctgcccgggcagctcaagaagcagctggtgctccggatcatcagtggccagcagcttcccaagccgcgcgactccatgctgggggaccgtggggagatcatcgacccctttgtggaggtggagatcattgggctccctgtggactgcagcagggagcagacccgcgtggtggacgacaacgggttcaaccccacctgggaggagaccctggttttcatggtgcacatgccggagatcgcgctggtccgcttcctcgtctgggaccacgatcccatcgggcgtgacttcattggccagaggacgctggccttcagcagcatgatgccaggctacagacacgtgtacctagaagggatggaagaggcctccatcttcgtgcatgtggctgtcagtgacatcagcggtaaggtcaagcaggctctgggcctaaaaggcctcttcctccgaggcccaaagcccggctcgctggacagtcatgctgctgggcggcccccggcccggccctccgttagccagcggatcctgcggcgcacggccagcgccccgaccaagagccagaagccgggccgcaggggcttcccggagctggtcctgggtacacgggacacaggctccaagggggtggcagacgatgtggtgccccccgggcccggacctgctccggaagccccagcccaggaggggcccggcagcggcagcccccgagacacccgccccctctccacgcagcggccactccccccactgtgcagcctggaaaccatcgctgaggagcccgccccaggccctggtcccccgccaccagcggctgtccccaccagctcttctcagggacggcccccataccccacaggacccggagccaatgtggcaagccccctagaggacactgaggagccccgagacagcaggcctcggccgtgcaacggcgagggcgccggcggggcatacgagagggcccccggcagccagacggacggcaggagccagccccggaccctgggccacctgcccgtgattagaagggtgaagagtgaggggcaggtgcccacggagcccctgggagggtggcggcccctggccgctccctttccagctcctgccgtgtactccgatgccacgggcagtgacccgctgtggcagcggctggagccatgtggccaccgagacagcgtttcctcctcctccagcatgtcatccagcgacactgtcattgacctctccctgcccagcctgggcctgggccgcagccgtgagaacctcgctggagcccacatgggacgcctgccccccaggccccactcggcttcggctgcccgcccagacctgccacctgtgaccaagagcaaatccaaccccaaccttcgggctacaggccagcggcctcccatacctgacgaactgcagcccaggtccctggccccaaggatggctggcctccccttccggcctccctggggctgcctttccctggtgggcgtgcaggactgccccgtggctgccaagtccaagagcctgggcgacctcactgctgatgactttgcccctagctttgagggcggctcccgcagactgagccacagcctgggcctcccgggagggacacggcgggtgtcggggccaggggtgagacgggacaccctgacagagcagctgcgctggctcactgtcttccagcaggcaggagacatcacgtcacccaccagcctgggcccggctggggagggggtggcagggggccctggttttgtgcggcgctcctcctcccgcagccacagccgcgtgcgtgccattgccagccgggcccgccaggcccaggagcggcagcagagactgcagggcctgggccggcagggacccccagaagaggagcggggcacccccgagggcgcctgctccgtgggccacgagggcagtgtggatgcaccagcaccctccaagggagccctcgggccagcatccgcggctgctgaaaacctggtcctgctccgcctctgaccgtcagtggtgggaacctgggcggctctggaggcccagggcaggggtgggcgtgttgtttgctcaggaaacagggcagccaggcccccaaaactgtgtccccctggctgccctgtgtcccctccacccctgcctccctcctgcccctgctcccggggaggaaaggctaaagctgctggcccggggcccacaggaggggcttcgaggctggccctgccaggcagttttcccggcgttttaggatctgtacatagagaaatatttaaatttttagaagcaaaacttatacaacattaaaatgataccaagtcc

SEQ ID NO: 15857 - DNA, 6453 bp, Homo sapiens
  ENST00000627279
cacagggaacgggtagggtcccacggtttggggagagacatggcagtcctcaagggctgggatcagggcgcagccagggtttctgatggctttgctgatggtcaggacccaggcatgccaggcaaggcctcagcccagcagttgccaagcgtgtagccactttgggcccgtggagagagtcgcgctgcggagcccccagggggacctgaggtcacaagagcctcgatgcacctgagcgcggagctgggggtccctggagccgctgtccccacctgcggcgctggagccctggaggtgtccaggggcttccttggaacgtggagacgtgctggttaaacgtggagccccgggccagccgggcactgggggctgcaggtggagggaggtggatgctctccctcgtgggggcgtgtcttttccacaggaaagggaaagggggagggacacgggtcagcagtggggggctgtgcagtctcgcagatcttcacccttggttcttgaactctggaccctgagccctgccgagggtcccgcaaaggtgggcaaggagctcccggctgcttggtctccgcagtgttggggctgccagcagggggacgctgggcccccggggacctgacccgtgctccctccccaccccgcagtctccatcgactccatccaggaggtgagtgaggggcggcagtcggaggtcttccagcgctaccctgacggcagcttcgaccccaactgctgcttcagcatctaccacggcagccaccgcgagtcgctggacctggtctccaccagcagcgaggtggcgcgcacctgggtcactggcctgcgctacctcatggccggcatcagcgacgaggacagcctggctcgccgccagcgcaccagggaccaatggctgaagcagacgtttgacgaggccgacaagaacggggatggcagcctgagcattggcgaggtcctgcagctgctgcacaagctcaacgtgaacctgccccggcagagggtgaagcagatgttcagggaagcggacacggatgaccaccaagggacgctgggttttgaagagttctgtgccttctacaagatgatgtccacccgccgggacctctacctgctcatgctgacctacagcaaccacaaggaccacctggatgccgccagcctgcagcgcttcctgcaggtggagcagaagatggcgggtgtgaccctcgagagctgccaggacatcatcgagcagtttgagccatgcccagaaaacaagagtaaggggctgctgggcattgatggcttcaccaactacaccaggagccctgctggtgacatcttcaaccctgagcaccaccatgtgcaccaggacatgacgcagccgctgagccactacttcatcacctcgtcccacaacacctacctcgtgggtgaccagctcatgtcccagtcacgggtggacatgtatgcttgggtcctgcaggctggctgccgctgcgtggaggtggactgctgggatgggcccgacggggagcccattgtgcaccatggctacactctgacttccaagatcctcttcaaagacgtcattgaaaccatcaacaaatatgccttcatcaagaatgagtacccagtgatcctgtccatcgaaaaccactgcagtgtcatccagcagaagaaaatggcccagtatctgactgacatccttggggacaagctggacctgtcatcagtgagcagtgaagatgccaccacactcccctctccacagatgctcaagggcaagatcctcgtgaaggggaagaagctcccagccaacatcagcgaggatgcggaggaaggcgaggtgtctgatgaggacagtgctgatgagattgacgatgactgcaagctcctcaatggggatgcatccaccaatcgaaagcgtgtagaaaacactgctaagaggaaactggattccctcatcaaagagtcgaagattcgggactgtgaggaccccaacaacttctccgtctccacactgtccccatctggaaagctcggacgcaagagcaaggctgaagaggacgtggagtctggggaggatgccggggccagcagacgcaatggccgcctcgtcgtgggaagcttctccaggcgcaagaagaagggcagcaagctgaagaaggcggccagcgtggaggagggagatgagggtcaggactccccgggaggccagagccgaggggcgacccggcagaagaagaccatgaagctgtcccgggccctctctgacctggtgaagtacaccaagtccgtggccacccacgacatagagatggaggcggcgtccagctggcaggtgtcgtccttcagcgagaccaaggcccaccagattctgcagcagaagccggcgcagtacctacgcttcaaccagcagcagctctcccgcatctacccctcctcctaccgtgtggactccagcaactacaacccgcagcccttctggaacgccggctgccaaatggttgccctgaactaccagtcagaggggcggatgctgcagctgaaccgagccaagttcagcgccaacggtggctgcggctacgtactcaagcctgggtgcatgtgccagggcgtgttcaaccccaactcggaggaccccctgcccgggcagctcaagaagcagctggtgctccggatcatcagtggccagcagcttcccaagccgcgcgactccatgctgggggaccgtggggagatcatcgacccctttgtggaggtggagatcattgggctccctgtggactgcagcagggagcagacccgcgtggtggacgacaacgggttcaaccccacctgggaggagaccctggttttcatggtgcacatgccggagatcgcgctggtccgcttcctcgtctgggaccacgatcccatcgggcgtgacttcattggccagaggacgctggccttcagcagcatgatgccaggctacagacacgtgtacctagaagggatggaagaggcctccatcttcgtgcatgtggctgtcagtgacatcagcggtaaggtcaagcaggctctgggcctaaaaggcctcttcctccgaggcccaaagcccggctcgctggacagtcatgctgctgggcggcccccggcccggccctccgttagccagcggatcctgcggcgcacggccagcgccccgaccaagagccagaagccgggccgcaggggcttcccggagctggtcctgggtacacgggacacaggctccaagggggtggcagacgatgtggtgccccccgggcccggacctgctccggaagccccagcccaggaggggcccggcagcggcagcccccgaggtaaggcgccagctgcggtggcagagaagagccctgtgcgagtgcggcccccgcgtgtcctggacggccccgggcctgctgggatggccgccacatgcatgaagtgtgtggtgggatcctgcgccggcgtgaacaccgggggcctgcagagggagcggccacccagcccggggcctgcaagcaggcaggcagccattcgccagcagccccgggcccgggctgactcactgggggccccctgctgtggcctggaccctcacgctatcccggggagaagcagagaggcccccaagggtcctggggcctggaggcagggtccaggcggtagcggctccatgtcctcggactccagcagcccagacagcccgggcatccccgaaaggtccccccgctggcctgagggtgcctgcaggcaaccgggggccctgcagggagagatgagtgccttgtttgctcaaaagctggaggagatcaggagtaaatcccccatgttctccgccggtaagcccctcttgccctgcgtggtcctcccgcacgcccctggcatggctgggcctgggtcacctgctgctgcttctgcgtggacggtgtcgcctcgtgtgctcgtgctcgtggctctgtatccgtggcactgtctccgtggcactctgctcccttggcttgcctgtggcccatagccccagccctcctgtctgagcttgaggccctgggacttgggtggagctggtttgaggcccgacaggctgggaagaaccagctgctcttgctgagggtctggggccgggactgtggcctgacatgctgggcccctccggctgggcgcttccccaaactcacctcctgggcggctggcgacctgcatggcccctgatgcctttcctgggactgggggccacgtaccatcccattcccacctccctctagggcaggctccaggggtccctactgggaagtctgatgtgggcaggtagtgcagctgctgggcgtctcctgcgcccctgggacgcctggagcctgctgagtgctgcgtggagtagattccctgggccccagggcttcgctgctttgggctgaagcaccccactagaagggtgtctccttagcctggagggagggacatacacggagcccgccccacaccaccctgcccctccagacccccctgaccaagctttcctttctgcccccacccacgctgcctccgtagttaggaactgagagcggcgagtgacaggtaacggggcccagccccggtgtcccgtgctgtcccagcccaaggagggccccgtgtgcggcacagggcgtggactgggccccagcagcagcagggtggggacaccgagtgtgccgcgcccgggggatgcctcggggtgggagctgggcctggcgaccctcggcacagggcaccggggacaccaccctgatccgactcctctccgcctctctccctgcctccctctctctcttctgcttctccctctggctctctctcactcccccacctccccacagacacccgccccctctccacgcagcggccactccccccactgtgcagcctggaaaccatcgctgaggagcccgccccaggccctggtcccccgccaccagcggctgtccccaccagctcttctcagggacggcccccataccccacaggacccggagccaatgtggcaagccccctagaggacactgaggagccccgagacagcaggcctcggccgtgcaacggcgagggcgccggcggggcatacgagagggcccccggcagccagacggacggcaggagccagccccggaccctgggccacctgcccgtgattagaagggtgaagagtgaggggcaggtgcccacggagcccctgggagggtggcggcccctggccgctccctttccagctcctgccgtgtactccgatgccacgggcagtgacccgctgtggcagcggctggagccatgtggccaccgagacagcgtttcctcctcctccagcatgtcatccagcgacactgtcattgacctctccctgcccagcctgggcctgggccgcagccgtgagaacctcgctggagcccacatgggacgcctgccccccaggccccactcggcttcggctgcccgcccagacctgccacctgtgaccaagagcaaatccaaccccaaccttcgggctacaggccagcggcctcccatacctgacgaactgcagcccaggtccctggccccaaggatggctggcctccccttccggcctccctggggctgcctttccctggtgggcgtgcaggactgccccgtggctgccaagtccaagagcctgggcgacctcactgctgatgactttgcccctagctttgagggcggctcccgcagactgagccacagcctgggcctcccgggagggacacggcgggtgtcggggccaggggtgagacgggacaccctgacagagcagctgcgctggctcactgtcttccagcaggcaggagacatcacgtcacccaccagcctgggcccggctggggagggggtggcagggggccctggttttgtgcggcgctcctcctcccgcagccacagccgcgtgcgtgccattgccagccgggcccgccaggcccaggagcggcagcagagactgcagggcctgggccggcagggacccccagaagaggagcggggcacccccgagggcgcctgctccgtgggccacgagggcagtgtggatgcaccagcaccctccaagggagccctcgggccagcatccgcggctgctgaaaacctggtcctgctccgcctctgaccgtcagtggtgggaacctgggcggctctggaggcccagggcaggggtgggcgtgttgtttgctcaggaaacagggcagccaggcccccaaaactgtgtccccctggctgccctgtgtcccctccacccctgcctccctcctgcccctgctcccggggaggaaaggctaaagctgctggcccggggcccacaggaggggcttcgaggctggccctgccaggcagttttcccggcgttttaggatctgtacatagagaaatatttaaatttttagaagcaaaacttatacaacattaaaatgataccaagtccctttc

SEQ ID NO: 15858 - DNA, 6986 bp, Homo sapiens
  ENST00000625637
gtgggggaaccctccttgctagcgttgcaaagaagggcccagctccgtcaggaatccagggatggagaactggggagcctgggccccacatgagattcatggcaggacttgtctgaggggccccagtgccagcgacccagccccctgtgcctggcccctctgtgggtctcaggacctgggtctgggctgggtgtttggaggaacctcctcccggctctcagacacctctgttttgtctgctgtggatgacttccagcttggtccccctgtggccctggcaggagtatcaccatgggagagggcaggacaggggctgggcgagcaggcctcccactagaccaggctactcctgctgtggaccagctacttccacctctgcccttggcttgccctcctcagagttctcagcctgagtgggccctggggacactgtcaccagagaccccacccctcatacccccagggacccagacccacccccagaagccatgtgacctcctcggctcagctgtgggaggcatgggctctgtcccacatgctgcggtagccacaaaggtgatccatactgggccaggtgcaccccgaggtgcccccctggaccactgcctccctccctccccctggcaccggctccagtctcctatgtgggggctggggagggggctgttggcagccatgccccagcaagcagggggcttgctgagggctgggccactgaccacctccccggcatcccctcaggcgtgttcaaccccaactcggaggaccccctgcccgggcagctcaagaagcagctggtgctccggatcatcagtggccagcagcttcccaagccgcgcgactccatgctgggggaccgtggggagatcatcgacccctttgtggaggtggagatcattgggctccctgtggactgcagcagggagcagacccgcgtggtggacgacaacgggttcaaccccacctgggaggagaccctggttttcatggtgcacatgccggagatcgcgctggtccgcttcctcgtctgggaccacgatcccatcgggcgtgacttcattggccagaggacgctggccttcagcagcatgatgccaggctacagacacgtgtacctagaagggatggaagaggcctccatcttcgtgcatgtggctgtcagtgacatcagcggtaaggtgagtgtcaccccctgccaccagccatcatggggaggggccacaccagccccttgtcccatgcccccccatgtgtccccagtgctgggtcctgaactcaggcagtgaggcctagggtcccctccccgggcctctgctcctctatctcaagaggggctgctgtgggggcctggctcctgagccaccagtgcccacctctgatctcagggctggctttgggcatctcgggcaggacaggtcctgagtgctccgggccttgccccgccctgtgtcacccatgcctgtctcagactcttgggggccttgcagcctccacccctacagtgctgccatctggcttctcagcagggaccgagtgatgcccctctcccctctactaccccccacccctctacttcctggtgtcacgtggaaggcagctgcccgggtttgcctgtgactccacacccagcatgtctgtcccctgccccaggtcagggtggggcctcggcttccgcaggaagtggtcttggtgccagccctgctgccctggctttgagctggggcccagtgccctctgggtcctgctggctgcagctggccctcggggaacccgcacacacagcaggaggggcctgcccaggcccagtgctgactctctcctgccatgctctcgggcccagaggtgccatccagcccctgccgtctatccacccatctgttcctcgtcccccaggctgcagggctccccacgccactgctgtggccgcctcacctgctccccctgtctctttggtcttgcagtcggcttctctatggccacagcctacttttagaagtgcagctctgttaggagccttgaaggtacccggtgcgcgggacagtgcggcccgccgcccctgcatgcccaggccgcaccccattagcatccatgattcctggtagcatttggagactgtcgctcatgtgacgtggatcatgacatggctccgggggccctggccatccccagccatagtggcatttacgaggcagatccagggttcagctgggtggccgccttctcactggcctctcctcccctcccctccctcagtcctccctcccctccctcagtcctccctcccctccctcagtcctccctcccctccctcagtcctccctcccctccctcagccccttccctggcgggcagcccgctggagcccccactgtgcccctcctatccccctccttctctctcctgcccccatctcggaccctcaggctgttggttctgagttcgcctcccactccctccctgtccttgccaaccatgccagtgcatgggatgagggcacccctgaggccggcgctccgagccagaatcccggatctgcttctaaatggcttcccagccactgtgaccaaatgcgtagatttgggatcttgaatcaggaagctgattcaagtgctggccatctgaacgcatctgcccagaggcgcccctgcaggggggtgacccacctgccgggcctgggccgctctgtgcacgagcacggctcgtcatgggggcgcggtgggtgctgtctcgggggcatctggcatgtgagggcccctctggcctctgcgccctggagatgcggctgcctccctctcagcagctgttctgcccaggcagggacctcctgggcccagctgtccaggaagattggctgtggccaggtgctggtgggctgggagtctgagcccatcttggcagggctcagggggcagcaagccagctgcgggccttgggggctcacatgagtggagggcagggcaagaccagaaaaggctgcctgggggaattcaggaaggcttcctggaagaggtggtacttcctagggcacgagtatcaccatgggagtgggcaggacacgggccgggcaagtgggcctcccgctgcacctggctactcctgctgtggaccagctactcctgcctgagggtggggcacacacaaccagggagtgccacgccagtgtcccctgctagcgccgggggctgcgggcctctgagcaggtgcaggctgtggtgggccaggctggggctcgaggtctctcctccggagggaaagaccttctctccatgcccctcaagggccccacatgccctggacaggtcaggcgagggcagtttctgccggaagggtggggtgggccatgtgtacttagatctgtagcagctactgtcccaggcagagctgccctagggaccctgctcctgaaggccctggtgtgtccacacacccccagcctgaggtggcccagcccctcggaccgagacacgcatggcacgtctgtggcacggtctggagagctggccctgggggagcagctgcagctgggctgggacccctggcaacagctacatgggctccttctcttgcaggtcaagcaggctctgggcctaaaaggcctcttcctccgaggcccaaagcccggctcgctggacagtcatgctgctgggcggcccccggcccggccctccgttagccagcggatcctgcggcgcacggccagcgccccgaccaagagccagaagccgggccgcaggggcttcccggagctggtcctgggtacacgggacacaggctccaagggggtggcagacgatgtggtgccccccgggcccggacctgctccggaagccccagcccaggaggggcccggcagcggcagcccccgaggtaaggcgccagctgcggtggcagagaagagccctgtgcgagtgcggcccccgcgtgtcctggacggccccgggcctgctgggatggccgccacatgcatgaagtgtgtggtgggatcctgcgccggcgtgaacaccgggggcctgcagagggagcggccacccagcccggggcctgcaagcaggcaggcagccattcgccagcagccccgggcccgggctgactcactgggggccccctgctgtggcctggaccctcacgctatcccggggagaagcagagaggcccccaagggtcctggggcctggaggcagggtccaggcggtagcggctccatgtcctcggactccagcagcccagacagcccgggcatccccgaaaggtccccccgctggcctgagggtgcctgcaggcaaccgggggccctgcagggagagatgagtgccttgtttgctcaaaagctggaggagatcaggagtaaatcccccatgttctccgccggtaagcccctcttgccctgcgtggtcctcccgcacgcccctggcatggctgggcctgggtcacctgctgctgcttctgcgtggacggtgtcgcctcgtgtgctcgtgctcgtggctctgtatccgtggcactgtctccgtggcactctgctcccttggcttgcctgtggcccatagccccagccctcctgtctgagcttgaggccctgggacttgggtggagctggtttgaggcccgacaggctgggaagaaccagctgctcttgctgagggtctggggccgggactgtggcctgacatgctgggcccctccggctgggcgcttccccaaactcacctcctgggcggctggcgacctgcatggcccctgatgcctttcctgggactgggggccacgtaccatcccattcccacctccctctagggcaggctccaggggtccctactgggaagtctgatgtgggcaggtagtgcagctgctgggcgtctcctgcgcccctgggacgcctggagcctgctgagtgctgcgtggagtagattccctgggccccagggcttcgctgctttgggctgaagcaccccactagaagggtgtctccttagcctggagggagggacatacacggagcccgccccacaccaccctgcccctccagacccccctgaccaagctttcctttctgcccccacccacgctgcctccgtagttaggaactgagagcggcgagtgacaggtaacggggcccagccccggtgtcccgtgctgtcccagcccaaggagggccccgtgtgcggcacagggcgtggactgggccccagcagcagcagggtggggacaccgagtgtgccgcgcccgggggatgcctcggggtgggagctgggcctggcgaccctcggcacagggcaccggggacaccaccctgatccgactcctctccgcctctctccctgcctccctctctctcttctgcttctccctctggctctctctcactcccccacctccccacagacacccgccccctctccacgcagcggccactccccccactgtgcagcctggaaaccatcgctgaggagcccgccccaggccctggtcccccgccaccagcggctgtccccaccagctcttctcagggacggcccccataccccacaggacccggagccaatgtggcaagccccctagaggacactgaggagccccgagacagcaggcctcggccgtgcaacggcgagggcgccggcggggcatacgagagggcccccggcagccagacggacggcaggagccagccccggaccctgggccacctgcccgtgattagaagggtgaagagtgaggggcaggtgcccacggagcccctgggagggtggcggcccctggccgctccctttccagctcctgccgtgtactccgatgccacgggcagtgacccgctgtggcagcggctggagccatgtggccaccgagacagcgtttcctcctcctccagcatgtcatccagcgacactgtcattgacctctccctgcccagcctgggcctgggccgcagccgtgagaacctcgctggagcccacatgggacgcctgccccccaggccccactcggcttcggctgcccgcccagacctgccacctgtgaccaagagcaaatccaaccccaaccttcgggctacaggccagcggcctcccatacctgacgaactgcagcccaggtccctggccccaaggatggctggcctccccttccggcctccctggggctgcctttccctggtgggcgtgcaggactgccccgtggctgccaagtccaagagcctgggcgacctcactgctgatgactttgcccctagctttgagggcggctcccgcagactgagccacagcctgggcctcccgggagggacacggcgggtgtcggggccaggggtgagacgggacaccctgacagagcagctgcgctggctcactgtcttccagcaggcaggagacatcacgtcacccaccagcctgggcccggctggggagggggtggcagggggccctggttttgtgcggcgctcctcctcccgcagccacagccgcgtgcgtgccattgccagccgggcccgccaggcccaggagcggcagcagagactgcagggcctgggccggcagggacccccagaagaggagcggggcacccccgagggcgcctgctccgtgggccacgagggcagtgtggatgcaccagcaccctccaagggagccctcgggccagcatccgcggctgctgaaaacctggtcctgctccgcctctgaccgtcagtggtgggaacctgggcggctctggaggcccagggcaggggtgggcgtgttgtttgctcaggaaacagggcagccaggcccccaaaactgtgtccccctggctgccctgtgtcccctccacccctgcctccctcctgcccctgctcccggggaggaaaggctaaagctgctggcccggggcccacaggaggggcttcgaggctggccctgccaggcagttttcccggcgttttaggatctgtacatagagaaatatttaaatttttagaagcaaaacttatacaacattaaaatgataccaagtccctt

SEQ ID NO: 15859 - DNA, 2341 bp, Homo sapiens
  ENST00000627778
ggtgggggccagccccacacaggcgggaggggtgggagttgggggcgggccgggcatcgcgatgggccctgatgccacccccactcctgtgtcccagatcatcgacccctttgtggaggtggagatcattgggctccctgtggactgcagcagggagcagacccgcgtggtggacgacaacgggttcaaccccacctgggaggagaccctggttttcatggtgcacatgccggagatcgcgctggtccgcttcctcgtctgggaccacgatcccatcgggcgtgacttcattggccagaggacgctggccttcagcagcatgatgccaggctacagacacgtgtacctagaagggatggaagaggcctccatcttcgtgcatgtggctgtcagtgacatcagcggtaaggtcaagcaggctctgggcctaaaaggcctcttcctccgaggcccaaagcccggctcgctggacagtcatgctgctgggcggcccccggcccggccctccgttagccagcggatcctgcggcgcacggccagcgccccgaccaagagccagaagccgggccgcaggggcttcccggagctggtcctgggtacacgggacacaggctccaagggggtggcagacgatgtggtgccccccgggcccggacctgctccggaagccccagcccaggaggggcccggcagcggcagcccccgagttaggaactgagagcggcgagtgacagacacccgccccctctccacgcagcggccactccccccactgtgcagcctggaaaccatcgctgaggagcccgccccaggccctggtcccccgccaccagcggctgtccccaccagctcttctcagggacggcccccataccccacaggacccggagccaatgtggcaagccccctagaggacactgaggagccccgagacagcaggcctcggccgtgcaacggcgagggcgccggcggggcatacgagagggcccccggcagccagacggacggcaggagccagccccggaccctgggccacctgcccgtgattagaagggtgaagagtgaggggcaggtgcccacggagcccctgggagggtggcggcccctggccgctccctttccagctcctgccgtgtactccgatgccacgggcagtgacccgctgtggcagcggctggagccatgtggccaccgagacagcgtttcctcctcctccagcatgtcatccagcgacactgtcattgacctctccctgcccagcctgggcctgggccgcagccgtgagaacctcgctggagcccacatgggacgcctgccccccaggccccactcggcttcggctgcccgcccagacctgccacctgtgaccaagagcaaatccaaccccaaccttcgggctacaggccagcggcctcccatacctgacgaactgcagcccaggtccctggccccaaggatggctggcctccccttccggcctccctggggctgcctttccctggtgggcgtgcaggactgccccgtggctgccaagtccaagagcctgggcgacctcactgctgatgactttgcccctagctttgagggcggctcccgcagactgagccacagcctgggcctcccgggagggacacggcgggtgtcggggccaggggtgagacgggacaccctgacagagcagctgcgctggctcactgtcttccagcaggcaggagacatcacgtcacccaccagcctgggcccggctggggagggggtggcagggggccctggttttgtgcggcgctcctcctcccgcagccacagccgcgtgcgtgccattgccagccgggcccgccaggcccaggagcggcagcagagactgcagggcctgggccggcagggacccccagaagaggagcggggcacccccgagggcgcctgctccgtgggccacgagggcagtgtggatgcaccagcaccctccaagggagccctcgggccagcatccgcggctgctgaaaacctggtcctgctccgcctctgaccgtcagtggtgggaacctgggcggctctggaggcccagggcaggggtgggcgtgttgtttgctcaggaaacagggcagccaggcccccaaaactgtgtccccctggctgccctgtgtcccctccacccctgcctccctcctgcccctgctcccggggaggaaaggctaaagctgctggcccggggcccacaggaggggcttcgaggctggccctgccaggcagttttcccggcgttttaggatctgtacatagagaaatatttaaatttttagaagcaaaacttatacaacattaaaatgataccaagtccctt

SEQ ID NO: 15860 - DNA, 4837 bp, Homo sapiens
  ENST00000620687
gcggctgcgtcagggattccttggtggccctggagggtggataggctggcctgggggccatcaggacagcaggtgacggtcaggccaatgccagccgggcctgggcacagccctgtgggggcttcggagggccctgaggaggaggaggaagaggcagaggagagaaggccccacggaggtcctgtcgccagcgctgccactgcctgacctccgctgcccgaaggccggtgggcctctgtggcctccgtgaagcaggcccggctgtcgtcaggccatgtctggtccatggccctcccccgacagccggaccaagggaacggtggcctggctggcggaggtactcctctgggttggagggagtgtggtgctgtcttcagagtggcagctcggccccctggtggagcggtgcatgggtgccatgcaagaggggatgcagatggtgaagctgcgtggcggctccaagggcctggtccgcttctactacctggacgagcaccgctcctgcatccgctggaggccctcacgcaagaacgagaaggccaagatctccatcgactccatccaggaggtgagtgaggggcggcagtcggaggtcttccagcgctaccctgacggcagcttcgaccccaactgctgcttcagcatctaccacggcagccaccgcgagtcgctggacctggtctccaccagcagcgaggtggcgcgcacctgggtcactggcctgcgctacctcatggccggcatcagcgacgaggacagcctggctcgccgccagcgcaccagggaccagtggctgaagcagacgtttgacgaggccgacaagaacggggatggcagcctgagcattggcgaggtcctgcagctgctgcacaagctcaacgtgaacctgccccggcagagggtgaagcagatgttcagggaagcggacacggatgaccaccaagggacgctgggttttgaagagttctgtgccttctacaagatgatgtccacccgccgggacctctacctgctcatgctgacctacagcaaccacaaggaccacctggatgccgccagcctgcagcgcttcctgcaggtggagcagaagatggcgggtgtgaccctcgagagctgccaggacatcatcgagcagtttgagccatgcccagaaaacaagagtaaggggctgctgggcattgatggcttcaccaactacaccaggagccctgctggtgacatcttcaaccctgagcaccaccatgtgcaccaggacatgacgcagccgctgagccactacttcatcacctcgtcccacaacacctacctcgtgggtgaccagctcatgtcccagtcacgggtggacatgtatgcttgggtcctgcaggctggctgccgctgcgtggaggtggactgctgggatgggcccgacggggagcccattgtgcaccatggctacactctgacttccaagatcctcttcaaagacgtcattgaaaccatcaacaaatatgccttcatcaagaatgagtacccagtgatcctgtccatcgaaaaccactgcagtgtcatccagcagaagaaaatggcccagtatctgactgacatccttggggacaagctggacctgtcatcagtgagcagtgaagatgccaccacactcccctctccacagatgctcaagggcaagatcctcgtgaaggggaagaagctcccagccaacatcagcgaggatgcggaggaaggcgaggtgtctgatgaggacagtgctgatgagattgacgatgactgcaagctcctcaatggggatgcatccaccaatcgaaagcgtgtagaaaacactgctaagaggaaactggattccctcatcaaagagtcgaagattcgggactgtgaggaccccaacaacttctccgtctccacactgtccccatctggaaagctcggacgcaagagcaaggctgaagaggacgtggagtctggggaggatgccggggccagcagacgcaatggccgcctcgtcgtgggaagcttctccaggcgcaagaagaagggcagcaagctgaagaaggcggccagcgtggaggagggagatgagggtcaggactccccgggaggccagagccgaggggcgacccggcagaagaagaccatgaagctgtcccgggccctctctgacctggtgaagtacaccaagtccgtggccacccacgacatagagatggaggcggcgtccagctggcaggtgtcgtccttcagcgagaccaaggcccaccagattctgcagcagaagccggcgcagtacctacgcttcaaccagcagcagctctcccgcatctacccctcctcctaccgtgtggactccagcaactacaacccgcagcccttctggaacgccggctgccaaatggttgccctgaactaccagtcagaggggcggatgctgcagctgaaccgagccaagttcagcgccaacggtggctgcggctacgtactcaagcctgggtgcatgtgccagggcgtgttcaaccccaactcggaggaccccctgcccgggcagctcaagaagcagctggtgctccggatcatcagtggccagcagcttcccaagccgcgcgactccatgctgggggaccgtggggagatcatcgacccctttgtggaggtggagatcattgggctccctgtggactgcagcagggagcagacccgcgtggtggacgacaacgggttcaaccccacctgggaggagaccctggttttcatggtgcacatgccggagatcgcgctggtccgcttcctcgtctgggaccacgatcccatcgggcgtgacttcattggccagaggacgctggccttcagcagcatgatgccaggctacagacacgtgtacctagaagggatggaagaggcctccatcttcgtgcatgtggctgtcagtgacatcagcggtaaggtcaagcaggctctgggcctaaaaggcctcttcctccgaggcccaaagcccggctcgctggacagtcatgctgctgggcggcccccggcccggccctccgttagccagcggatcctgcggcgcacggccagcgccccgaccaagagccagaagccgggccgcaggggcttcccggagctggtcctgggtacacgggacacaggctccaagggggtggcagacgatgtggtgccccccgggcccggacctgctccggaagccccagcccaggaggggcccggcagcggcagcccccgagacacccgccccctctccacgcagcggccactccccccactgtgcagcctggaaaccatcgctgaggagcccgccccaggccctggtcccccgccaccagcggctgtccccaccagctcttctcagggacggcccccataccccacaggacccggagccaatgtggcaagccccctagaggacactgaggagccccgagacagcaggcctcggccgtgcaacggcgagggcgccggcggggcatacgagagggcccccggcagccagacggacggcaggagccagccccggaccctgggccacctgcccgtgattagaagggtgaagagtgaggggcaggtgcccacggagcccctgggagggtggcggcccctggccgctccctttccagctcctgccgtgtactccgatgccacgggcagtgacccgctgtggcagcggctggagccatgtggccaccgagacagcgtttcctcctcctccagcatgtcatccagcgacactgtcattgacctctccctgcccagcctgggcctgggccgcagccgtgagaacctcgctggagcccacatgggacgcctgccccccaggccccactcggcttcggctgcccgcccagacctgccacctgtgaccaagagcaaatccaaccccaaccttcgggctacaggccagcggcctcccatacctgacgaactgcagcccaggtccctggccccaaggatggctggcctccccttccggcctccctggggctgcctttccctggtgggcgtgcaggactgccccgtggctgccaagtccaagagcctgggcgacctcactgctgatgactttgcccctagctttgagggcggctcccgcagactgagccacagcctgggcctcccgggagggacacggcgggtgtcggggccaggggtgagacgggacaccctgacagagcagctgcgctggctcactgtcttccagcaggcaggagacatcacgtcacccaccagcctgggcccggctggggagggggtggcagggggccctggttttgtgcggcgctcctcctcccgcagccacagccgcgtgcgtgccattgccagccgggcccgccaggcccaggagcggcagcagagactgcagggcctgggccggcagggacccccagaagaggagcggggcacccccgagggcgcctgctccgtgggccacgagggcagtgtggatgcaccagcaccctccaagggagccctcgggccagcatccgcggctgctgaaaacctggtcctgctccgcctctgaccgtcagtggtgggaacctgggcggctctggaggcccagggcaggggtgggcgtgttgtttgctcaggaaacagggcagccaggcccccaaaactgtgtccccctggctgccctgtgtcccctccacccctgcctccctcctgcccctgctcccggggaggaaaggctaaagctgctggcccggggcccacaggaggggcttcgaggctggccctgccaggcagttttcccggcgttttaggatctgtacatagagaaatatttaaatttttagaagcaaaacttatacaacattaaaatgataccaagtcc

SEQ ID NO: 15861 - DNA, 568 bp, Homo sapiens
  ENST00000609981
gccctttgctgcggcagctttctgttctccctggctccctgcacggaactgagctttggtgtgtgatgcgctgctggcccaggctacaccccgacaagggacaccgggggccccgggagcagagagacctcagagcagcctcctcctgcctcctgtggacggccggccccagctggtgatcccagccagtcccagctttcagttgctgcccccaccgacagtcctcagtccctccatgatggctcccccgacagccggcccccttcctggcccagctcttccgcctgaggacccagggccggatccggagagcaggtggcttttcttgagcgccaacattctgcccgtggtggagcggtgcatgggtgccatgcaagaggggatgcagatggtgaagctgcgtggcggctccaagggcctggtccgcttctactacctggacgagcaccgctcctgcatccgctggaggccctcacgcaagaacgagaaggccaagatctccatcgactccatccaggaggtgagtgaggggcggcagtcggaggtcttccagcgctaccctgacggc

SEQ ID NO: 15862 - DNA, 5450 bp, Homo sapiens; identical to SEQ ID NO: 15855
  ENST00000449969

SEQ ID NO: 15863 - DNA, 4837 bp, Homo sapiens; identical to SEQ ID NO: 15856
  ENST00000419816

SEQ ID NO: 15864 - DNA, 6453 bp, Homo sapiens; identical to SEQ ID NO: 15857
  ENST00000343889

SEQ ID NO: 15865 - DNA, 3781 bp, Homo sapiens
  ENST00000278878
ggcgcgcacctgggtcactggcctgcgctacctcatggccggcatcagcgacgaggacagcctggctcgccgccagcgcaccagggaccaatggctgaagcagacgtttgacgaggccgacaagaacggggatggcagcctgagcattggcgaggtcctgcagctgctgcacaagctcaacgtgaacctgccccggcagagggtgaagcagatgttcagggaagcggacacggatgaccaccaagggacgctgggttttgaagagttctgtgccttctacaagatgatgtccacccgccgggacctctacctgctcatgctgacctacagcaaccacaaggaccacctggatgccgccagcctgcagcgcttcctgcaggtggagcagaagatggcgggtgtgaccctcgagagctgccaggacatcatcgagcagtttgagccatgcccagaaaacaagagtaaggggctgctgggcattgatggcttcaccaactacaccaggagccctgctggtgacatcttcaaccctgagcaccaccatgtgcaccaggacatgacgcagccgctgagccactacttcatcacctcgtcccacaacacctacctcgtgggtgaccagctcatgtcccagtcacgggtggacatgtatgcttgggtcctgcaggctggctgccgctgcgtggaggtggactgctgggatgggcccgacggggagcccattgtgcaccatggctacactctgacttccaagatcctcttcaaagacgtcattgaaaccatcaacaaatatgccttcatcaagaatgagtacccagtgatcctgtccatcgaaaaccactgcagtgtcatccagcagaagaaaatggcccagtatctgactgacatccttggggacaagctggacctgtcatcagtgagcagtgaagatgccaccacactcccctctccacagatgctcaagggcaagatcctcgtgaaggggaagaagctcccagccaacatcagcgaggatgcggaggaaggcgaggtgtctgatgaggacagtgctgatgagattgacgatgactgcaagctcctcaatggggatgcatccaccaatcgaaagcgtgtagaaaacactgctaagaggaaactggattccctcatcaaagagtcgaagattcgggactgtgaggaccccaacaacttctccgtctccacactgtccccatctggaaagctcggacgcaagagcaaggctgaagaggacgtggagtctggggaggatgccggggccagcagacgcaatggccgcctcgtcgtgggaagcttctccaggcgcaagaagaagggcagcaagctgaagaaggcggccagcgtggaggagggagatgagggtcaggactccccgggaggccagagccgaggggcgacccggcagaagaagaccatgaagctgtcccgggccctctctgacctggtgaagtacaccaagtccgtggccacccacgacatagagatggaggcggcgtccagctggcaggtgtcgtccttcagcgagaccaaggcccaccagattctgcagcagaagccggcgcagtacctacgcttcaaccagcagcagctctcccgcatctacccctcctcctaccgtgtggactccagcaactacaacccgcagcccttctggaacgccggctgccaaatgggcgtgttcaaccccaactcggaggaccccctgcccgggcagctcaagaagcagctggtgctccggatcatcagtggccagcagcttcccaagccgcgcgactccatgctgggggaccgtggggagatcatcgacccctttgtggaggtggagatcattgggctccctgtggactgcagcagggagcagacccgcgtggtggacgacaacgggttcaaccccacctgggaggagaccctggttttcatggtgcacatgccggagatcgcgctggtccgcttcctcgtctgggaccacgatcccatcgggcgtgacttcattggccagaggacgctggccttcagcagcatgatgccaggctacagacacgtgtacctagaagggatggaagaggcctccatcttcgtgcatgtggctgtcagtgacatcagcggtaaggtcaagcaggctctgggcctaaaaggcctcttcctccgaggcccaaagcccggctcgctggacagtcatgctgctgggcggcccccggcccggccctccgttagccagcggatcctgcggcgcacggccagcgccccgaccaagagccagaagccgggccgcaggggcttcccggagctggtcctgggtacacgggacacaggctccaagggggtggcagacgatgtggtgccccccgggcccggacctgctccggaagccccagcccaggaggggcccggcagcggcagcccccgagacacccgccccctctccacgcagcggccactccccccactgtgcagcctggaaaccatcgctgaggagcccgccccaggccctggtcccccgccaccagcggctgtccccaccagctcttctcagggacggcccccataccccacaggacccggagccaatgtggcaagccccctagaggacactgaggagccccgagacagcaggcctcggccgtgcaacggcgagggcgccggcggggcatacgagagggcccccggcagccagacggacggcaggagccagccccggaccctgggccacctgcccgtgattagaagggtgaagagtgaggggcaggtgcccacggagcccctgggagggtggcggcccctggccgctccctttccagctcctgccgtgtactccgatgccacgggcagtgacccgctgtggcagcggctggagccatgtggccaccgagacagcgtttcctcctcctccagcatgtcatccagcgacactgtcattgacctctccctgcccagcctgggcctgggccgcagccgtgagaacctcgctggagcccacatgggacgcctgccccccaggccccactcggcttcggctgcccgcccagacctgccacctgtgaccaagagcaaatccaaccccaaccttcgggctacaggccagcggcctcccatacctgacgaactgcagcccaggtccctggccccaaggatggctggcctccccttccggcctccctggggctgcctttccctggtgggcgtgcaggactgccccgtggctgccaagtccaagagcctgggcgacctcactgctgatgactttgcccctagctttgagggcggctcccgcagactgagccacagcctgggcctcccgggagggacacggcgggtgtcggggccaggggtgagacgggacaccctgacagagcagctgcgctggctcactgtcttccagcaggcaggagacatcacgtcacccaccagcctgggcccggctggggagggggtggcagggggccctggttttgtgcggcgctcctcctcccgcagccacagccgcgtgcgtgccattgccagccgggcccgccaggcccaggagcggcagcagagactgcagggcctgggccggcagggacccccagaagaggagcggggcacccccgagggcgcctgctccgtgggccacgagggcagtgtggatgcaccagcaccctccaagggagccctcgggccagcatccgcggctgctgaaaacctggtcctgctccgcctctgaccgtcagtggtgggaacctgggcggctctggaggcccagggcaggggtgggcgtgttgtttgc

SEQ ID NO: 15866 - DNA, 6986 bp, Homo sapiens; identical to SEQ ID NO: 15858
  ENST00000473964

SEQ ID NO: 15867 - DNA, 2341 bp, Homo sapiens; identical to SEQ ID NO: 15859
  ENST00000462379

SEQ ID NO: 15868 - DNA, 4837 bp, Homo sapiens; identical to SEQ ID NO: 15860
  ENST00000378486

SEQ ID NO: 15869 - DNA, 5125 bp, Homo sapiens
  ENST00000428675
atcgggccgccggcgtccgggctccagaggccgcctggctgggcgcccggtgccttttgtctggcgcagggccggcgtttgcatcacatttcggatacctccctctctttttcgcctctccttctgcctcccgctcacatcgcctccccactcccgccaccgtcccccgccggactgctagcctcctagaccgaagcccgaggacgtctctgcccgagcgatgtcccctctccagaaagttgccgccgccgccgccgccgccgccactgccgccgctgggcggtgaaacaaagtctggcggggccgcctcccggtgcaggagcgcaccggtgcctagcggctggactccgctgccgggcgtcccgctttcccccggggagccctaaacgctccaggccatggccgagggcgcggccggcagggaggatccggcgccgcccgacgcggcggggggcgaagacgacccccgagtgggcccggatgccgccggggactgcgtgacggcggcctctgggggccggatgagggaccgtcgcagcggggtcgcactgccaggcgccgcggggaccccagcggacagcgaggcgggcctcctggaggcagcacgggcgaccccccggcgcagcagcatcatcaaggatccttcaaaccaaaaatgtggtggaagaaagaaaaccgtgtctttcagcagcatgccatcggaaaagaaaattagcagtgcaaatgactgcatcagcttcatgcaagctggctgtgagttgaagaaagtccggccaaattctcgcatttacaaccgttttttcactctggacacagaccttcaagctcttcgctgggaaccttcaaagaaagacctcgagaaagccaagcttgatatttctgccataaaagagatcagactggggaaaaacacggaaacatttagaaacaatggccttgctgaccagatctgtgaggactgtgccttttccatactccacggggaaaactatgagtctctggacctagttgccaattcagcagatgtggcaaacatctgggtgtctgggttacggtacctggtttctcgaagtaagcagcctcttgattttatggagggcaaccagaacacaccacggttcatgtggttgaaaacagtgtttgaagcagcagatgttgatgggaatgggattatgttggaagacacctctgtagagttaataaaacaactcaaccctactctgaaggaagccaagatcaggttaaagtttaaagaaatccagaagagcaaggaaaaactaaccacccgcgtgaccgaagaggaattttgtgaagctttttgtgaactttgcaccaggccagaagtgtatttcttacttgtacagatatctaaaaacaaagaatatttggatgccaatgatctcatgctctttttagaagctgagcaaggagtcacccatatcaccgaggatatatgcttagacatcataaggagatacgaactttctgaagagggacgtcaaaaagggtttcttgcaattgatggctttacccagtatttattgtcatcagaatgtgacatttttgatcctgagcaaaagaaggttgcccaagatatgacccagccattatctcactactatatcaatgcctctcataacacctatctaatagaagaccagttcagggggccagctgacatcaatgggtacattagagctttgaaaatgggctgtcgaagcgttgaactcgatgtaagtgatggttcagataatgaaccaatcctttgtaatcgaaataacatgacaacccatgtttcctttcgaagtgtcatagaggtaataaataaatttgcctttgttgcttctgaatacccactcattctttgcttgggaaatcactgctccttgccgcagcagaaggtaatggctcaacagatgaaaaaggtctttggcaataaactctatactgaagcacctttgccctcagaatcctacctcccatcaccagaaaaattaaaaagaatgatcattgtgaaaggaaagaagttgccttctgatccagatgtgttagaaggagaagtaacagatgaagatgaagaagctgaaatgtctcgaaggatgtcggtagattacaatggtgagcagaagcaaatccgactctgtagggagctctctgatttggtgtctatttgtaaatctgttcaatacagggattttgaactatctatgaaaagccaaaactattgggaaatgtgttcatttagtgaaacagaggccagccgcattgcaaatgagtacccagaggattttgttaattataataagaagttcttatcaagaatctatccaagtgccatgaggatcgattccagtaacttgaatccacaggacttttggaattgtggctgtcagattgtagcaatgaattttcagactccgggtccaatgatggaccttcacacgggctggtttcttcaaaacgggggatgtggttatgttctaaggccgtctataatgcgagatgaagtttcttacttcagcgcaaatacaaagggcattctacctggggtgtctcctctagctcttcatatcaagatcatcagtggtcagaatttcccaaagcccaagggagcttgtgccaaaggggatgtcatagatccctatgtttgtatagagatacacggaattccagcggattgttcggaacaaagaactaaaactgtacagcaaaacagtgataatcctatttttgatgaaacttttgagttccaagtaaacctacctgagctggccatgatccgttttgttgttctggatgatgactacattggggatgagtttatagggcaatatacgataccatttgaatgtttgcagcctggatatcggcatgttcccctgcgttcttttgtgggtgacatcatggagcacgtaaccctttttgtccacatagcaataactaatcgaagtggaggaggaaaggcacagaagcgcagtctttcagtgagaatggggaagaaagttcgggaatataccatgctcaggaatatcggtcttaaaaccattgatgacatctttaaaatagcggttcatccattacgagaagccatagatatgagagaaaatatgcagaatgcaatcgtgtctattaaggaactatgtggactccctccaattgccagtctgaagcagtgcctgttaactctgtcatctcggctcatcaccagtgacaatactccttcagtctcacttgtgatgaaagacagctttccttacctggagcctctgggtgcaattccagatgtgcagaaaaagatgctgactgcttatgatctgatgattcaagagagccggtttctcatagaaatggcggacacagtccaggaaaagattgtacagtgtcagaaagcagggatggagttccatgaagaacttcataatttgggggcaaaagaaggcttgaagggaagaaaactcaacaaagcaactgagagctttgcttggaacattacagtattgaagggccaaggagatctgttgaagaatgccaagaatgaagctatagaaaacatgaagcagatccagctggcatgcctgtcctgtggactgagtaaagcccccagcagcagtgctgaggccaagagcaagcgcagcctggaagccatagaggagaaggaaagtagtgaggagaatgggaagctgtgactctgggcattatcgacacgttcacccatcttatcaaggactctggtttctcattcttgttttctttctttaaatgttttataagttcacaaaatggtgccctatatggggtattggacatagatattttcacaatgtcagtatttcagtgtagttaatttatctaaattaaagcctttagtatcagtgttttaaattctgagacatgtgtcaacacccctgtgtggatgcctgtggaagagtgtgtgtgtgtgtgtgtgtgtgtgtgtgtggcagagagagagaaagagagagagagagagaaattctgttaaaatctattctgtgttgcattattcatttagtgagttattccttgatcattttgggacaattgttttaatctgaaattctaaagagcacttactgtaacctgttgctgtgtttaatttgacttctctgcctttgacatttaatttagtgatcttagcatagcttattattgaaggaagccaaatttatcaaagcatagatgttttggtagattaaatatagattagaaaaattcctaagaatcagagtagaaataaaagtgaatgaaagattaaacagatgatgagaatttctaaaaagattagcaaggtcatttcttcagtcagaaaactttaaaaaatatttattaaataaaatcaatttttaggaagttttctgtagtcatttactaaacatatgatttcactagaaaagctgatcataagtgaatttatacctacctgtgtggtactctgaaacacactgaaagctctgttgcaattaggattttgatgtgacaataatattgttgtataatttcgagatttgtaggaaggtctcattcttccaagctgagagtctagcactcattttctataacagatatggcagcttagaggtgttggctttgtttggatgtaatttagggtactaaatttaaatttaaagatattgttcaaacaatatcatatcatcacattgagctgatataaattctgtgggtccgataatatctttgtgataatttaagagctaaccagttaccacacatctatgatataaccctaacacacacagaaaagcatacatgcaaaaagaaatgactaattagggtacatttataattgcatctaggtaatttttaccctaatgtcttcataaagtacttgagtgtaatgtttgttacctccaacagaactaaatgttctatggttatgaaagaatatatttatttaaagcattgcttttattttgaaaagcttcttaattaatttgattaacaaatatgctaatttggggaaacctagagaagataattgttgaaattttgcaaatataaacatctcctatagcttctgtgttatttctgacttcttaacactattatgtttatgttgcacattactgaaagagtaaagatatgaaaa

SEQ ID NO: 15870 - DNA, 6665 bp, Homo sapiens
  ENST00000435320
atcgggccgccggcgtccgggctccagaggccgcctggctgggcgcccggtgccttttgtctggcgcagggccggcgtttgcatcacatttcggatacctccctctctttttcgcctctccttctgcctcccgctcacatcgcctccccactcccgccaccgtcccccgccggactgctagcctcctagaccgaagcccgaggacgtctctgcccgagcgatgtcccctctccagaaagttgccgccgccgccgccgccgccgccactgccgccgctgggcggtgaaacaaagtctggcggggccgcctcccggtgcaggagcgcaccggtgcctagcggctggactccgctgccgggcgtcccgctttcccccggggagccctaaacgctccaggccatggccgagggcgcggccggcagggaggatccggcgccgcccgacgcggcggggggcgaagacgacccccgagtgggcccggatgccgccggggactgcgtgacggcggcctctgggggccggatgagggaccgtcgcagcggggtcgcactgccaggcgccgcggggaccccagcggacagcgaggcgggcctcctggaggcagcacgggcgaccccccggcgcagcagcatcatcaagatgggactgtgtagttgcaggaaaacagctcagagtttccactgattcttcattatggatccttcaaaccaaaaatgtggtggaagaaagaaaaccgtgtctttcagcagcatgccatcggaaaagaaaattagcagtgcaaatgactgcatcagcttcatgcaagctggctgtgagttgaagaaagtccggccaaattctcgcatttacaaccgttttttcactctggacacagaccttcaagctcttcgctgggaaccttcaaagaaagacctcgagaaagccaagcttgatatttctgccataaaagagatcagactggggaaaaacacggaaacatttagaaacaatggccttgctgaccagatctgtgaggactgtgccttttccatactccacggggaaaactatgagtctctggacctagttgccaattcagcagatgtggcaaacatctgggtgtctgggttacggtacctggtttctcgaagtaagcagcctcttgattttatggagggcaaccagaacacaccacggttcatgtggttgaaaacagtgtttgaagcagcagatgttgatgggaatgggattatgttggaagacacctctgtagagttaataaaacaactcaaccctactctgaaggaagccaagatcaggttaaagtttaaagaaatccagaagagcaaggaaaaactaaccacccgcgtgaccgaagaggaattttgtgaagctttttgtgaactttgcaccaggccagaagtgtatttcttacttgtacagatatctaaaaacaaagaatatttggatgccaatgatctcatgctctttttagaagctgagcaaggagtcacccatatcaccgaggatatatgcttagacatcataaggagatacgaactttctgaagagggacgtcaaaaagggtttcttgcaattgatggctttacccagtatttattgtcatcagaatgtgacatttttgatcctgagcaaaagaaggttgcccaagatatgacccagccattatctcactactatatcaatgcctctcataacacctatctaatagaagaccagttcagggggccagctgacatcaatgggtacattagagctttgaaaatgggctgtcgaagcgttgaactcgatgtaagtgatggttcagataatgaaccaatcctttgtaatcgaaataacatgacaacccatgtttcctttcgaagtgtcatagaggtaataaataaatttgcctttgttgcttctgaatacccactcattctttgcttgggaaatcactgctccttgccgcagcagaaggtaatggctcaacagatgaaaaaggtctttggcaataaactctatactgaagcacctttgccctcagaatcctacctcccatcaccagaaaaattaaaaagaatgatcattgtgaaaggaaagaagttgccttctgatccagatgtgttagaaggagaagtaacagatgaagatgaagaagctgaaatgtctcgaaggatgtcggtagattacaatggtgagcagaagcaaatccgactctgtagggagctctctgatttggtgtctatttgtaaatctgttcaatacagggattttgaactatctatgaaaagccaaaactattgggaaatgtgttcatttagtgaaacagaggccagccgcattgcaaatgagtacccagaggattttgttaattataataagaagttcttatcaagaatctatccaagtgccatgaggatcgattccagtaacttgaatccacaggacttttggaattgtggctgtcagattgtagcaatgaattttcagactccgggtccaatgatggaccttcacacgggctggtttcttcaaaacgggggatgtggttatgttctaaggccgtctataatgcgagatgaagtttcttacttcagcgcaaatacaaagggcattctacctggggtgtctcctctagctcttcatatcaagatcatcagtggtcagaatttcccaaagcccaagggagcttgtgccaaaggggatgtcatagatccctatgtttgtatagagatacacggaattccagcggattgttcggaacaaagaactaaaactgtacagcaaaacagtgataatcctatttttgatgaaacttttgagttccaagtaaacctacctgagctggccatgatccgttttgttgttctggatgatgactacattggggatgagtttatagggcaatatacgataccatttgaatgtttgcagcctggatatcggcatgttcccctgcgttcttttgtgggtgacatcatggagcacgtaaccctttttgtccacatagcaataactaatcgaagtggaggaggaaaggcacagaagcgcagtctttcagtgagaatggggaagaaagttcgggaatataccatgctcaggaatatcggtcttaaaaccattgatgacatctttaaaatagcggttcatccattacgagaagccatagatatgagagaaaatatgcagaatgcaatcgtgtctattaaggaactatgtggactccctccaattgccagtctgaagcagtgcctgttaactctgtcatctcggctcatcaccagtgacaatactccttcagtctcacttgtgatgaaagacagctttccttacctggagcctctgggtgcaattccagatgtgcagaaaaagatgctgactgcttatgatctgatgattcaagagagccggtttctcatagaaatggcggacacagtccaggaaaagattgtacagtgtcagaaagcagggatggagttccatgaagaacttcataatttgggggcaaaagaaggcttgaagggaagaaaactcaacaaagcaactgagagctttgcttggaacattacagtattgaagggccaaggagatctgttgaagaatgccaagaatgaagctatagaaaacatgaagcagatccagctggcatgcctgtcctgtggactgagtaaagcccccagcagcagtgctgaggccaagagcaagcgcagcctggaagccatagaggagaaggaaagtagtgaggagaatgggaagctgtgactctgggcattatcgacacgttcacccatcttatcaaggactctggtttctcattcttgttttctttctttaaatgttttataagttcacaaaatggtgccctatatggggtattggacatagatattttcacaatgtcagtatttcagtgtagttaatttatctaaattaaagcctttagtatcagtgttttaaattctgagacatgtgtcaacacccctgtgtggatgcctgtggaagagtgtgtgtgtgtgtgtgtgtgtgtgtgtgtggcagagagagagaaagagagagagagagagaaattctgttaaaatctattctgtgttgcattattcatttagtgagttattccttgatcattttgggacaattgttttaatctgaaattctaaagagcacttactgtaacctgttgctgtgtttaatttgacttctctgcctttgacatttaatttagtgatcttagcatagcttattattgaaggaagccaaatttatcaaagcatagatgttttggtagattaaatatagattagaaaaattcctaagaatcagagtagaaataaaagtgaatgaaagattaaacagatgatgagaatttctaaaaagattagcaaggtcatttcttcagtcagaaaactttaaaaaatatttattaaataaaatcaatttttaggaagttttctgtagtcatttactaaacatatgatttcactagaaaagctgatcataagtgaatttatacctacctgtgtggtactctgaaacacactgaaagctctgttgcaattaggattttgatgtgacaataatattgttgtataatttcgagatttgtaggaaggtctcattcttccaagctgagagtctagcactcattttctataacagatatggcagcttagaggtgttggctttgtttggatgtaatttagggtactaaatttaaatttaaagatattgttcaaacaatatcatatcatcacattgagctgatataaattctgtgggtccgataatatctttgtgataatttaagagctaaccagttaccacacatctatgatataaccctaacacacacagaaaagcatacatgcaaaaagaaatgactaattagggtacatttataattgcatctaggtaatttttaccctaatgtcttcataaagtacttgagtgtaatgtttgttacctccaacagaactaaatgttctatggttatgaaagaatatatttatttaaagcattgcttttattttgaaaagcttcttaattaatttgattaacaaatatgctaatttggggaaacctagagaagataattgttgaaattttgcaaatataaacatctcctatagcttctgtgttatttctgacttcttaacactattatgtttatgttgcacattactgaaagagtaaagatatgaaaaaaacacttattgttttcttttattgtgaattgaaaaagcaaagctaatgaaaatgggttactacatcaaaaatatcttaaagagtttgctatttccatggaccagatatgatgaaattattccctgggtttaaaactgggcactcgaggaggaggtacctgaagtcatttgaaggcaagtttccaatgatgctacaatggcctgaaaaaatttctttaccctctgttatatttaacttgctggtaggaggaatagtggaatgcaggtgttaagccctttgtggtgaaaaagaggttctatagacagaaacaaaacccaccttacatcagctgattggttgattttactagtgtacctcttcatctacttgaattctatttggtaaatccatgtctttactggatatacagttaggtgggaagaggagataaaggatgacaaactctcaaacaatatttatacatttatttactccagggtcaaatccaatccttggaagtagcttctctagtttattttatttgtcccagagctctactcacacttaggacccacccaaaaattctcaaaaacgtaatatggattctgcctcatctgatgctatttctggcagtgggttgtcagccatactctgcttcattccactgggtgtccttgctagatggggagtgagatgtggagcagggaggagctttggattctgggagtggaggtggcaagggaaaagtctcctagtctcctgtgatgttcctgcctccagatagaatagcaaaaacaaacaatttttttttgtgtattatgcctccatgacattgttacattctatgaggagcatctgtctcctttctagacttgaactgtggtagaaaaagcccccttctctcttctatctacttagatttggtgatgctaggaatgtagtgttttagatattaattctatttttatttattcatttttacatcaccaataggatctgaggtggagatggcgggtattatcactggcattttacaggtgagaaagcccaaagccactgaggtaattaatggaataattgattttgaacttgggtctgtctgatttcatgtgcaagattatatacttagtgattttgattttaagtttattcttaacattttaaaccagactattaactcttacctttataaccacagatacaaagaactgtatcatttattttctgaatataaaatattaatggtcaatataaaaatacaaaaatagagaactatatacaacagaaaagcaaaattacccactaataacattttgatttatatccctttagacactgtttagagtttatacatatatgtaaatatgcttgtattttaacaaaattgagatattatataaactgtttgtagcagggtgtttaaaattttaacaatatgttatggatatctttctgtgtcaataaatgtgtatttacattagagttccaagcatttgaactgaa

SEQ ID NO: 15871 - DNA, 3083 bp, Homo sapiens
  ENST00000487695
attgcagggtctttctgatgtgatttcttatagcacctctcaagaaaatgaagaataaacttcaggatccttcaaaccaaaaatgtggtggaagaaagaaaaccgtgtctttcagcagcatgccatcggaaaagaaaattagcagtgcaaatgactgcatcagcttcatgcaagctggctgtgagttgaagaaagtccggccaaattctcgcatttacaaccgttttttcactctggacacagaccttcaagctcttcgctgggaaccttcaaagaaagacctcgagaaagccaagcttgatatttctgccataaaagagatcagactggggaaaaacacggaaacatttagaaacaatggccttgctgaccagatctgtgaggactgtgccttttccatactccacggggaaaactatgagtctctggacctagttgccaattcagcagatgtggcaaacatctgggtgtctgggttacggtacctggtttctcgaagtaagcagcctcttgattttatggagggcaaccagaacacaccacggttcatgtggttgaaaacagtgtttgaagcagcagatgttgatgggaatgggattatgttggaagacacctctgtagagttaataaaacaactcaaccctactctgaaggaagccaagatcaggttaaagtttaaagaaatccagaagagcaaggaaaaactaaccacccgcgtgaccgaagaggaattttgtgaagctttttgtgaactttgcaccaggccagaagtgtatttcttacttgtacagatatctaaaaacaaagaatatttggatgccaatgatctcatgctctttttagaagctgagcaaggagtcacccatatcaccgaggatatatgcttagacatcataaggagatacgaactttctgaagagggacgtcaaaaagggtttcttgcaattgatggctttacccagtatttattgtcatcagaatgtgacatttttgatcctgagcaaaagaaggttgcccaagatatgacccagccattatctcactactatatcaatgcctctcataacacctatctaatagaagaccagttcagggggccagctgacatcaatgggtacattagagctttgaaaatgggctgtcgaagcgttgaactcgatgtaagtgatggttcagataatgaaccaatcctttgtaatcgaaataacatgacaacccatgtttcctttcgaagtgtcatagaggtaataaataaatttgcctttgttgcttctgaatacccactcattctttgcttgggaaatcactgctccttgccgcagcagaaggtaatggctcaacagatgaaaaaggtctttggcaataaactctatactgaagcacctttgccctcagaatcctacctcccatcaccagaaaaattaaaaagaatgatcattgtgaaaggaaagaagttgccttctgatccagatgtgttagaaggagaagtaacagatgaagatgaagaagctgaaatgtctcgaaggatgtcggtagattacaatggtgagcagaagcaaatccgactctgtagggagctctctgatttggtgtctatttgtaaatctgttcaatacagggattttgaactatctatgaaaagccaaaactattgggaaatgtgttcatttagtgaaacagaggccagccgcattgcaaatgagtacccagaggattttgttaattataataagaagttcttatcaagaatctatccaagtgccatgaggatcgattccagtaacttgaatccacaggacttttggaattgtggctgtcagattgtagcaatgaattttcagactccgggtccaatgatggaccttcacacgggctggtttcttcaaaacgggggatgtggttatgttctaaggccgtctataatgcgagatgaagtttcttacttcagcgcaaatacaaagggcattctacctggggtgtctcctctagctcttcatatcaagatcatcagtggtcagaatttcccaaagcccaagggagcttgtgccaaaggggatgtcatagatccctatgtttgtatagagatacacggaattccagcggattgttcggaacaaagaactaaaactgtacagcaaaacagtgataatcctatttttgatgaaacttttgagttccaagtaaacctacctgagctggccatgatccgttttgttgttctggatgatgactacattggggatgagtttatagggcaatatacgataccatttgaatgtttgcagcctggatatcggcatgttcccctgcgttcttttgtgggtgacatcatggagcacgtaaccctttttgtccacatagcaataactaatcgaagtggaggaggaaaggcacagaagcgcagtctttcagtgagaatggggaagaaagttcgggaatataccatgctcaggaatatcggtcttaaaaccattgatgacatctttaaaatagcggttcatccattacgagaagccatagatatgagagaaaatatgcagaatgcaatcgtgtctattaaggaactatgtggactccctccaattgccagtctgaagcagtgcctgttaactctgtcatctcggctcatcaccagtgacaatactccttcagtctcacttgtgatgaaagacagctttccttacctggagcctctgggtgcaattccagatgtgcagaaaaagatgctgactgcttatgatctgatgattcaagagagccggtttctcatagaaatggcggacacagtccaggaaaagattgtacagtgtcagaaagcagggatggagttccatgaagaacttcataatttgggggcaaaagaaggcttgaagggaagaaaactcaacaaagcaactgagagctttgcttggaacattacagtattgaagggccaaggagatctgttgaagaatgccaagaatgaagctatagaaaacatgaagcagatccagctggcatgcctgtcctgtggactgagtaaagcccccagcagcagtgctgaggccaagagcaagcgcagcctggaagccatagaggagaag

SEQ ID NO: 15872 - DNA, 236 bp, Homo sapiens
  ENST00000625084
gatctgaggtggagatggcgggtattatcactggcattttacagcgatgagtcaacaagaagtttacagcactgagaaagacgagtcaacaacagaaggaaaaaaatccagagaaaatggcacttgctgcattggaatgaaagataatctgcagaaggtaaatggacaggagagattttcatcattttaaatgtatttgcaatgaccatgatttatattaaagtttctcttctctg

SEQ ID NO: 15873 - DNA, 1195 bp, Homo sapiens
  ENST00000472193
tgagaaggaacagtcaaagatattgcaggaagaccagtagtacatggaagtcaaaggagagagcatcaagaaagagatgcgatgagtcaacaagaagtttacagcactgagaaagacgagtcaacaacagaaggaaaaaaatccagagaaaatggcacttgctgcattggaatgaaagataatctgcagaaggacctgctcagtggcaataaacattggcattcttggaaacagtgtttgcctaagaatcttctgtctgcctttgttgctttggccatattatgataagggcatgactggatttaccaaaatgggcatgattggatctacttattctcttatcagacaccttttcctagacaacatcctgaaacataagaataagcacaaaaatgaacatattacatcaaacgtaccactgagaagaatggtaagtttaacagtttcccacgtgggaggcatattgacgattacaattttaagttagcagaacaccagctcacatggaaacagtctcctccgtgaattctttctttggctgacagacatgagatgttagctgtctaagaagaccttcacaccaacaccttcttagaagatattgtaagataacaatccttgagtggaacctgaattctttctaaacactgcatgtaggaaaacaagaggcagttcacacaatcacttaacacctcttcttaaaagtgaatccttgaaggagtggtgttcaaatatttaagtacattagatactttatacacgccacatccaaaatgctcagtattcctaatacatttcattttctcccaagttttaatggttgatgcacaatcacattaatttcctattaatttctaggaatatgtacacagtagccttaggagaaagaagataactattactttacatttttaactgttttgttttcatgtccatgagagaaaaattaaagtaagttaaaaaattaactcagacactctatttatttttaggaagacatacaccccccacagggagacttttacatgttgtaataatgttcacaaacagctactctttaagtgtaacactattctaagcctcttttcctccattttatttcatatacatttatgcatctgcatgcatatataaccacatgtatttatatttagtaggtatagtttattacacataaatctaaatatctatcata

SEQ ID NO: 15874 - DNA, 5979 bp, Homo sapiens
  ENST00000437704
attttacaggatccttcaaaccaaaaatgtggtggaagaaagaaaaccgtgtctttcagcagcatgccatcggaaaagaaaattagcagtgcaaatgactgcatcagcttcatgcaagctggctgtgagttgaagaaagtccggccaaattctcgcatttacaaccgttttttcactctggacacagaccttcaagctcttcgctgggaaccttcaaagaaagacctcgagaaagccaagcttgatatttctgccataaaagagatcagactggggaaaaacacggaaacatttagaaacaatggccttgctgaccagatctgtgaggactgtgccttttccatactccacggggaaaactatgagtctctggacctagttgccaattcagcagatgtggcaaacatctgggtgtctgggttacggtacctggtttctcgaagtaagcagcctcttgattttatggagggcaaccagaacacaccacggttcatgtggttgaaaacagtgtttgaagcagcagatgttgatgggaatgggattatgttggaagacacctctgtagagttaataaaacaactcaaccctactctgaaggaagccaagatcaggttaaagtttaaagaaatccagaagagcaaggaaaaactaaccacccgcgtgaccgaagaggaattttgtgaagctttttgtgaactttgcaccaggccagaagtgtatttcttacttgtacagatatctaaaaacaaagaatatttggatgccaatgatctcatgctctttttagaagctgagcaaggagtcacccatatcaccgaggatatatgcttagacatcataaggagatacgaactttctgaagagggacgtcaaaaagggtttcttgcaattgatggctttacccagtatttattgtcatcagaatgtgacatttttgatcctgagcaaaagaaggttgcccaagatatgacccagccattatctcactactatatcaatgcctctcataacacctatctaatagaagaccagttcagggggccagctgacatcaatgggtacattagagctttgaaaatgggctgtcgaagcgttgaactcgatgtaagtgatggttcagataatgaaccaatcctttgtaatcgaaataacatgacaacccatgtttcctttcgaagtgtcatagaggtaataaataaatttgcctttgttgcttctgaatacccactcattctttgcttgggaaatcactgctccttgccgcagcagaaggtaatggctcaacagatgaaaaaggtctttggcaataaactctatactgaagcacctttgccctcagaatcctacctcccatcaccagaaaaattaaaaagaatgatcattgtgaaaggaaagaagttgccttctgatccagatgtgttagaaggagaagtaacagatgaagatgaagaagctgaaatgtctcgaaggatgtcggtagattacaatggtgagcagaagcaaatccgactctgtagggagctctctgatttggtgtctatttgtaaatctgttcaatacagggattttgaactatctatgaaaagccaaaactattgggaaatgtgttcatttagtgaaacagaggccagccgcattgcaaatgagtacccagaggattttgttaattataataagaagttcttatcaagaatctatccaagtgccatgaggatcgattccagtaacttgaatccacaggacttttggaattgtggctgtcagattgtagcaatgaattttcagactccgggtccaatgatggaccttcacacgggctggtttcttcaaaacgggggatgtggttatgttctaaggccgtctataatgcgagatgaagtttcttacttcagcgcaaatacaaagggcattctacctggggtgtctcctctagctcttcatatcaagatcatcagtggtcagaatttcccaaagcccaagggagcttgtgccaaaggggatgtcatagatccctatgtttgtatagagatacacggaattccagcggattgttcggaacaaagaactaaaactgtacagcaaaacagtgataatcctatttttgatgaaacttttgagttccaagtaaacctacctgagctggccatgatccgttttgttgttctggatgatgactacattggggatgagtttatagggcaatatacgataccatttgaatgtttgcagcctggatatcggcatgttcccctgcgttcttttgtgggtgacatcatggagcacgtaaccctttttgtccacatagcaataactaatcgaagtggaggaggaaaggcacagaagcgcagtctttcagtgagaatggggaagaaagttcgggaatataccatgctcaggaatatcggtcttaaaaccattgatgacatctttaaaatagcggttcatccattacgagaagccatagatatgagagaaaatatgcagaatgcaatcgtgtctattaaggaactatgtggactccctccaattgccagtctgaagcagtgcctgttaactctgtcatctcggctcatcaccagtgacaatactccttcagtctcacttgtgatgaaagacagctttccttacctggagcctctgggtgcaattccagatgtgcagaaaaagatgctgactgcttatgatctgatgattcaagagagccggtttctcatagaaatggcggacacagtccaggaaaagattgtacagtgtcagaaagcagggatggagttccatgaagaacttcataatttgggggcaaaagaaggcttgaagggaagaaaactcaacaaagcaactgagagctttgcttggaacattacagtattgaagggccaaggagatctgttgaagaatgccaagaatgaagctatagaaaacatgaagcagatccagctggcatgcctgtcctgtggactgagtaaagcccccagcagcagtgctgaggccaagagcaagcgcagcctggaagccatagaggagaaggaaagtagtgaggagaatgggaagctgtgactctgggcattatcgacacgttcacccatcttatcaaggactctggtttctcattcttgttttctttctttaaatgttttataagttcacaaaatggtgccctatatggggtattggacatagatattttcacaatgtcagtatttcagtgtagttaatttatctaaattaaagcctttagtatcagtgttttaaattctgagacatgtgtcaacacccctgtgtggatgcctgtggaagagtgtgtgtgtgtgtgtgtgtgtgtgtgtgtggcagagagagagaaagagagagagagagagaaattctgttaaaatctattctgtgttgcattattcatttagtgagttattccttgatcattttgggacaattgttttaatctgaaattctaaagagcacttactgtaacctgttgctgtgtttaatttgacttctctgcctttgacatttaatttagtgatcttagcatagcttattattgaaggaagccaaatttatcaaagcatagatgttttggtagattaaatatagattagaaaaattcctaagaatcagagtagaaataaaagtgaatgaaagattaaacagatgatgagaatttctaaaaagattagcaaggtcatttcttcagtcagaaaactttaaaaaatatttattaaataaaatcaatttttaggaagttttctgtagtcatttactaaacatatgatttcactagaaaagctgatcataagtgaatttatacctacctgtgtggtactctgaaacacactgaaagctctgttgcaattaggattttgatgtgacaataatattgttgtataatttcgagatttgtaggaaggtctcattcttccaagctgagagtctagcactcattttctataacagatatggcagcttagaggtgttggctttgtttggatgtaatttagggtactaaatttaaatttaaagatattgttcaaacaatatcatatcatcacattgagctgatataaattctgtgggtccgataatatctttgtgataatttaagagctaaccagttaccacacatctatgatataaccctaacacacacagaaaagcatacatgcaaaaagaaatgactaattagggtacatttataattgcatctaggtaatttttaccctaatgtcttcataaagtacttgagtgtaatgtttgttacctccaacagaactaaatgttctatggttatgaaagaatatatttatttaaagcattgcttttattttgaaaagcttcttaattaatttgattaacaaatatgctaatttggggaaacctagagaagataattgttgaaattttgcaaatataaacatctcctatagcttctgtgttatttctgacttcttaacactattatgtttatgttgcacattactgaaagagtaaagatatgaaaaaaacacttattgttttcttttattgtgaattgaaaaagcaaagctaatgaaaatgggttactacatcaaaaatatcttaaagagtttgctatttccatggaccagatatgatgaaattattccctgggtttaaaactgggcactcgaggaggaggtacctgaagtcatttgaaggcaagtttccaatgatgctacaatggcctgaaaaaatttctttaccctctgttatatttaacttgctggtaggaggaatagtggaatgcaggtgttaagccctttgtggtgaaaaagaggttctatagacagaaacaaaacccaccttacatcagctgattggttgattttactagtgtacctcttcatctacttgaattctatttggtaaatccatgtctttactggatatacagttaggtgggaagaggagataaaggatgacaaactctcaaacaatatttatacatttatttactccagggtcaaatccaatccttggaagtagcttctctagtttattttatttgtcccagagctctactcacacttaggacccacccaaaaattctcaaaaacgtaatatggattctgcctcatctgatgctatttctggcagtgggttgtcagccatactctgcttcattccactgggtgtccttgctagatggggagtgagatgtggagcagggaggagctttggattctgggagtggaggtggcaagggaaaagtctcctagtctcctgtgatgttcctgcctccagatagaatagcaaaaacaaacaatttttttttgtgtattatgcctccatgacattgttacattctatgaggagcatctgtctcctttctagacttgaactgtggtagaaaaagcccccttctctcttctatctacttagatttggtgatgctaggaatgtagtgttttagatattaattctatttttatttattcatttttacatcaccaataggatctgaggtggagatggcgggtattatcactggcattttacaggtgagaaagcccaaagccactgaggtaattaatggaataattgattttgaacttgggtctgtctgatttcatgtgcaagattatatacttagtgattttgattttaagtttattcttaacattttaaaccagactattaactcttacctttataaccacagatacaaagaactgtatcatttattttctgaatataaaatattaatggtcaatataaaaatacaaaaatagagaactatatacaacagaaaagcaaaattacccactaataacattttgatttatatccctttagacactgtttagagtttatacatatatgtaaatatgcttgtattttaacaaaattgagatattatataaactgtttgtagcagggtgtttaaaattttaacaatatgttatggatatctttctgtgtcaataaatgtgtatttacattagagttccaagcatttgaactgaa

SEQ ID NO: 15875 - DNA, 7704 bp, Homo sapiens
  ENST00000377801
attggattagcggcagcagcctgccagcctgcccgaggagtgctgggaccagcgcgctgcacgccgactggcacgatggcctcgtctcaggggaaaaacgagctgaaattagccgactggatggcaactctgccggagagcatgcacagcatccccctcaccaatttagccattccagggtctcatgattccttcagcttctacattgatgaagcctctccagtaggtcctgagcagccagaaactgtccagaattttgtctctgtgtttggaactgtggccaaaaagctcatgcggaaatggttagccactcagacaatgaattttactggccagctaggagctggaattcgttattttgatcttcgaatttccaccaagcccagagaccccgacaatgaactctattttgctcatggtttgttcagtgccaaagtcaatgaaggccttgaggagatcaatgcattcctcacagatcaccataaggaggtagtgttcttggacttcaaccacttttatgggatgcagaaatatcaccatgaaaaactggtccaaatgctgaaagacatctatggaaataaaatgtgcccagcgatttttgcccaggaagttagtttaaagtacctgtgggagaaggactatcaagtgctggtcttctaccatagtccagtggctctggaagtgccctttctctggcctgggcagatgatgccagcaccctgggccaacaccacagaccccgagaaactgatccagtttcttcaagcatccatcactgagagaagaaagaagggatcgttttttatatctcaggtggtgctgacccccaaagctagcactgtggtcaaaggggtggcaagtggcctcagagaaacaatcacagaaagagctcttcctgccatgatgcagtgggtccgcacgcagaagccaggagagagtggcatcaatattgtcactgccgattttgtagaacttggtgactttatcagcactgtcataaagctcaactatgtctttgatgaaggagaagccaacacttgatagcactacttggagtttccatgaataagatggagaaagctcattgtattagggcatactatctgtaaacactctgatcttcctattccactgagtctctgaagggaatagggctggtagtgggtgggaaaaggggaaaaactgtttcttcagtgattacaatcatactcttcattactataaatatttcatttcccatttgatgagcaaaatctacttctagtgttaggaataaaaaaaaaagaccagtaactttgtttttcaaaattagtctttgtaacatagaattcatgagtgtttacttgattaggttctctatttccagcctatgactcctacgctgtctataccctgcaacctttctgctccctctcttgctcgctctttttaatcagatgctgtatgggaatcaaaacaattgaatgcccaacattttgtgtattacattgttgtcttaaaacttactagttttgtgggacttgttataatgctctatagtcatccacagttgggcaatcatagctaatttttggtcatagaaaatctgcatcaaatcagtttccatgcatcagtaatattgaaggtcataatcagtgatttttgttatatgaaaataatagtgtttcacagtatttctatttaaggcagctataaatataggagaaaaatgtttttggagagctgtgaatgccaatttcagagggaaaaatggttgaggggtgaaagagatgtatggcattttaatttggcaatctcttaaataatattgccctgcaagtacccagtaaatggtaaggtacaagtgtgttaaaattgaaaactctgaaaataactctttaaaaagccctcttaatgatgctcttgatgaaagaaaaagacagaaggaaggaaggaaggaaggaaggaaggaaggaaggaaggaaggaaggaaaggaagaaaggaagggagggaggaagggagggaagaagggagggaaggacagaaggaaggacgggaggaaggaaggaagggaggaaggaaggaaggaagagagggagggagggaggaagagagggagggagggaggaagagaggaaggaagaagaaaaagactgcaagctttcctgccaatttgggattttcaaatatttaattctaaattccagattttaaggaagatttttcaagaaactgcaagtttttgacttgaaggaaagaaagaggaaggctggtagaagcagttagagcaatgtgtttgaaattatgtccatgaaatcacagggatctctgaaatatctttaggaaacttgaaatttatgaggtctgaatggacttgtttaaaattggctctgactcctcacttctgagtttcatcctatccgagggatgagattaaggcagaggcaaaagtttcacacaaagtttctgcaacctaacgtttaatagtccgggtctacagggaagaacaatgacacagcttgagcgttacttcctccttcgtgtcattgtgatatttgacaactctaaaaaataaaaaaaaaaaacttagagcacaataatccttgcctatgtacttcacaggaatattgtgaggtgtttataaaattataaaatttgatgaaattcttacaattattaattattttattttcatgtttagaaataatcacaccccaatagtttcctaggataatacagtccatgcaaagtagggtcatagagaaataaaagcatgccctcagcttttaatgaacttaaatgtagcacatatggcttaatctcttagacttagataagggagttcaattcaaaaccatatatgtcaagaccacaaataatcaagagttgatttcaagattataaatactcatgatcagaaaatagtacttattagcaattaaagggaggaaaagaaattgtttatactgaagagaatgtttatgaggagtgtgtatgtacctgtggtataccaaatagcatacatgtacacacaaaaatgtgtgtatacatttgggttgtgtgtatacatcttgccatatacaatatacaaacatatgcccattcctgtgatagcatacaaattcaaacatacagaaacacacacagatatggacacagtacaattcttcttttcaaatgaagacattgataatattaaataatttaattttaagactgaaacccttaatattgtgtgaaaaagagtaataaaacctttgaaagtagagtagatgatcacatcaaagtatttttgtaaaagaattctagtgtaggacttaattatttttaaaatatatttcttctcttctttccattttcccttcccttgtagttttattatctttctgtcttttacacctgctctttatgtgaaaatgtatatgaatccttttaaaatgattaggattattgaaatgtatgtcccgtaaatttggtttttgggcagactttctctctaactggctattcattcatccttcaggaggatcttagccaagaatatttgcaatgacacatgaatttaattttataaatataatggaaaacagatttttcatcatatcatgaataaaatatagaggtaactatgttgtattttcttgaacctagatactttctcatagtgtttgcttagaattaactttgtcctatttgtcaactgggttctggaaaaaaacaaacatgatgaagcttttgaataattgtgcagttttttaactagggaaagctttgtactgctgctaatgatatgcacccagaaaccttgttagacaaaaggcagtttcaagccaatgctatggtttccatgtggacatacagtgcctatgtagcaggcacttagagtaaatggacttgccttaatttataaaggagggaagaggtagaagggaaccatgggtcctccagctagagggggagtttactaaaagggagtccttggaaaggggaatggagagaaggtgcctttgactgtcttctatccattagttctgccctggagcacactggggaagcaggctgcgggccttccaaaagtaaaaaatggtgatatgcaatcgaagcttatccttagcctatgcacatttgtctcagctgggcattgtcttttcagagagcttgtagcacaagggctacacatgggcgccaagatggtggtagatacaccttggtgcactttttgttttacttgtttcttaagactatttcacaagtcctgtgaggcaaaaaaacaaaacaaaacaaaacaaccaaacaaatacaatctaacttttacccaatctacagcaggaaatcaaaggagtgggtggaatgagagaaaatatgcaaagagatcatttttaagtttgatttcctgtctgtaattttcaaggactaatatagcaaatttttcttctgccattatcatttatgtctccctatttaccacacaataatgtaaatgcagagaatgaggaggcatcttttaaaagccttaggatattctatatgatgacctcaatattgactttcagccatactgggaaaacttacttttcatggagtgccacctaacagtgaatgtattagagtataaaatgtttgccatgtatacacctgtatgtgcacatacacacattacacacacacacagaatgcacatttcacacacatatacttattattcaagttgaaactgcactctaatcaatctgagtctattgctgtttcaactcttaaaatcaatatctcctacattagtagatataaacataattcaaatatttaaatatttaagaggagaaaagtaactagaaaaccaatgaaaagtgaggccatcagaaatagaaaatgcctggcacgaacagtctatctaaattctcaatttcacttcaaattagagaatccataatggactagaatataaattacaaacacatacacacatcttcacttaaagttgttttaagttctttgaagttctgacatgtttttagccagggttatttgttcaggttcttccttgttaggattccagactggaaagttggaagtctcaggaaatgcatgtttccatgagttttttagtttcacagttttacagatccaacgacacaatcttttaatctttggtcactcaaccaaacaggagttccgtaggcagagtgctcactttgaattgctaatagaaaataatgcacagtgtcctcaggatatgctaaacaaggtttttaagagcattttattttacagcactttagtcttttcagctagatttcagtgacactatggtgtaaatgctatatctgccataacttattggtggctcctgtgttacatacagttttaaataatgctctaaattgtttgttttcccaatgataatgataaagtgttctgtagaatttgtaaaacatgtcaattgaatctgttgaaaattgtgtaattgttatttcaattgtgatactattttgtaggtaatagttttaaacgtatatttgtatgagtcaaaagtatgtgcttgtatgtggtatgtgtgtgtaagtatataatatcttatcaaaaatcaaacttatcctaaagaaaaagggcacattgtgaccagccttaatttattaacacttttttgttgtttttgcaatttggatttaaaattgaaacagaaattaagtttttgttaaaaatggtgtcttttaattttgtgaggaatgggctttagaacctatctgagttcccacaagcaaactgtccaccttgtgaggtaccccattgcttttcgtaataatcaaacatcaattcatatattaacttcattttcatacagactaatttgttttcatcaacaatagaaccagtacacctttaaagttgaccttcccaacatggcacccatttttctttaatgataaattttccatgaaaaattgtttctccaaaccattactttttaaaattcaatcttcccaagtaagatgaactgccttggtgttaggagagcttttaaaggcccatccatactaggtggttccaacatggttctcttctcgagaaaacaagcatgcaacccacacacttttctggtctgccccacgtgtagaattagtctagcaatagaaaactcatgactgacaaggatctacacatgtggtcatgcttgaagcaaaaattctgtgaccttctttgggcttggatctgattacagaatattaattaactttcttatttcctttctttctccatccttagttattccttttcaatatttagagttgccaggtaaaatacaggatatccagtgaaatttaaatttcagataaacagtatttctttagcatatttctcatatatttaatcagacatactttcactttaaaaaaagtttatctgaaattcaaatgtaactgggtatgtcctatatattttttcctaaatctcacaattctatccacactgcctttctatctttttcagctgggctatctataaggggcgagatctacctccctccatacccttgtgttcagacaccttatgaatatctgcagtcataatgtccttcaagaaagaaaacattggtcagctctaggtcctgcaaatgctttttgaaggacgaactcaaatacagatgggataatcaagtaaatatcttcataggatcaatgccaccatgttcaacacttccctttgccagcctgttgtgaggtccaagtttccccattaatcccttatatagcatttcccagtaactgggacaaccaaaaacacaccgacatattagaaatgctcctgaaaagtggcaacaccgcctaactcagtaccaggacctcttttaaattcaatttcttttttctttcagagagataacaaacgaattcattatttcccccattcacatcttaccacaaattatttttatcaggttaaaactggtcatctacggaattgtagaaaggtgacataggaactgtcttcactgctggaagaataaaagagtctgaggtatagacactgccctggtgacaccttctcagaacattgttgggggacaggggaggcaggcgcaagtaggggatagaatctgaccctgacatgcagctatcacctggcagagagactcgtcaaagcaaattataacgaccagtactatttttttttggaattgaaaacccaagaagccctaaaataagaacagtgagatcaaaggctggtttctaaaacaatgcagaaaatagaaccatgttggaattcctaaattctagctttcaaatactactgtttccaacagtgaatccttgacagagactgaatgcagatggaattttgaaacattttcagtagctacctcctctcctgaaattcctataagtggcagaggaaaatccaaatcctttaatataacatgtccatctcatgactcctgcttacacacatttgtgttgatttgcttcatttctggaggatgggaatttgcagagctggtgacatttccttcattagacaccagaaattcaccagagagagacagatctgtgccttctctttttaggatctggttattgatactttaataaatgtggtgtaaagaaaatccatggctacagtctgtatagaaaatgtgaattttttaaataagattgtgttcttaatgtaaaaaataaaagtttatttgtattcagtgaaatgcctaataaagtcctggtaccaat

SEQ ID NO: 15876 - DNA, 7538 bp, Homo sapiens
  ENST00000328457
gtaaactctagcggggctagagcaaacattggattagcggcagcagcctgccagcctgcccgaggagtgctgggaccagcgcgctgcacgccgactggcacgatggcctcgtctcaggggaaaaacgagctgaaattagccgactggatggcaactctgccggagagcatgcacagcatccccctcaccaatttagccattccagggtctcatgattccttcagcttctacattgatgaagcctctccagtaggtcctgagcagccagaaactgtccagaattttgtctctgtgtttggaactgtggccaaaaagctcatgcggaaatggttagccactcagacaatgaattttactggccagctaggagctggaattcgttattttgatcttcgaatttccaccaagcccagagaccccgacaatgaactctattttgctcatggtttgttcagtgccaaagtcaatgaaggccttgaggagatcaatgcattcctcacagatcaccataaggaggtagtgttcttggacttcaaccacttttatgggatgcagaaatatcaccatgaaaaactggtccaaatgctgaaagacatctatggaaataaaatgtgcccagcgatttttgcccaggaagttagtttaaagtacctgtgggagaaggactatcaagtgctggtcttctaccatagtccagtggctctggaagtgccctttctctggcctgggcagatgatgccagcaccctgggccaacaccacagaccccgagaaactgatccagtttcttcaagcatccatcactgagagaagaaagaagggatcgttttttatatctcaggtggtgctgacccccaaagctagcactgtggtcaaaggggtggcaagtggcctcagagaaacaatcacagaaagagctcttcctgccatgatgcagtgggtccgcacgcagaagccaggagagagtggcatcaatattgtcactgccgattttgtagaacttggtgactttatcagcactgtcataaagctcaactatgtctttgatgaaggagaagccaacacttgatagcactacttggagtttccatgaataagatggagaaagctcattgtattagggcatactatctgtaaacactctgatcttcctattccactgagtctctgaagggaatagggctggtagtgggtgggaaaaggggaaaaactgtttcttcagtgattacaatcatactcttcattactataaatatttcatttcccatttgatgagcaaaatctacttctagtgttaggaataaaaaaaaaagaccagtaactttgtttttcaaaattagtctttgtaacatagaattcatgagtgtttacttgattaggttctctatttccagcctatgactcctacgctgtctataccctgcaacctttctgctccctctcttgctcgctctttttaatcagatgctgtatgggaatcaaaacaattgaatgcccaacattttgtgtattacattgttgtcttaaaacttactagttttgtgggacttgttataatgctctatagtcatccacagttgggcaatcatagctaatttttggtcatagaaaatctgcatcaaatcagtttccatgcatcagtaatattgaaggtcataatcagtgatttttgttatatgaaaataatagtgtttcacagtatttctatttaaggcagctataaatataggagaaaaatgtttttggagagctgtgaatgccaatttcagagggaaaaatggttgaggggtgaaagagatgtatggcattttaatttggcaatctcttaaataatattgccctgcaagtacccagtaaatggtaaggtacaagtgtgttaaaattgaaaactctgaaaataactctttaaaaagccctcttaatgatgctcttgatgaaagaaaaagacagaaggaaggaagaagaaaaagactgcaagctttcctgccaatttgggattttcaaatatttaattctaaattccagattttaaggaagatttttcaagaaactgcaagtttttgacttgaaggaaagaaagaggaaggctggtagaagcagttagagcaatgtgtttgaaattatgtccatgaaatcacagggatctctgaaatatctttaggaaacttgaaatttatgaggtctgaatggacttgtttaaaattggctctgactcctcacttctgagtttcatcctatccgagggatgagattaaggcagaggcaaaagtttcacacaaagtttctgcaacctaacgtttaatagtccgggtctacagggaagaacaatgacacagcttgagcgttacttcctccttcgtgtcattgtgatatttgacaactctaaaaaataaaaaaaaaaaacttagagcacaataatccttgcctatgtacttcacaggaatattgtgaggtgtttataaaattataaaatttgatgaaattcttacaattattaattattttattttcatgtttagaaataatcacaccccaatagtttcctaggataatacagtccatgcaaagtagggtcatagagaaataaaagcatgccctcagcttttaatgaacttaaatgtagcacatatggcttaatctcttagacttagataagggagttcaattcaaaaccatatatgtcaagaccacaaataatcaagagttgatttcaagattataaatactcatgatcagaaaatagtacttattagcaattaaagggaggaaaagaaattgtttatactgaagagaatgtttatgaggagtgtgtatgtacctgtggtataccaaatagcatacatgtacacacaaaaatgtgtgtatacatttgggttgtgtgtatacatcttgccatatacaatatacaaacatatgcccattcctgtgatagcatacaaattcaaacatacagaaacacacacagatatggacacagtacaattcttcttttcaaatgaagacattgataatattaaataatttaattttaagactgaaacccttaatattgtgtgaaaaagagtaataaaacctttgaaagtagagtagatgatcacatcaaagtatttttgtaaaagaattctagtgtaggacttaattatttttaaaatatatttcttctcttctttccattttcccttcccttgtagttttattatctttctgtcttttacacctgctctttatgtgaaaatgtatatgaatccttttaaaatgattaggattattgaaatgtatgtcccgtaaatttggtttttgggcagactttctctctaactggctattcattcatccttcaggaggatcttagccaagaatatttgcaatgacacatgaatttaattttataaatataatggaaaacagatttttcatcatatcatgaataaaatatagaggtaactatgttgtattttcttgaacctagatactttctcatagtgtttgcttagaattaactttgtcctatttgtcaactgggttctggaaaaaaacaaacatgatgaagcttttgaataattgtgcagttttttaactagggaaagctttgtactgctgctaatgatatgcacccagaaaccttgttagacaaaaggcagtttcaagccaatgctatggtttccatgtggacatacagtgcctatgtagcaggcacttagagtaaatggacttgccttaatttataaaggagggaagaggtagaagggaaccatgggtcctccagctagagggggagtttactaaaagggagtccttggaaaggggaatggagagaaggtgcctttgactgtcttctatccattagttctgccctggagcacactggggaagcaggctgcgggccttccaaaagtaaaaaatggtgatatgcaatcgaagcttatccttagcctatgcacatttgtctcagctgggcattgtcttttcagagagcttgtagcacaagggctacacatgggcgccaagatggtggtagatacaccttggtgcactttttgttttacttgtttcttaagactatttcacaagtcctgtgaggcaaaaaaacaaaacaaaacaaaacaaccaaacaaatacaatctaacttttacccaatctacagcaggaaatcaaaggagtgggtggaatgagagaaaatatgcaaagagatcatttttaagtttgatttcctgtctgtaattttcaaggactaatatagcaaatttttcttctgccattatcatttatgtctccctatttaccacacaataatgtaaatgcagagaatgaggaggcatcttttaaaagccttaggatattctatatgatgacctcaatattgactttcagccatactgggaaaacttacttttcatggagtgccacctaacagtgaatgtattagagtataaaatgtttgccatgtatacacctgtatgtgcacatacacacattacacacacacacagaatgcacatttcacacacatatacttattattcaagttgaaactgcactctaatcaatctgagtctattgctgtttcaactcttaaaatcaatatctcctacattagtagatataaacataattcaaatatttaaatatttaagaggagaaaagtaactagaaaaccaatgaaaagtgaggccatcagaaatagaaaatgcctggcacgaacagtctatctaaattctcaatttcacttcaaattagagaatccataatggactagaatataaattacaaacacatacacacatcttcacttaaagttgttttaagttctttgaagttctgacatgtttttagccagggttatttgttcaggttcttccttgttaggattccagactggaaagttggaagtctcaggaaatgcatgtttccatgagttttttagtttcacagttttacagatccaacgacacaatcttttaatctttggtcactcaaccaaacaggagttccgtaggcagagtgctcactttgaattgctaatagaaaataatgcacagtgtcctcaggatatgctaaacaaggtttttaagagcattttattttacagcactttagtcttttcagctagatttcagtgacactatggtgtaaatgctatatctgccataacttattggtggctcctgtgttacatacagttttaaataatgctctaaattgtttgttttcccaatgataatgataaagtgttctgtagaatttgtaaaacatgtcaattgaatctgttgaaaattgtgtaattgttatttcaattgtgatactattttgtaggtaatagttttaaacgtatatttgtatgagtcaaaagtatgtgcttgtatgtggtatgtgtgtgtaagtatataatatcttatcaaaaatcaaacttatcctaaagaaaaagggcacattgtgaccagccttaatttattaacacttttttgttgtttttgcaatttggatttaaaattgaaacagaaattaagtttttgttaaaaatggtgtcttttaattttgtgaggaatgggctttagaacctatctgagttcccacaagcaaactgtccaccttgtgaggtaccccattgcttttcgtaataatcaaacatcaattcatatattaacttcattttcatacagactaatttgttttcatcaacaatagaaccagtacacctttaaagttgaccttcccaacatggcacccatttttctttaatgataaattttccatgaaaaattgtttctccaaaccattactttttaaaattcaatcttcccaagtaagatgaactgccttggtgttaggagagcttttaaaggcccatccatactaggtggttccaacatggttctcttctcgagaaaacaagcatgcaacccacacacttttctggtctgccccacgtgtagaattagtctagcaatagaaaactcatgactgacaaggatctacacatgtggtcatgcttgaagcaaaaattctgtgaccttctttgggcttggatctgattacagaatattaattaactttcttatttcctttctttctccatccttagttattccttttcaatatttagagttgccaggtaaaatacaggatatccagtgaaatttaaatttcagataaacagtatttctttagcatatttctcatatatttaatcagacatactttcactttaaaaaaagtttatctgaaattcaaatgtaactgggtatgtcctatatattttttcctaaatctcacaattctatccacactgcctttctatctttttcagctgggctatctataaggggcgagatctacctccctccatacccttgtgttcagacaccttatgaatatctgcagtcataatgtccttcaagaaagaaaacattggtcagctctaggtcctgcaaatgctttttgaaggacgaactcaaatacagatgggataatcaagtaaatatcttcataggatcaatgccaccatgttcaacacttccctttgccagcctgttgtgaggtccaagtttccccattaatcccttatatagcatttcccagtaactgggacaaccaaaaacacaccgacatattagaaatgctcctgaaaagtggcaacaccgcctaactcagtaccaggacctcttttaaattcaatttcttttttctttcagagagataacaaacgaattcattatttcccccattcacatcttaccacaaattatttttatcaggttaaaactggtcatctacggaattgtagaaaggtgacataggaactgtcttcactgctggaagaataaaagagtctgaggtatagacactgccctggtgacaccttctcagaacattgttgggggacaggggaggcaggcgcaagtaggggatagaatctgaccctgacatgcagctatcacctggcagagagactcgtcaaagcaaattataacgaccagtactatttttttttggaattgaaaacccaagaagccctaaaataagaacagtgagatcaaaggctggtttctaaaacaatgcagaaaatagaaccatgttggaattcctaaattctagctttcaaatactactgtttccaacagtgaatccttgacagagactgaatgcagatggaattttgaaacattttcagtagctacctcctctcctgaaattcctataagtggcagaggaaaatccaaatcctttaatataacatgtccatctcatgactcctgcttacacacatttgtgttgatttgcttcatttctggaggatgggaatttgcagagctggtgacatttccttcattagacaccagaaattcaccagagagagacagatctgtgccttctctttttaggatctggttattgatactttaataaatgtggtgtaaagaaaatccatggctacagtctgtatagaaaatgtgaattttttaaataagattgtgttcttaatgtaaaaaataaaagtttatttgtattcagtgaaatgcctaataaagtcctggtacc

SEQ ID NO: 15877 - DNA, 694 bp, Homo sapiens
  ENST00000463281
tgtgattaggcccacctgatcaaatgtaaaaacatgcatgggatatttgattacgtaacaaccagctaaaactgagagcacacagccttcggaaacccccaaggtgtcgaggaggatcagatccagataagagaagatgattccttctagtcctgtaaaatttcctgtcatccttagctgctgggttgattgaaatttgatctctacatttcaaaatcaaactagtgaatacagtttgtctttcaagagaatcagaggcatcgtaactcctaccaagttaatgaggaaactgaggctcagatcagatgagaactcacttaaatccactcaatgtgtagatggtagagctgggactagcaacattgctgcagcccattgttggcctctctcttcactttatcattgcccaagaatgaggatatgcagtaaacagaattcagtagcagtttacatagtacagcattctgcaaaaattgcatgaaatgtggacacaagatgtactgtatgacttaattacctgtcattctctgacaccattactacctactagaagttcaaataatttatctttaacattgcaatatctgataaactttttaaaatgtaaataattcaaagccttgaaaatctatcatgaatctgctcaacatttcaaagtgactattttgaaatgcctataaatgctatatacctg

SEQ ID NO: 15878 - DNA, 5855 bp, Homo sapiens
  ENST00000356327
ccgccaacgcgcaggtgctagcggccccttcgccctgcagcccctttgcttttactctgtccaaagttaacatgtcactgaaaaacgagccacgggtaaatacctctgcactgcagaaaattgctgctgacatgagtaatatcatagaaaatctggacacgcgggaactccactttgagggagaggaggtagactacgacgtgtctcccagcgatcccaagatacaagaagtgtatatccctttctctgctatttataacactcaaggatttaaggagcctaatatacagacgtatctctccggctgtccaataaaagcacaagttctggaagtggaacgcttcacatctacaacaagggtaccaagtattaatctttacactattgaattaacacatggggaatttaaatggcaagttaagaggaaattcaagcattttcaagaatttcacagagagctgctcaagtacaaagcctttatccgcatccccattcccactagaagacacacgtttaggaggcaaaacgtcagagaggagcctcgagagatgcccagtttgccccgttcatctgaaaacatgataagagaagaacaattccttggtagaagaaaacaactggaagattacttgacaaagatactaaaaatgcccatgtatagaaactatcatgccacaacagagtttcttgatataagccagctgtctttcatccatgatttgggaccaaagggcatagaaggtatgataatgaaaagatctggaggacacagaataccaggcttgaattgctgtggtcagggaagagcctgctacagatggtcaaaaagatggttaatagtgaaagattcctttttattgtatatgaaaccagacagcggtgccattgccttcgtcctgctggtagacaaagaattcaaaattaaggtggggaagaaggagacagaaacgaaatatggaatccgaattgataatctttcaaggacacttattttaaaatgcaacagctatagacatgctcggtggtggggaggggctatagaagaattcatccagaaacatggcaccaactttctcaaagatcatcgatttgggtcatatgctgctatccaagagaatgctttagctaaatggtatgttaatgccaaaggatattttgaagatgtggcaaatgcaatggaagaggcaaatgaagagatttttatcacagactggtggctgagtccagaaatcttcctgaaacgcccagtggttgagggaaatcgttggaggttggactgcattcttaaacgaaaagcacaacaaggagtgaggatcttcataatgctctacaaagaggtggaactcgctcttggcatcaatagtgaatacaccaagaggactttgatgcgtctacatcccaacataaaggtgatgagacacccggatcatgtgtcatccaccgtctatttgtgggctcaccatgagaagcttgtcatcattgaccaatcggtggcctttgtgggagggattgacctggcctatggaaggtgggacgacaatgagcacagactcacagacgtgggcagtgtgaagcgggtcacttcaggaccgtctctgggttccctcccacctgccgcaatggagtctatggaatccttaagactcaaagataaaaatgagcctgttcaaaacctacccatccagaagagtattgatgatgtggattcaaaactgaaaggaataggaaagccaagaaagttctccaaatttagtctctacaagcagctccacaggcaccacctgcacgacgcagatagcatcagcagcattgacagcacctccaataccgggtccatccgtagtttacagacaggtgtgggagagctgcatggggaaaccagattctggcatggaaaggactactgcaatttcgtcttcaaagactgggttcaacttgataaaccttttgctgatttcattgacaggtactccacgccccggatgccctggcatgacattgcctctgcagtccacgggaaggcggctcgtgatgtggcacgtcacttcatccagcgctggaacttcacaaaaattatgaaatcaaaatatcggtccctttcttatccttttctgcttccaaagtctcaaacaacagcccatgagttgagatatcaagtgcctgggtctgtccatgctaacgtacagttgctccgctctgctgctgattggtctgctggtataaagtaccatgaagagtccatccacgccgcttacgtccatgtgatagagaacagcaggcactatatctatatcgaaaaccagtttttcataagctgtgctgatgacaaagttgtgttcaacaagataggcgatgccattgcccagaggatcctgaaagctcacagggaaaaccagaaataccgggtatatgtcgtgataccacttctgccagggttcgaaggagacatttcaaccggcggaggaaatgctctacaggcaatcatgcacttcaactacagaaccatgtgcagaggagaaaattccatccttggacagttaaaagcagagcttggtaatcagtggataaattacatatcattctgtggtcttagaacacatgcagagctcgaaggaaacctagtaactgagcttatctatgtccacagcaagttgttaattgctgatgataacactgttattattggctctgccaacataaatgaccgcagcatgctgggaaagcgtgacagtgaaatggctgtcattgtgcaagatacagagactgttccttcagtaatggatggaaaagagtaccaagctggccggtttgcccgaggacttcggctacagtgctttagggttgtccttggctatcttgatgacccaagtgaggacattcaggatccagtgagtgacaaattcttcaaggaggtgtgggtttcaacagcagctcgaaatgctacaatttatgacaaggttttccggtgccttcccaatgatgaagtacacaatttaattcagctgagagactttataaacaagcccgtattagctaaggaagatcccattcgagctgaggaggaactgaagaagatccgtggatttttggtgcaattccccttttatttcttgtctgaagaaagcctactgccttctgttgggaccaaagaggccatagtgcccatggaggtttggacttaagagatattcattggcagctcaaagacttccaccctggagaccacactgcacacagtgacttcctggggatgtcatagccaaagccaggcctgacgcattctcgtatccaacccaaggaccttttggaatgactggggagggctgcagtcacattgatgtaaggactgtaaacatcagcaagactttataattccttctgcctaacttgtaaaaagggggctgcattcttgttggtagcatgtactctgttgagtaaaacacatattcaaattccgtataccaaaatccatttcctttgtaacaagaatttaccagtaactgtgatctaggttgccaaaagttgtctgaatctccttattcttctctgatcttcatttatgcagccaatgtctagctggacctgccctcatcttgcagttcatacaggcactgtttgagagattgtttattattagatgttgtaatgctgcttcaagattcttcatggttacatgggatgcccctgctcatctggtcctgaagtagtaacattcacccaaatgaggatatagtcattattccttttcagtcactgtacgaacacggcagactttagcctacacagtagactgtgttaggcacttctggtaacattgacactgtatcttgacaccactaagcaacaggaaggaataaattccaatattgagacagagatttatttcattttgctcccaaaggcactgacaacatgagtccttgtgattaggcccacctgatcaaatgtaaaaacatgcatgggatatttgattacgtaacaaccagctaaaactgagagcacacagccttcggaaacccccaaggtgtcgaggaggatcagatccagataagagaagatgattccttctagtcctgtaaaatttcctgtcatccttagctgctgggttgattgaaatttgatctctacatttcaaaatcaaactagtgaatacagtttgtctttcaagagaatcagaggcatcgtaactcctaccaagttagtaagtatgagtctaaccttgtttgacattcaggtcttctgctacattatcttctttgagaaaaattaattgattataaaatatgtgctacttcacttacattattaaatatgtattaacgcctctcaccagggcttccagtgaagttacaatgccctagtctgtgaattagtctggaaacgtgtttttccttttcggatgttagagtaccctttgataaactaaattttactaagctgaacaactctgacagtctaaagagctaatgtgggttaccaaaaggcctgtacctgtaaaacaaaatgcaggtgtaatgattatacatgtctatggattacctggacatactctcatttgggttgttcttcaaagaagcaagcagccgatccctgttttcataaagctaatacttcagttggaaaaattaaacaggagcacaaagtcagggataggggttagcagaagagagaaatagtgtcacatcaagggcaggatctcatagctagggaacatttcacaaataaggtgagattttgtaaccaataataaaaatgaatgtttttataagtaaataacttatttttcatatggctaaagatggtaaaatgacttcattctatagccattgtaaataagaatttgctattgatgaaagaagttcagattggcatttgaagtattgagtgtatgggatctctaaggatttcttagattttatatttaaatattttttaaaccttagaggagtcaacaaactggctcttgattttcagcaccctactctcatgaaaaaagcctgaaaggaccctttcccttataagtaatttaatccaatttctccccattttatagatgaggaaactgaggctcagatcagatgagaactcacttaaatccactcaatgtgtagatggtagagctgggactagcaacattgctgcagcccattgttggcctctctcttcactttatcattgcccaagaatgaggatatgcagtaaacagaattcaggcaagatacctctaagctgttttgaaccctctgatattttgtatttatgtgtttgtctgtctccccctactagaatgtaagctccatggggcagggacttcactgtattttgttcatagtgtatccccagagcctggaccagtgcttggcacataggagatggcaataaatgcttgtagaattaataaacaaggtgaaggagagagctaatgaaatgaaaatcttagtctcatataagaagtcttactactgctttctatggcaagttccttttctattgcatcttcccaaagacaagatgctcatctgcaaaggggtgataagatttacttggagggattttatggaaaattcagtgcaataattgcttttttttttttttttgcagtagcagtttacatagtacagcattctgcaaaaattgcatgaaatgtggacacaagatgtactgtatgacttaattacctgtcattctctgacaccattactacctactagaagttcaaataatttatctttaacattgcaatatctgataaactttttaaaatgtaaataattcaaagccttgaaaatctatcatgaatctgctcaacatttcaaagtgactattttgaaatgcctataaatgctatatacctg

SEQ ID NO: 15879 - DNA, 5604 bp, Homo sapiens
  ENST00000351298
ccctccctcccgctgagctccagctgtgccagaggcacccgagccctgagagtccgccgccaacgcgcaggtgctagcggccccttcgccctgcagcccctttgcttttactctgtccaaagttaacatgtcactgaaaaacgagccacgggtaaatacctctgcactgcagaaaattgctgctgacatgagtaatatcatagaaaatctggacacgcgggaactccactttgagggagaggaggtagactacgacgtgtctcccagcgatcccaagatacaagaagtgtatatccctttctctgctatttataacactcaaggatttaaggagcctaatatacagacgtatctctccggctgtccaataaaagcacaagttctggaagtggaacgcttcacatctacaacaagggtaccaagtattaatctttacactattgaattaacacatggggaatttaaatggcaagttaagaggaaattcaagcattttcaagaatttcacagagagctgctcaagtacaaagcctttatccgcatccccattcccactagaagacacacgtttaggaggcaaaacgtcagagaggagcctcgagagatgcccagtttgccccgttcatctgaaaacatgataagagaagaacaattccttggtagaagaaaacaactggaagattacttgacaaagatactaaaaatgcccatgtatagaaactatcatgccacaacagagtttcttgatataagccagctgtctttcatccatgatttgggaccaaagggcatagaaggtatgataatgaaaagatctggaggacacagaataccaggcttgaattgctgtggtcagggaagagcctgctacagatggtcaaaaagatggttaatagtgaaagattcctttttattgtatatgaaaccagacagcggtgccattgccttcgtcctgctggtagacaaagaattcaaaattaaggtggggaagaaggagacagaaacgaaatatggaatccgaattgataatctttcaaggacacttattttaaaatgcaacagctatagacatgctcggtggtggggaggggctatagaagaattcatccagaaacatggcaccaactttctcaaagatcatcgatttgggtcatatgctgctatccaagagaatgctttagctaaatggtatgttaatgccaaaggatattttgaagatgtggcaaatgcaatggaagaggcaaatgaagagatttttatcacagactggtggctgagtccagaaatcttcctgaaacgcccagtggttgagggaaatcgttggaggttggactgcattcttaaacgaaaagcacaacaaggagtgaggatcttcataatgctctacaaagaggtggaactcgctcttggcatcaatagtgaatacaccaagaggactttgatgcgtctacatcccaacataaaggtgatgagacacccggatcatgtgtcatccaccgtctatttgtgggctcaccatgagaagcttgtcatcattgaccaatcggtggcctttgtgggagggattgacctggcctatggaaggtgggacgacaatgagcacagactcacagacgtgggcagtgtgaagcgggtcacttcaggaccgtctctgggttccctcccacctgccgcaatggagtctatggaatccttaagactcaaagataaaaatgagcctgttcaaaacctacccatccagaagagtattgatgatgtggattcaaaactgaaaggaataggaaagccaagaaagttctccaaatttagtctctacaagcagctccacaggcaccacctgcacgacgcagatagcatcagcagcattgacagcacctccagttattttaatcactatagaagtcatcacaatttaatccatggtttaaaaccccacttcaaactctttcacccgtccagtgagtctgagcaaggactcactagacctcatgctgataccgggtccatccgtagtttacagacaggtgtgggagagctgcatggggaaaccagattctggcatggaaaggactactgcaatttcgtcttcaaagactgggttcaacttgataaaccttttgctgatttcattgacaggtactccacgccccggatgccctggcatgacattgcctctgcagtccacgggaaggcggctcgtgatgtggcacgtcacttcatccagcgctggaacttcacaaaaattatgaaatcaaaatatcggtccctttcttatccttttctgcttccaaagtctcaaacaacagcccatgagttgagatatcaagtgcctgggtctgtccatgctaacgtacagttgctccgctctgctgctgattggtctgctggtataaagtaccatgaagagtccatccacgccgcttacgtccatgtgatagagaacagcaggcactatatctatatcgaaaaccagtttttcataagctgtgctgatgacaaagttgtgttcaacaagataggcgatgccattgcccagaggatcctgaaagctcacagggaaaaccagaaataccgggtatatgtcgtgataccacttctgccagggttcgaaggagacatttcaaccggcggaggaaatgctctacaggcaatcatgcacttcaactacagaaccatgtgcagaggagaaaattccatccttggacagttaaaagcagagcttggtaatcagtggataaattacatatcattctgtggtcttagaacacatgcagagctcgaaggaaacctagtaactgagcttatctatgtccacagcaagttgttaattgctgatgataacactgttattattggctctgccaacataaatgaccgcagcatgctgggaaagcgtgacagtgaaatggctgtcattgtgcaagatacagagactgttccttcagtaatggatggaaaagagtaccaagctggccggtttgcccgaggacttcggctacagtgctttagggttgtccttggctatcttgatgacccaagtgaggacattcaggatccagtgagtgacaaattcttcaaggaggtgtgggtttcaacagcagctcgaaatgctacaatttatgacaaggttttccggtgccttcccaatgatgaagtacacaatttaattcagctgagagactttataaacaagcccgtattagctaaggaagatcccattcgagctgaggaggaactgaagaagatccgtggatttttggtgcaattccccttttatttcttgtctgaagaaagcctactgccttctgttgggaccaaagaggccatagtgcccatggaggtttggacttaagagatattcattggcagctcaaagacttccaccctggagaccacactgcacacagtgacttcctggggatgtcatagccaaagccaggcctgacgcattctcgtatccaacccaaggaccttttggaatgactggggagggctgcagtcacattgatgtaaggactgtaaacatcagcaagactttataattccttctgcctaacttgtaaaaagggggctgcattcttgttggtagcatgtactctgttgagtaaaacacatattcaaattccgtataccaaaatccatttcctttgtaacaagaatttaccagtaactgtgatctaggttgccaaaagttgtctgaatctccttattcttctctgatcttcatttatgcagccaatgtctagctggacctgccctcatcttgcagttcatacaggcactgtttgagagattgtttattattagatgttgtaatgctgcttcaagattcttcatggttacatgggatgcccctgctcatctggtcctgaagtagtaacattcacccaaatgaggatatagtcattattccttttcagtcactgtacgaacacggcagactttagcctacacagtagactgtgttaggcacttctggtaacattgacactgtatcttgacaccactaagcaacaggaaggaataaattccaatattgagacagagatttatttcattttgctcccaaaggcactgacaacatgagtccttgtgattaggcccacctgatcaaatgtaaaaacatgcatgggatatttgattacgtaacaaccagctaaaactgagagcacacagccttcggaaacccccaaggtgtcgaggaggatcagatccagataagagaagatgattccttctagtcctgtaaaatttcctgtcatccttagctgctgggttgattgaaatttgatctctacatttcaaaatcaaactagtgaatacagtttgtctttcaagagaatcagaggcatcgtaactcctaccaagttagtaagtatgagtctaaccttgtttgacattcaggtcttctgctacattatcttctttgagaaaaattaattgattataaaatatgtgctacttcacttacattattaaatatgtattaacgcctctcaccagggcttccagtgaagttacaatgccctagtctgtgaattagtctggaaacgtgtttttccttttcggatgttagagtaccctttgataaactaaattttactaagctgaacaactctgacagtctaaagagctaatgtgggttaccaaaaggcctgtacctgtaaaacaaaatgcaggtgtaatgattatacatgtctatggattacctggacatactctcatttgggttgttcttcaaagaagcaagcagccgatccctgttttcataaagctaatacttcagttggaaaaattaaacaggagcacaaagtcagggataggggttagcagaagagagaaatagtgtcacatcaagggcaggatctcatagctagggaacatttcacaaataaggtgagattttgtaaccaataataaaaatgaatgtttttataagtaaataacttatttttcatatggctaaagatggtaaaatgacttcattctatagccattgtaaataagaatttgctattgatgaaagaagttcagattggcatttgaagtattgagtgtatgggatctctaaggatttcttagattttatatttaaatattttttaaaccttagaggagtcaacaaactggctcttgattttcagcaccctactctcatgaaaaaagcctgaaaggaccctttcccttataagtaatttaatccaatttctccccattttatagatgaggaaactgaggctcagatcagatgagaactcacttaaatccactcaatgtgtagatggtagagctgggactagcaacattgctgcagcccattgttggcctctctcttcactttatcattgcccaagaatgaggatatgcagtaaacagaattcaggcaagatacctctaagctgttttgaaccctctgatattttgtatttatgtgtttgtctgtctccccctactagaatgtaagctccatggggcagggacttcactgtattttgttcatagtgtatccccagagcctggaccagtgcttggcacataggagatggcaataaatgcttgtagaattaataaacaaggtgaaggagagagctaatgaaatgaaaa

SEQ ID NO: 15880 - DNA, 839 bp, Homo sapiens
  ENST00000446289
tccatgctaacgtacagttgctccgctctgctgctgattggtctgctggtataaagtaccatgaagagtccatccacgccgcttacgtccatgtgatagagaacagcaggcactatatctatatcgaaaaccagtttttcataagctgtgctgatgacaaagttgtgttcaacaagataggcgatgccattgcccagaggatcctgaaagctcacagggaaaaccagaaataccgggtatatgtcgtgataccacttctgccagggttcgaaggagacatttcaaccggcggaggaaatgctctacaggcaatcatgcacttcaactacagaaccatgtgcagaggagaaaattccatccttggacagttaaaagcagagcttggtaatcagtggataaattacatatcattctgtggtcttagaacacatgcagagctcgaaggaaacctagtaactgagcttatctatgtccacagcaagttgttaattgctgatgataacactgttattattggctctgccaacataaatgaccgcagcatgctgggaaagcgtgacagtgaaatggctgtcattgtgcaagatacagagactgttccttcagtaatggatggaaaagagtaccaagctggccggtttgcccgaggacttcggctacagtgctttaggtctaaaatgactccaggtgtcgaagatccctgatctttggcaagaagatgcaaattttaaactaatctgtggtgaagcagagagaatactgggctaggaagctgggctcgtttcagctgtgcgatcctaaataagtccattcaataaagtgttatttagaactttcaa

SEQ ID NO: 15881 - DNA, 701 bp, Homo sapiens
  ENST00000465816
cctttgtgttctgccatgattgtgaggcctccccagccatgtggaactttgctccgctctgctgctgattggtctgctggtataaagtaccatgaagagtccatccacgccgcttacgtccatgtgatagagaacagcaggcactatatctatatcgaaaaccagtttttcataagctgtgctgatgacaaagttgtgttcaacaagataggcgatgccattgcccagaggatcctgaaagctcacagggaaaaccagaaataccgggtatatgtcgtgataccacttctgccagggttcgaaggagacatttcaaccggcggaggaaatgctctacaggcaatcatgcacttcaactacagaaccatgtgcagaggagaaaattccatccttggacagttaaaagcagagcttggtaatcagtggataaattacatatcattctgtggtcttagaacacatgcagagctcgaaggaaacctagtaactgagcttatctatgtccacagcaagttgttaattgctgatgataacactgttattattggctctgccaacataaatgaccgcagcatgctgggaaagcgtgacagtgaaatggctgtcattgtgcaagatacagagactgttccttcagtaatggatggaaaagagtaccaagctggccggtttgcccgaggacttcggctacagtgctttag

SEQ ID NO: 15882 - DNA, 576 bp, Homo sapiens
  ENST00000467432
ttttaatagcctctctttctgaaatctaacacgaattttataacttttccatttacctacctcaaaacaactatcatgtccctattagtagcattacaaaagtgatattcatgtaactgtttttagcatttagatatatatgtagcatcttctcatagaagcacttgttctgtttttacttgtgttaggattaaacctacagatactgcatgggattggttgttttgaaacctctgtaattattttctcctttacatattttcagaaccatgtgcagaggagaaaattccatccttggacagttaaaagcagagcttggtaatcagtggataaattacatatcattctgtggtcttagaacacatgcagagctcgaaggaaacctagtaactgagcttatctatgtccacagcaagttgttaattgctgatgataacactgttattattggctctgccaacataaatgaccgcagcatgctgggaaagcgtgacagtgaaatggctgtcattgtgcaagatacagagactgttccttcagtaatggatggaaaagagtaccaagctggccggtttg

SEQ ID NO: 15883 - DNA, 1773 bp, Homo sapiens
  ENST00000471075
cttgttagcccacagcctgtaatagaatggacagatgccaccctagttgtgtcttaagaaattaagaagcttttaggtgtttaataaatgagagttgagcctccctttctgggactcacctgaaccacagtctctgagggggtcttgctgcattcacagataccgggtccatccgtagtttacagacaggtgtgggagagctgcatggggaaaccagattctggcatggaaaggactactgcaatttcgtcttcaaagactgggttcaacttgataaaccttttgctgatttcattgacaggtactccacgccccggatgccctggcatgacattgcctctgcagtccacgggaaggcggctcgtgatgtggcacgtcacttcatccagcgctggaacttcacaaaaattatgaaatcaaaatatcggtccctttcttatccttttctgcttccaaagtctcaaacaacagcccatgagttgagatatcaagtgcctgggtctgtccatgctaacgtacagttgctccgctctgctgctgattggtctgctggtataaagtaccatgaagagtccatccacgccgcttacgtccatgtgatagagaacagcaggcactatatctatatcgaaaaccagtttttcataagctgtgctgatgacaaagttgtgttcaacaagataggcgatgccattgcccagaggatcctgaaagctcacagtcttgctctgtcacccaagctgaagtgcagtggtgtgatcttggcttactgcaacctccatctcccgggttcaagcaattctcctgcctcagcctcccgagtatctgggattacaggcacccgccaccacactcagctaatttttttgtatttttggtggagacggggtttcaccatgtcggccaggctagctttgaactcctaacctcaagtgatccgcccacctcggcctcccaaagtgcccctcatgcttcttataactgtagaagagctactgcttgcctgtaagtgggtggtatgggaaataccacactgggaaatctgaaattattgggggaccagatgtctggagacctggattctctccagctctgttatccacaggtatgtgaccttctgagtacgtcagtttgtccttctgacacgctgtttcttcaccaaccacgaataatattatctgttctacgtagcttatatgaatatatgtgaaagtagtttgtaagctgtaaagcaccagttcatgtaagaacttattatagcatttccatgatattcatcatctggaaatatgttgttcactgtaaattgaagcaaggataaagaggcatcatattcaaatcagctgtttcaaaattagtatttatgctagaaaaagaaatgttttaatttaaaagatgcttaaatgttccgtattttaaattattggacggctacttctggataagaaaaatttgttttggtttctcacgactggctgttgttcatcatgtgacttgtttaggcacacgattacaacactctgtctagaggtttgctgccagaaacctatagctgactcttcctgggaatcaatttttgatttccctgttattgatctgataacactctccccaaaatataaagtaaaacaaaatgtattctgaagcataatatgtgtttagtttagtattgttttaattttagatgctatttactttgttgttatttgaagatatgcaagccttctaattgaaatcagcaattgatataattgaataaaaatgttaccaaat

SEQ ID NO: 15884 - DNA, 491 bp, Homo sapiens
  ENST00000481505
taacaaaaaggaacaataaacttgtctttcaggtatgttaatgccaaaggatattttgaagatgtggcaaatgcaatggaagaggcaaatgaagagatttttatcacagactggtggctgagtccagaaatcttcctgaaacgcccagtggttgagggaaatcgttggaggttggactgcattcttaaacgaaaagcacaacaaggagtgaggatcttcataatgctctacaaagaggtggaactcgctcttggcatcaatagtgaatacaccaagaggactttgatgcgtctacatcccaacataaaggtgatgagacacccggatcatgtgtcatccaccgtctatttgtgggctcaccatgagaagcttgtcatcattgaccaatcggtggcctttgtgggagggattgacctggcctatggaaggtgggacgacaatgagcacagactcacagacgtgggcagtgtgaagcgggtcacttcaggacc

SEQ ID NO: 15885 - DNA, 996 bp, Homo sapiens
  ENST00000498278
cgccaacgcgcaggtgctagcggccccttcgccctgcagcccctttgcttttactctgtccaaagttaacatgtcactgaaaaacgagccacgggtaaatacctctgcactgcagaaaattgctgctgacatgagtaatatcatagaaaatctggacacgcgggaactccactttgagggagaggaggtagactacgacgtgtctcccagcgatcccaagatacaagaagtgtatatccctttctctgctatttataacactcaaggatttaaggagcctaatatacagacgtatctctccggctgtccaataaaagcacaagttctggaagtggaacgcttcacatctacaacaagggtaccaagtattaatctttacactattgaattaacacatggggaatttaaatggcaagttaagaggaaattcaagcattttcaagaatttcacagagagctgctcaagtacaaagcctttatccgcatccccattcccactagaagacacacgtttaggaggcaaaacgtcagagaggagcctcgagagatgcccagtttgccccgttcatctgaaaacatgataagagaagaacaattccttggtagaagaaaacaactggaagattacttgacaaagatactaaaaatgcccatgtatagaaactatcatgccacaacagagtttcttgatataagccagctgtctttcatccatgatttgggaccaaagggcatagaaggtatgataatgaaaagatctggaggacacagaataccaggcttgaattgctgtggtcagggaagagcctgctacagatggtcaaaaagatggttaatagtgaaagattcctttttattgtatatgaaaccagacagcggtgccattgccttcgtcctgctggtagacaaagaattcaaaattaaggtggggaagaaggagacagaaacgaaatatggaatccgaattgataatctttcaaggtacacatttcaaat

SEQ ID NO: 15886 - DNA, 831 bp, Homo sapiens
  ENST00000475273
agactacgacgtgtctcccagcgatcccaagatacaagaagtgtatatccctttctctgctatttataacactcaaggatttaaggagcctaatatacagacgtatctctccggctgtccaataaaagcacaagttctggaagtggaacgcttcacatctacaacaagggtaccaagtattaatctttacactattgaattaacacatggggaatttaaatggcaagttaagaggaaattcaagcattttcaagaatttcacagagagctgctcaagtacaaagcctttatccgcatccccattcccactagaagacacacgtttaggaggcaaaacgtcagagaggagcctcgagagatgcccagtttgccccgttcatctgaaaacatgataagagaagaacaattccttggtagaagaaaacaactggaagattacttgacaaagatactaaaaatgcccatgtatagaaactatcatgccacaacagagtttcttgatataagccagctgtctttcatccatgatttgggaccaaagggcatagaaggtatgataatgaaaagatctggaggacacagaataccaggcttgaattgctgtggtcagggaagagcctgctacagatggtcaaaaaggctgtcagaacccacctgtctgtgtgcacagcagtctgggaagtgtcaacagctcccaggagcagccatcagccaagaactgatcggagtccagccccatcctcctcagttggggtgactctgcagcagtctctacactgtctcccagaactccttagctggcttacagcacagctgcccacaataaaaagc

SEQ ID NO: 15887 - DNA, 646 bp, Homo sapiens
  ENST00000440204
aggcacccgagccctgagagtccgccgccaacgcgcaggtgctagcggccccttcgccctgcagcccctttgcttttactctgtccaaagttaacatgtcactgaaaaacgagccacgggtaaatacctctgcactgcagaaaattgctgctgacatgagtaatatcatagaaaatctggacacgcgggaactccactttgagggagaggaggtagactacgacgtgtctcccagcgatcccaagatacaagaaggtaccaagtattaatctttacactattgaattaacacatggggaatttaaatggcaagttaagaggaaattcaagcattttcaagaatttcacagagagctgctcaagtacaaagcctttatccgcatccccattcccactagaagacacacgtttaggaggcaaaacgtcagagaggagcctcgagagatgcccagtttgccccgttcatctgaaaacatgataagagaagaacaattccttggtagaagaaaacaactggaagattacttgacaaagatactaaaaatgcccatgtatagaaactatcatgccacaacagagtttcttgatataagccagctgtctttcatccatgatttgggaccaaagggcatgtaagttgcaataa

SEQ ID NO: 15888 - DNA, 621 bp, Homo sapiens
  ENST00000418087
agccaaaactgggcttgggaacaggaaggctttgcccgtttatttggattctcagggtagtcgattttgccacctcttggctatcagctgccttggagattggtttcatagtaaggattctttctttaaggtgatatggagcaactgctttcacaggggcaccagcccctttgcttttactctgtccaaagttaacatgtcactgaaaaacgagccacgggtaaatacctctgcactgcagaaaattgctgctgacatgagtaatatcatagaaaatctggacacgcgggaactccactttgagggagaggaggtagactacgacgtgtctcccagcgatcccaagatacaagaagtgtatatccctttctctgctatttataacactcaaggatttaaggagcctaatatacagacgtatctctccggctgtccaataaaagcacaagttctggaagtggaacgcttcacatctacaacaagggtaccaagtattaatctttacactattgaattaacacatggggaatttaaatggcaagttaagaggaaattcaagcattttcaagaatttcacagagagctgctcaagtacaaagcctttatccgcatccccattcc

SEQ ID NO: 15889 - DNA, 558 bp, Homo sapiens
  ENST00000489995
atgacttaagttgccttgagggagtcagccaaaactgggcttgggaacaggaaggctttgcccgtttatttggattctcagggtagtcgattttgccacctcttggctatcagctgccttggagattggtttcatagtaaggattctttctttaaggtgatatggagcaactgctttcacaggggcaccaggttggtaaaaactcaaagctaacaccattcagaacttacctaatgatgtttgaaaaagaggcggtaggctgataactgcttcctaggaagacctaccaacttcaccagcatgctcattactctcatcattgttgttggaacattttgttcttgggtacaagcttactttacacacatctggttactatgtttgttctggaagacggcagcctcatggagtgactagagaacacttgatactgagctctggaaatcgttttttaacagctttattgatattgtataatttacagatcatcaagttaagccctttaaagtatacaattcattggttttttgaatatctacagagttgtgtgaccataac

SEQ ID NO: 15890 - DNA, 1012 bp, Homo sapiens
  ENST00000460926
ccgccgccaacgcgcaggtgctagcggccccttcgccctgcagatattcccactctggccactgcccaaaggggctcttatctgaggaatactgctgacttcgtgtacctagttttacagagccatctttctgaagcataaattagattacattattctacagcttaaatccctccatgaacttcccatcacccaagagtggatctgaaacgccttagagtgtcattcaagacccttctgtatgtggctgccatgcatttttttcaactttatttccagccttgcaatgtacatacatccatctctgtcccacgccctctgcagggctttttggttccagaacgtgccatgtgcttttctcctttggagctctttgaataggatgcccttcctcccttgtctgcctgtagatagaaaaatcctgtgcattggtgagttggccctgaccaccattttcttagcatgctgaattacttctgttcccctctgtgtttgcacagctttgtttgtgcacagtagacttttggctgggccatgtagactgcctcctccatgagtttgccagctttttgaggacaatgtctgttttattcatcctcgaattctcagtgcctagcagagtgcatagcacagggtagttatgcaatacatattggagtaaaggaatacagttcaaaaaaacagtctcattaacagatgcaaaccaactcctctcatgacgcagagaatctaagctcaaacaaattaccagagttggcagttgaagtactatatatagacagaacttaataaatgcttttctttgtcttaagcctttgatgacagtgatgtgtttttatgaacgtagataaccacaagcagatgtgtcaaagctcttttgtccaggaataaactgagtttcgtcatcatcttgacagtactttcctggatgagtgttcaggaaacatgaaaagtttttaaacaattcaacaaatgtgtaataaaagtttgttaccttgttttatttgttgtt

SEQ ID NO: 15891 - DNA, 1506 bp, Homo sapiens
  ENST00000497307
aggtgcaagaaggcttataaagactccagcaaagctccagtctcttaattatgtcacctcagggtgatgcggtcgagttatgaaactttgggaaaagagaacaaggaacgcgggcgatcagaggcccagtcgcgagacctgccccgctggggcctccagccggcaccgcgacgccccgggacctggcaccgcctcgctccacccctgcgaatccggggcgaatccgggcggagagttcctgccggccgcgcagcgcagagccccctccggcccgccctctctccctccctcccgctgagctccagctgtgccagaggcacccgagccctgagagtccgccgccaacgcgcaggtgctagcggccccttcgccctgcaggagagaatatcctttgaccctacgtggaagcctacaagaaggggaattctgggcaatgtggttcagcccagccacatcacatactattatttagtagtcatgaagagagagacatagacagtgaagagtaagtgaagaatttgagggtcatcagccattgtgaactcatcaaaatattcccactctggccactgcccaaaggggctcttatctgaggaatactgctgacttcgtgtacctagttttacagagccatctttctgaagcataaattagattacattattctacagcttaaatccctccatgaacttcccatcacccaagagtggatctgaaacgccttagagtgtcattcaagacccttctgtatgtggctgccatgcatttttttcaactttatttccagccttgcaatgtacatacatccatctctgtcccacgccctctgcagggctttttggttccagaacgtgccatgtgcttttctcctttggagctctttgaataggatgcccttcctcccttgtctgcctgtagatagaaaaatcctgtgcattggtgagttggccctgaccaccattttcttagcatgctgaattacttctgttcccctctgtgtttgcacagctttgtttgtgcacagtagacttttggctgggccatgtagactgcctcctccatgagtttgccagctttttgaggacaatgtctgttttattcatcctcgaattctcagtgcctagcagagtgcatagcacagggtagttatgcaatacatattggagtaaaggaatacagttcaaaaaaacagtctcattaacagatgcaaaccaactcctctcatgacgcagagaatctaagctcaaacaaattaccagagttggcagttgaagtactatatatagacagaacttaataaatgcttttctttgtcttaagcctttgatgacagtgatgtgtttttatgaacgtagataaccacaagcagatgtgtcaaagctcttttgtccaggaataaactgagtttcgtcatcatcttgacagtactttcctggatgagtgttcaggaaacatgaaaagtttttaaacaattcaacaaatgtgtaataaaagtttgttaccttg

SEQ ID NO: 15892 - DNA, 174 bp, Homo sapiens
  ENST00000627725
atgtcactgaaaaacgagccacgggtaaatacctctgcactgcagaaaattgctgctgacatgagtaatatcatagaaaatctggacacgcgggaactccactttgagggagaggaggtagactacgacgtgtctcccagcgatcccaagatacaagaaggtaccaagtattaa

SEQ ID NO: 15893 - DNA, 2906 bp, Homo sapiens
  ENST00000331659
ccagcccgcagagcacggtcctgggggtgtgatcacagctgctgaccgcggctcccgccgtgtgatgtgaccactcggaggtggggcgagggggccgggggccagcagcagggagtgtgtaaaaggtcttcttcctcacaatacgattgaaggtgtttgggacgtagggctcagatccaggagtgccgtcctccaagccttccataggattttgtgacgcccttgagaaccgcccttgtagactcagtcctgaactaccgccacgcctgtatttgctcctcctcatctcggattattgctttctttacttcctctgtgaagcactaaatactagtagctttttaagaacagaccacaacagtttcttcgtttgaccattactaagtctgcctccaaaatggggagttccgttaactttatcagccagccctgccaattttagttaagataagccttcgtgggcctccaaaggcctctgagagactaggtacccagagacctctgaggtatgttaaatggtttagttcgtggtggtgcaatgaaaacttaaagaaggaaaggaatctgcaatttgaactgttaacagaccccacatttacacactgcctatttgaataagaatctctttcagtattaaatgttttgtgacacacaaatgaatttgtacacagtcttttagcttgaatttgtagacagcctttaaatgttgtttggggatctttggactaattgtataagcgctcagtctggtctcaaactcatgatctcaggttatccatgcgcctcggcctccgaaaatgctgcgattataggcgtgagccaccactcccagccccttcttgtgatgatgtgagatgataaaatgcctgtgtgaagatgaagtgaggcgaataacctaggcagtgtgacataagtggaaaacgccagaaataaacaattcatgttataaattgtgcaccattctgagtagtgtgatgaaatcttgcactcctccattccatcctgccagcattgccagtcactcggtggccatctctgtgatcagattaacagtggttttatcagtatcatagggcttatgttcaagtaactgtattttacttaataatggctacaaagtgcaaaagtagcgatataatatttttggaccatggttgactgcaggtaactgaaattttagttacatgaaaccacagataaggggggactgcactacacataaaataggcataagtaacctcaagacaatagacattattaaaatatagaaaagtaataaagaagtgataaatggagaacttttgctttaatataatttattgtaagtttatataatttaatttttagtaacttcaatttttaatattttaatttttaatgatttatgtgtttaacaactgactcacaaaattgctgaaaatttcccaatcttgatgaaaatttcccagtctgctctcaggagcctatatgagccagcccagaataccactggagttataattttagaagattaccttggtagcaatctgtagaaatgttttgtaggggagctacagtagggatcaaaagtggagacagattacgaaatgtcttcagaccctgccagcatgagggttcaaatgatgtctagtcagtggagatcacgcaaatttcactggtttgtgttcccacgtggatccgtaggaccttcaatgcaagtctccttcaggtattcctggtggtatcttggcattgtctcacatgtgttttgagagccccacttccttggggagtcttccgctttggcttccttgttgatgaccgtgggccaaagggctttgtgtgtgaggctccacctcagccatagctggtgtcctcctgaagaggatttatgccaaaaggagtcacatgccaggacttgtttttttcaagtttgcaaatctggggggagggtggggctctagaaagatgctggaacctggtatgtgccctgcagaaatgtccttgactccttttgtcaccaggagcctaaatttactgtgtttctctgtgactcacagaggcagggggaaagacaatcctctccacttcttcctgcagctacttgctccatcagcctcagccagtctggggctgggcagggaaacaggccctcttccttctcctggtttgtcccctggtttgctcagcgagaccttcgtgtctgagggcccccttctcaccttgcagatcagctggtgtggtactgaatgcctgatggatggccaggggcccctgatccatctgcattcccagaatataagaatctcatttggggccacccagcccccactactcttagtatatgaaataaggtggaatagataagaggatggaactggcccctgggtgcatgatggggccaataacggaggtacagggtgcatatgtggctgggctgtgagacagggaaagaggatggaattgagatgcaaggtagaaaagcatgactatgttcagtttgggacttgatgaaatagatactggtaggacagttcactaggcactgggccttcaggagaaagagaagaaaggaatggtggcattgggagtagtaaagctgtgggtatgaatgagtatctatgagactcacctccctgtgaggacatagaatgaggagacacagtctacaggtagactaggtcgagttcagaagcctgaagaacaccagtgtttaagggatggtgttgggaaagggagccaggccagccagagaggaatgttccggaactctgaaaggaaggaaatggcaggaacaaaggagctggggcacaacagtggtgactcacactgggaacacttcggcccattgtgtttatgcttatagtttcccaagtttatcttttcagggttatgattacgttaacctcacctccctccctccctct

SEQ ID NO: 15894 - DNA, 2007 bp, Homo sapiens
  ENST00000540372
aggacaaagaggaagtagctggaaggggaaggagccagctgcagagaggaggaggtgagctgcagagaagaggaggttggtgtggagcacaggcagcaccgagcctgccccgtgagctgagggcctgcagtctgcggctggaatcaggatagacaccaaggcaggacccccagagagctggagctgctggtgatgccaggctgccctgtgcagatgctgaagcctctttggaaagcagcagtggcccccacatggccatgctccatgccgccccgccgcccgtgggacagagaggctggcacgttgcaggtcctgggagcgctggctgtgctgtggctgggctccgtggctcttatctgcctcctgtggcaagtgccccgtcctcccacctggggccaggtgcagcccaaggacgtgcccaggtcctgggagcatggctccagcccagcttgggagcccctggaagcagaggccaggcagcagagggactcctgccagcttgtccttgtggaaagcatcccccaggacctgccatctgcagccggcagcccctctgcccagcctctgggccaggcctggctgcagctgctggacactgcccaggagagcgtccacgtggcttcatactactggtccctcacagggcctgacatcggggtcaacgactcgtcttcccagctgggagaggctcttctgcagaagctgcagcagctgctgggcaggaacatttccctggctgtggccaccagcagcccgacactggccaggacatccaccgacctgcaggttctggctgcccgaggtgcccatgtacgacaggtgcccatggggcggctcaccaggggtgttttgcactccaaattctgggttgtggatggacggcacatatacatgggcagtgccaacatggactggcggtctctgacgcaggtgaaggagcttggcgctgtcatctataactgcagccacctggcccaagacctggagaagaccttccagacctactgggtactgggggtgcccaaggctgtcctccccaaaacctggcctcagaacttctcatctcacttcaaccgtttccagcccttccacggcctctttgatggggtgcccaccactgcctacttctcagcgtcgccaccagcactctgtccccagggccgcacccgggacctggaggcgctgctggcggtgatggggagcgcccaggagttcatctatgcctccgtgatggagtatttccccaccacgcgcttcagccaccccccgaggtactggccggtgctggacaacgcgctgcgggcggcagccttcggcaagggcgtgcgcgtgcgcctgctggtcggctgcggactcaacacggaccccaccatgttcccctacctgcggtccctgcaggcgctcagcaaccccgcggccaacgtctctgtggacgtgaaagtcttcatcgtgccggtggggaaccattccaacatcccattcagcagggtgaaccacagcaagttcatggtcacggagaaggcagcctacataggcacctccaactggtcggaggattacttcagcagcacggcgggggtgggcttggtggtcacccagagccctggcgcgcagcccgcgggggccacggtgcaggagcagctgcggcagctctttgagcgggactggagttcgcgctacgccgtcggcctggacggacaggctccgggccaggactgcgtttggcagggctgaggggggcctctttttctctcggcgaccccgccccgcacgcgccctcccctctgaccccggcctgggcttcagccgcttcctcccgcaagcagcccgggtccgcactgcgccaggagccgcctgcgaccgcccgggcgtcgcaaaccgcccgcctgctctctgatttccgagtccagccccccctgagccccacctcctccagggagccctccaggaagccccttccctgactcctggcccacaggccaggcctaaaaaaaactcgtggcttcc

SEQ ID NO: 15895 - DNA, 6515 bp, Homo sapiens
  ENST00000392593
agaggaagtagctggaaggggaaggagccagctgcagagaggaggaggtgagctgcagagaagaggaggttggtgtggagcacaggcagcaccgagcctgccccgtgagctgagggcctgcagtctgcggctggaatcaggatagacaccaaggcaggacccccagagatgctgaagcctctttggaaagcagcagtggcccccacatggccatgctccatgccgccccgccgcccgtgggacagagaggctggcacgttgcaggtcctgggagcgctggctgtgctgtggctgggctccgtggctcttatctgcctcctgtggcaagtgccccgtcctcccacctggggccaggtgcagcccaaggacgtgcccaggtcctgggagcatggctccagcccagcttgggagcccctggaagcagaggccaggcagcagagggactcctgccagcttgtccttgtggaaagcatcccccaggacctgccatctgcagccggcagcccctctgcccagcctctgggccaggcctggctgcagctgctggacactgcccaggagagcgtccacgtggcttcatactactggtccctcacagggcctgacatcggggtcaacgactcgtcttcccagctgggagaggctcttctgcagaagctgcagcagctgctgggcaggaacatttccctggctgtggccaccagcagcccgacactggccaggacatccaccgacctgcaggttctggctgcccgaggtgcccatgtacgacaggtgcccatggggcggctcaccaggggtgttttgcactccaaattctgggttgtggatggacggcacatatacatgggcagtgccaacatggactggcggtctctgacgcaggtgaaggagcttggcgctgtcatctataactgcagccacctggcccaagacctggagaagaccttccagacctactgggtactgggggtgcccaaggctgtcctccccaaaacctggcctcagaacttctcatctcacttcaaccgtttccagcccttccacggcctctttgatggggtgcccaccactgcctacttctcagcgtcgccaccagcactctgtccccagggccgcacccgggacctggaggcgctgctggcggtgatggggagcgcccaggagttcatctatgcctccgtgatggagtatttccccaccacgcgcttcagccaccccccgaggtactggccggtgctggacaacgcgctgcgggcggcagccttcggcaagggcgtgcgcgtgcgcctgctggtcggctgcggactcaacacggaccccaccatgttcccctacctgcggtccctgcaggcgctcagcaaccccgcggccaacgtctctgtggacgtgaaagtcttcatcgtgccggtggggaaccattccaacatcccattcagcagggtgaaccacagcaagttcatggtcacggagaaggcagcctacataggcacctccaactggtcggaggattacttcagcagcacggcgggggtgggcttggtggtcacccagagccctggcgcgcagcccgcgggggccacggtgcaggagcagctgcggcagctctttgagcgggactggagttcgcgctacgccgtcggcctggacggacaggctccgggccaggactgcgtttggcagggctgaggggggcctctttttctctcggcgaccccgccccgcacgcgccctcccctctgaccccggcctgggcttcagccgcttcctcccgcaagcagcccgggtccgcactgcgccaggagccgcctgcgaccgcccgggcgtcgcaaaccgcccgcctgctctctgatttccgagtccagccccccctgagccccacctcctccagggagccctccaggaagccccttccctgactcctggcccacaggccaggcctaaaaaaaactcgtggcttcccggtgcctctgtgtgagtcccgcgcgggcggcccttcatcctcttgccaagggcccgcctctatgcgcccgcccctgcgaaactgcgccgcgcgaccgccgtggcagcgcctcagctagccccgggtccgcgagaacctggggcggggcggggcggggaccagacgggcctcccaggcggagcgaaccctccacctcccaccccgcgccgggctgccgcgctccggaacccaaattcccgccccgaggctgccgggggaagcgagaggcgcggagcccacgcccgggactccagcggaggaaacgcagaccaaggcgcagcgccgcgcacccaccgccagggggcagctcctacggcgccggacaggggcggcgcgggaggggagcggggctgaggggaccgggagggcgggaggggacctgcgactgaggggacagggagggcgggaggcgacccgcggctgagtgagggaagggcgggaggggacccgcggctgaggggaccgggagggcgggaggcgacccgcggctgagtgaggggagggtgggaggggacccgcggctgaggggacagggagggcgggaggggacccgcggctgaggggaccgggagggcgggaggcgacccggggctgagtgaggggagggcgggaggggagcggggctgaggggaccgggagggcgggaggggacctgcgactgaggggacggggaggatgtgaggcgatccggggctgagtgaggggagggtgggaggggacccgcggctgaggggacggggagggcgggaggggacccgcggctgaggggacggggagggcgggaggcgacccggggctgaggggacggggagggcgggaggggacccgcggctgaggggacaggtcctgcgtgcgggctggggagacaggcgggcgagggtaggggtgcacaaggctgtgtggtttgtgggctgttgtgcagggtgggtccaagcatgtgggggcaggcttgtcctggggatgcagtgcccagggttggtggatggggctgagaggaccagcatttgagctggagggcaggaaggtgactccagtctgagaccaggacttggatgcagctccactggaactcaccctatcctgggagccacctgggcacctgtcctgcagatgcaggatttgaacccaggtttggcaactcagttcccactcttctgctatgaatgctgggtcagaaggattctcaaaacaccctggcttatctcacctgatggttcctgaccaagaccacagggtaccctcccctggtggaggtccatggggccatgctaggctggagttcagggatggctcagcggtatgaaggagcactggatgctgaatggaccccagggtgccccgaatgctctcccggtcttgaggcaccactttcctacccttctctacttctctccttttcctacccttctctacttttttctttcctacatttgtgtccctgccacactgtgaactcagccatatcttcctcttccctctttgctttggggaaagctagcaaagttcatctcaggtacagtacaagttacttttctgttcgattagtgacctcatacttcccccatctaaaggacaccttagacttcagcattctgtctgtgcagaaatctcctacacccatcctgcctccctgcccaagcttgtgaaaagcttgctgcagatgctgcagggggatagggatccacatagccctgcaaggccttcaggagcttctgggggctgctttgtgtgtgagctgcacttggccaagccaagctctggcagttgcagtggctgctccctgtggcttcctatccctcattcatgctccatatctcctcagtaaccatctggcaaaaagcttcgtggcaacacctggctcagaagccgatatcatcccagactaagctctgccctccagggttgcacgtgtgggtttgctccctggttcttggccttatacctgaatgtgtctcagagcacttggcctgctctcttggcctgccaactatgttctaggagggctctgtgctccaggctgtgatttggacaactggctggtggccctcagccagtgaaaggcctctttccacacacctggggactggcagtcacacctcagtggcactgacagaggcctgcttcaaggcagatgcctattccaaaggaaatccagcttgacaaggcttgggagaccccaggagggtgccacaatgtggccccttctgggctatagcagacagactctagaatggctcccttgacccccacctgctggtatgcatgcccttgtgtgatctcaccttgagtgtgtgcaggacctgtgccttgttgtaaccaatagaatacagaggtaaggggatgtcactcctgtgacaccttgtgatcatgtgacataagattataacattatcaaggaatagcagtctatcccttgctagctttaaaaagtgagctgctaggctatgagctgtcctatgaagaggcccatgtagcagggtactggggttgcctccagcccccaactagcaagaaactggggccctcaatcatcccatccacaaggagttgagtgtggctagcaacaacgtgagcttcagaagtggctgctttcctggtcatacctgaaggggagaccacagccccagctgacatcttgattgtagcctaatgggaccttgagcagagaacccaacaaagccacacttgggctcctgatccacagaaactgggagatcataaatgtgtgttgttttaagttgctaatttgtagtgatgttcttatgcagcatagataactcatacacagagaaccaaggccacgcgagaaccctgtgggggcccctgctgctcagccactcctcacatgctgggacagctgtctctctggcctctagcaccaaggtccccactatcccaggccttgactcttggatcagagagggacaaaagccccatggagccaagcagactcctccccctgggctgcactcacctagcttgtctggcacacacaagttggagtagagaaggcaggaagccctgggaagggagagggtgatggccttgcttaactgggatgagtgtccaccaaatttcccttcccacttcccctgctcatgagcccccaggggacctgtgtcagttcactttctagaggcttctatgtgccctaacttggatgacacccacgggcctccccaactcagcacagggaacatatgcccatggtggcatggggaaagaacccagcctctcccctgcccaggctcctgcaccccatagctgtcacccctctggaacctctcagggcagcacgagtggtagcctcggagtggccttcaccctccaggcactgcggtcctccagattggctcacagcccagctcttgctcccatatccacagccatgagagcagccacctccccagggggccataagcgcttctcaccaggagcccacctaggccaggagggagctgggggcaagttccaactgcccccttgaacactgcatacccatgaatctggcaggggcatctgggaagagatttgaccactgaaagactgtagggaaacccttgaacctcaatccgctacgccacgtggatttgcttcctgtgggctgcccaagagcgcctctgtggtgaaggaagcttctgaggatgggccactaaagatggccaaggtcacctttctgtgctgtccccactctgcactccatctcccatcccacactgcctccagctggagggagggagggagggttgtacgtctgtgtccctgccacactgtgaactcagccctatcttccttgtcttcctcacagcctctggctcagaggaggacctggacaaatggatgataggtaggcaaccacccaaatgttcctcattgactgttctctagagctgcttagtagagaccaggagtgtgtgggaggaaagccctggtaaacttcgaccctgagacagaagacctcagcagccttcagcatgggatgcagcactttctttattgcccatccagggaacagccaagccagctccatctgcattctggctgcagcgtgtacattaggggactcaggggccacagtgtgggaccgtgcacactggcaaggcactggcggatgctggcaggccagtggacatggatagatgagaatgacaactcacagatgtcctagcttctgctggcccagctgccagccactggccatcacccttttgcccagcatgtgtgcattgtcacccaaaacatcttgaaacttgccattagtgaggcattcaacaaagaagtaagctaagtgagtaggaaacagtgtttcctggaatataccgcactctgcctgaaataggaaaactatgtttgccgggaagcagcagcagcaggaaagaagttataccaaaaacgacttgtacaccacagacattataaccctttcctcaaagaaacagtcatgttctgttgggtattatggacaggtctctggaaatttatctaataaagaccaacaaacttccccagcagt

SEQ ID NO: 15896 - DNA, 883 bp, Homo sapiens
  ENST00000557573
agagaagaggaggttggtgtggagcacaggcagcaccgagcctgccccgtgagctgagggcctgcagtctgcggctggaatcaggatagacaccaaggcaggacccccagagatgctgaagcctctttggaaagcagcagtggcccccacatggccatgctccatgccgccccgccgcccgtgggacagagaggctggcacggtcctgggagcgctggctgtgctgtggctgggctccgtggctcttatctgcctcctgtggcaagtgccccgtcctcccacctggggccaggtgcagcccaaggacgtgcccaggtcctgggagcatggctccagcccagcttgggagcccctggaagcagaggccaggcagcagagggactcctgccagcttgtccttgtggaaagcatcccccaggacctgccatctgcagccggcagcccctctgcccagcctctgggccaggcctggctgcagctgctggacactgcccaggagagcgtccacgtggcttcatactactggtccctcacagggcctgacatcggggtcaacgactcgtcttcccagctgggagaggctcttctgcagaagctgcagcagctgctgggcaggaacatttccctggctgtggccaccagcagcccgacactggccaggacatccaccgacctgcaggttctggctgcccgaggtgcccatgtacgacaggtgcccatggggcggctcaccaggggtgttttgcactccaaattctgggttgtggatggacggcacatatacatgggcagtgccaacatggactggcggtctctgacgcaggtgaaggagcttggcgctgtcatctataactgcagccacctggcccaagacctggagaag

SEQ ID NO: 15897 - DNA, 691 bp, Homo sapiens
  ENST00000472901
gagaagaggaggttggtgtggagcacaggcagcaccgagcctgccccgtgagctgagggcctgcagtctgcggctggaatcaggatagacaccaaggcaggacccccagagatgctgaagcctctttggaaagcagcagtggcccccacatggccatgctccatgccgccccgccgcccgtgggacagagaggctggcacgttgcaggtcctgggagcgctggctgtgctgtggctgggctccgtggctcttatctgcctcctgtggcaagtgccccgtcctcccacctggggccaggtgcagcccaaggacgtgcccaggtcctgggagcatggctccagcccagcttgggagcccctggaagcagaggccaggcagcagagggactcctgccagcttgtccttgtggaaagcatcccccaggacctgccatctgcagccggcagcccctctgcccagcctctgggccaggcctggctgcagctgctggacactgcccaggagagcgtccacgtggcttcatactactggtccctcacagggcctgacatcggggtcaacgactcgtcttcccagctggtgcgccccgccctggccccaccgcatcctggtgctggaaacacagcaagtcaggctgcctatctatgcaggcgtctcgggcaccaggcccgggggctcagcttggtggtag

SEQ ID NO: 15898 - DNA, 628 bp, Homo sapiens
  ENST00000472702
gcaagtggggaccagtcgggcagggactgcacctgccccaacatccctggcctgggtggagtggggtggaggccccacagaggggtttttctcccacagcgcctgactttggtccctgcaggtgaaggagcttggcgctgtcatctataactgcagccacctggcccaagacctggagaagaccttccagacctactgggtactgggggtgcccaaggctgtcctccccaaaacctggcctcagaacttctcatctcacttcaaccgtttccagcccttccacggcctctttgatggggtgcccaccactgcctacttctcagcgtcgccaccagcactctgtccccagggccgcacccgggacctggaggcgctgctggcggtgatggggagcgcccaggagttcatctatgcctccgtgatggagtatttccccaccacgcgcttcagccaccccccgaggtactggccggtgctggacaacgcgctgcgggcggcagccttcggcaagggcgtgcgcgtgcgcctgctggtcggctgcggactcaacacggaccccaccatgttcccctacctgcggtccctgcaggcgctcagcaaccccgcggccaacgtctctgtggacgtg

SEQ ID NO: 15899 - DNA, 667 bp, Homo sapiens
  ENST00000553861
aacgtctctgtggacgtggtgagggcgtgctcccggccgggcgtgggaaaggcggccctcctgccgcccttcctgacgcgctgcctctgctcccctaagaaagtcttcatcgtgccggtggggaaccattccaacatcccattcagcagggtgaaccacagcaagttcatggtcacggagaaggcagcctacataggcacctccaactggtcggaggattacttcagcagcacggcgggggtgggcttggtggtcacccagagccctggcgcgcagcccgcgggggccacggtgcaggagcagctgcggcagctctttgagcgggactggagttcgcgctacgccgtcggcctggacggacaggctccgggccaggactgcgtttggcagggctgaggggggcctctttttctctcggcgaccccgccccgcacgcgccctcccctctgaccccggcctgggcttcagccgcttcctcccgcaagcagcccgggtccgcactgcgccaggagccgcctgcgaccgcccgggcgtcgcaaaccgcccgcctgctctctgatttccgagtccagccccccctgagccccacctcctccagggagccctccaggaagccccttccctgactcctggcccacaggccaggcctaaaaaaaactcgtggctt

SEQ ID NO: 15900 - DNA, 8721 bp, Homo sapiens
  ENST00000536534
cacctcgccctccctccttccgccccgcgcctcccgcgatcgccccctcccgcccggccgcgctcccagctggcgctcagcaccccgcgctccccgcgcccgctcgctcctccagctcctccagctcagtctccagctccacctccggctcccgctgggcctcccgctcgccctccgcgcccggctccccgcgcgcccgtcccgagtccgctgctcgccggcggccgcccggtcatgtcaggatggagatccggcagcacgagtggctctcggcctccccccatgagggcttcgagcagatgaggctcaaaagccgccccaaggagccctccccaagcctgacccgagtgggcgcgaacttctacagcagcgtcaagcagcaggactacagcgccagcgtctggcttcggaggaaagacaagctggagcactcccagcagaagtgcatcgtgatctttgccctggtgtgctgctttgccattctggttgcactgatcttttcagccgtggacatcatgggagaggatgaggatggactctcagaaaaaaattgccaaaataaatgtcgaattgccctggtggaaaatattcctgaaggccttaactattcagaaaatgcaccatttcacttatcacttttccaaggctggatgaatttactcaacatggccaaaaagtctgttgacatagtgtcttcccattgggatctcaaccacactcatccatcagcatgtcagggtcaacgtctttttgaaaagttgctccagctgacttcgcaaaatattgaaatcaagctagtgagtgatgtaacagctgattcaaaggtattagaagccttgaaattaaagggagccgaggtgacgtacatgaacatgaccgcttacaacaagggccggctgcagtcctccttctggatcgtggacaaacagcacgtgtatatcggcagtgccggtttggactggcaatccctgggacagatgaaagaactcggtgtcatcttctacaactgcagctgcctggtcctagatttacaaaggatatttgctctatatagttcattaaaattcaaaagcagagtgcctcaaacctggtccaaaagactctatggagtctatgacaatgaaaagaaattgcaacttcagttgaatgaaaccaaatctcaagcatttgtatcgaattctccaaaactcttttgccctaaaaacagaagttttgacatagatgccatctacagtgtgatagatgatgccaagcagtatgtgtacatcgctgtcatggactacctgcctatctccagcacaagcaccaaaaggacttactggccagacttggatgcaaaaataagagaagcattagttttacgaagcgttagagttcgactccttttaagcttctggaaggaaactgatccccttacgtttaactttatttcatctcttaaagcgatttgcactgaaatagccaactgcagtttgaaagttaaattttttgatctggaaagagagaatgcttgtgctacaaaagaacaaaagaatcacacctttcctaggttaaatcgcaacaagtacatggtgacagatggagcagcttatattggaaattttgattgggtagggaatgatttcactcagaatgctggcacgggccttgttatcaaccaggcagatgtgaggaacaacagaagcatcattaagcaacttaaagatgtgtttgaaagggactggtattcaccgtatgccaaaaccttacagccaaccaaacagccgaactgctcaagcctgttcaaactcaaacccctctccaacaaaactgccacagacgacacaggcggaaaggatccccggaacgtataacatgatgaagaaactgacaggacagctctgtatttcatatttatacataaaggacttgaggagagaaaaaacactttaatatgtctctttttttagggaaaaagcacacttataaaaaatattctctgaacaacacataatacctatctaacaatatcttagcgtcgtgtacactaaaattaagacttttgtatttgttacctctgacagagaatgtcattctggcgtagaagttagtttttacgtttgcatacaaattttaagactttcattcctgctcctttctagttttagaactttttctgctgacctacccggtcagttgttaggaagcttagcatgaggtgggctctttaacaccattctgagaactgttgatttagagaggaaggtgaggattttgccttggagaagagactgataaaaccaagtgtttattcttgtaaatcgtctccaagacctacacagtcagctaagcatgaatagcttacatctcatgccagccttcaacacccttgaaaaatatccttttctgtcttgctcattttcttcttataccataagttttatttggtatcattttctcttctcacaaaatgttcctattatatagcattttctgtattcacctcaacattacttctaactatgataacatcttttgaaaacatacaaatttttcagaatggatactaagtggaaatagcagtctttcattttcacctttcaactgaatccttttttcccctaccgaattggtatttaaaaaaaatcacagtcagcaatatgtatcctttctctcaagctcagaaaaattatgtagccacctgctaatatccagcaagctatcaagtctgcattttgggaataaagtagtttttcacatttttgttcagtttatggtattataaaggaaaaaatctctatgcgtcagtggattttaatttctttagaatcattatgctgttaagagtatgccagcaaacgtttctagagctatttaatataccttctgctatttaatataccaaatgcttttcagagaaatgcaatttaaatactgtgcttaacatattttactaagaagcagaaatattgaattattgttctataacgtaattgtgtgttgttgttttatatctatacaatatatacccctgtattaatggagaccattgctacactagggagaggcatggcctcttcagagcccacagcaggtggccgggatgtccagttccaatgttgttcccgactctgtgactcaaagcggagcccctcactgcttggcctcgggcttctcttggtaatgtagacggtaataactcacctacctcgcaaggatgttgtcacggtaggaaatatttataacttgttttgaaatcaaaagaacctatataaatgctaagcattataatatataatctttttcttgaaataaactttgtcatatcttgatggaatcaacaccaggtcctcccccagaatccacaaaggaaaacaaattcacagcttcctgttgcaaatgtggatgaaaagagcacagccccacagaaaccctggtggagatctggattgtcaacatttcaatagaacattgcgttgggctgctttggcatgaataacatcaacacaaaactagacgtcgtgctagagctggttcttcaggaccataatatacatgtattttcagagcaaggaaacactcagttattctttttcatttctggagacttgatttctaaatgccaaaagagtgatcgaggagcctgtgaatcttatccaatggatttacttaatatagaatggctatgttggttatccagtgagtgatcacattacttcccttcttgttatttgcaagtattgcttcactagatatttaaccagttgatcaagagagctggaaggaagctgtatttttaagggtagcatggttttatgactaattgggagattctcactgaaattcttcatcaataatagccagtccctaagactctaaatatttaccatatacacaatccatatttgagttgggagttataactctgccagttatcccaataaagtaaacgtggctttggtgatgattttaaaaagaaagcagcctgggtgcggtggctcacgcctgtcatcccagcgctttggaaggccaaggcaggaggattgcttgaggccaagagtttgagaccagcctgggtagcatagcaagatcctgcctctaaaaataaataaatacagaaaggaaagaaggaatcagaataggagtggagacaaacctaccaagttcacactcagacaaacaaaagcgacctgagttggttttaaaaaggacatctaaagggagaaaaaaaaaccaaataaactaaaatttgttagttctcaagttgtcccctgaagtattcatccacagccatgggacactcataggcttggtgtcatggggccccttcactgtcactatctgctgtatgtgctacgagaagagaatgtcatccattacggaatgaccatcattgccatttccttttgaggcctggcaaaatgctatcaccaggagccgcatcccaggcttttctgccaagcagcagcagcagatgcctaccagacacagcaagcccctaatcaggggagtctgggcagcggtggtgactccatggggccacactgtccttctgtggcagccagaaaagtgacccccataccaagagtgtcagaaatgggttcatgtctcccaagagaacatttcattctgcagaactttctttcatttggatgctttagctatccctctagagacggctttcctttcttttagacttgtttctgtgctaaacaaactatcaacctccattcccccccacccctaaatatcccaggaattactttccaggagggaaagaatgcaaaacaaaaacaggttaatttgacaccctctggtggatgtccatgccagaaattatgaggagcagggtgactactccccattaacattcctggatttatttcccaagaggcaaaaaggaaaacaaacacaattagagactatatcttggatttcagtaccactaacactaacttagtgccttatgtatcctcaagtgttgattttaaacaatgacttattctatgagaacacttctctctcctgtggaattcaaatgaccttccgatgggcctaccagttgaaaacttccatttgagcagtgacagtttttatgctgcctgttctcttcccaagccccatcacctttatccacccccccgccaaatcaaatcattgcacacaccatcaaagatcaatactgtgggcctccactgcattgtcactggccactagcctatcaaataattgaatctctgcttgtccaaccattggagaggaagtggaagagtgagatgacatccatgctttgtaaacaacaagctttaggtacctgaacctgatagaaacaaggaatgctgaaaatgtccccactgacttaaaagaatgctgtaaagagatgctttgcagacttcctaggtcctgtggcacagagaatgaaaaccagcgtctttaacaagtcaaagcagacaaagaaacaaaaggtctgcggatacactttgcacctgtgtaactctgggcaccattcgggccctctctgtgctactgtttgtctcatgtctgaatggttcttggtgagaggggtctgatcacatttttggttgatctcaccctttgaaaaatgtgggggattttttttgaaatgcagttaatggtttaagtgcctcgatgaacctgggatggatagaagctcatttcccaccagcctgtggctatactcagtgactctgattcattctgtttgtttttaggaacttttattgaactaaattccaaggggggagaaaagaccataagaatttcttgataagatcagatccagggtctatctgtctcaggaattctatcctacaattaacttttttttttttccacacgtatgaccactggtgtgtgtttctgtgtccaaaattcatttcattatttttaactttaggaatgtaaaacgctgccattacttgcatagaacagccacttcctataatgaaagatactttgttattgtttattcaaactcagtccttacgaacagccccatatattgtggacaaatgtttcattcttttatctttctgtacttgttcccaatgaactggtgtgctttattatacaccttttaaaggcaaaattaatataacttccatttggcccaaggtaaaaaattttccaatttgatttggattagcatctttcattttccttttatatgttgttaacaaaatagctgcttaccattttcaccttattgacttaaatggacggaggcttttgaatagccctgacatcaaccccagttcgcagcctgtctttctcatttgagagaattcccatctttggctgaattatgaagatgctgctttatacagtgactcaatgggtattcctcagaagtttcttgaagatgtaaaaatgaaattttcttatttttgacccattagcagtcttgtatttacaaggttctaaaacttcactggtcattaacgcttcttttggcaatttgaaaaaaaaaagttacatttaatagactattacacattttcttttgctatgttcaactactaaacttctaattctgttacaaaaggtatcttgaatttttaatgttcctttatgtaaataggataaacttgtacctggacatatctatattattaaccttaagatccctaaataaatgggtttgataaagggttgaatttgggggaatcattaaaattatcaaacctttcgtataaccagatgctcagttttttcagaagtaaatattagatggctttttcatactgtgagatgaggcatttctttttctcctcaagctgatctcagaaacaaatcagtctctcatcagtaaccaagctgtactgtggtaaattatgaagaaggtagatgcgactggtccaatgggcccactgttttgtatattcacacaaggaggcatctttgaaacactatacctatctctttctctaaaaaaaaaaaaaaaaaaaaaaaaaaaacctttccaataaatgttcattctgagtacattaatttttagtgagaaaaagaaacaatcatagagaccccactagagaacctagtgtctgctcagcaaacccatattgagctgtagagcatactttaacagccatctcaaccagctcacccaacgtgtaaattcccttcccatttgggcatagaagttgacagcctagagtgtcaggacggccgagtggtctgaggctccagactcaaggtgagaagctgaaaacctacttgagccaaacaatttggagtgctttatatggttcctttctcaagacccacacaggataaaattttgttgatttactaaagtaatttggatttgaggcagtcttatctctgaaaggatatgcacagcatgtaataaggtgggtgctgttttcataaagagaatcaatctgagaggcatacttttaaaaaaaaaactatcattggagaggttagcaaaggcttaaaagtgaactttgagtctgcaatagtcaatagtattctgattttattggcagtttctgaatgctacaatttcgtgtttttttttaaaaaaatgggctaacagtgcgatgacagtcatgtacaaggagtccaattaaatcatagtaagggtgaagattatttgtgatttatttttatatgagagataaattagtaaggagaaaagatctctttttatgaagtggatatctggctctcaaacccattccttttggctcagacattaaaaaattattaattcccttatggactctcctattccccatgggcggaaaattctgaaaagcagatgagacattctgagccccttgcaagacaaacacagatggtttctaatttagagttttcccacacaaatgcacaaccaatcttggaaatatgacctcaattcccaggattaaaaacgttgaaattatatgttactttccaatataaatagaggatgaagatctttaaagacaactcagaaaatatgatccaataacattcaaatcagagcgtaatctacaatttcacttaatagttaaaagtgaagattagctgcttctttaaaaggggtgagttattaaaggcaacatcctagaaaatgtaataacaagaaggcaacaccatattttcagcaaagttatggtactgataaagcactttgaaaatcctctgtaggaaaatgtcattgagaaacaaaggccaatttgtctccagtgataaagctatctctcattcatatttcataggtggatctatagttttcctggtgtcttggagagaccctacctccacagctcctgcaggagcaaaaccatgttttctgccatgtgagctctctacactggccacagctgattgtaccaaggttcagtacccgacccaaagagactcattttcaggccagagggcggcctaaggaatgaaagtgtacctagcagtggtattcttgtttgatggtacctggccccaccaatcacggccctcttttagggagtttgaacaccagaaagtaaatgatgaataggaagcacagccagaatagacacagtcaccgtaatggtgactctgagaacagtgacagcagttacttctgcagtcaagacaatttgaggtcttgttgattcaccattctgctcttagcttactggagaaatacttgactcctgaacaatgagtctggactttgtagttcctgggttgctttttttttttcttcctttcttatgtattgacataaataaactcacattaactgaa

SEQ ID NO: 15901 - DNA, 2830 bp, Homo sapiens
  ENST00000314833
attctctgcctctgaaggctccagaggctgtgggaagcagcacatcagcgacagctcctggctgctggactccgcagggagggaaggaagattggtcgcaatgtcccagcagaagtgcatcgtgatctttgccctggtgtgctgctttgccattctggttgcactgatcttttcagccgtggacatcatgggagaggatgaggatggactctcagaaaaaaattgccaaaataaatgtcggtaagagggtcaacgtctttttgaaaagttgctccagctgacttcgcaaaatattgaaatcaagctagtgagtgatgtaacagctgattcaaaggtattagaagccttgaaattaaagggagccgaggtgacgtacatgaacatgaccgcttacaacaagggccggctgcagtcctccttctggatcgtggacaaacagcacgtgtatatcggcagtgccggtttggactggcaatccctgggacagatgaaagaactcggtgtcatcttctacaactgcagctgcctggtcctagatttacaaaggatatttgctctatatagttcattaaaattcaaaagcagagtgcctcaaacctggtccaaaagactctatggagtctatgacaatgaaaagaaattgcaacttcagttgaatgaaaccaaatctcaagcatttgtatcgaattctccaaaactcttttgccctaaaaacagaagttttgacatagatgccatctacagtgtgatagatgatgccaagcagtatgtgtacatcgctgtcatggactacctgcctatctccagcacaagcaccaaaaggacttactggccagacttggatgcaaaaataagagaagcattagttttacgaagcgttagagttcgactccttttaagcttctggaaggaaactgatccccttacgtttaactttatttcatctcttaaagcgatttgcactgaaatagccaactgcagtttgaaagttaaattttttgatctggaaagagagaatgcttgtgctacaaaagaacaaaagaatcacacctttcctaggttaaatcgcaacaagtacatggtgacagatggagcagcttatattggaaattttgattgggtagggaatgatttcactcagaatgctggcacgggccttgttatcaaccaggcagatgtgaggaacaacagaagcatcattaagcaacttaaagatgtgtttgaaagggactggtattcaccgtatgccaaaaccttacagccaaccaaacagccgaactgctcaagcctgttcaaactcaaacccctctccaacaaaactgccacagacgacacaggcggaaaggatccccggaacgtataacatgatgaagaaactgacaggacagctctgtatttcatatttatacataaaggacttgaggagagaaaaaacactttaatatgtctctttttttagggaaaaagcacacttataaaaaatattctctgaacaacacataatacctatctaacaatatcttagcgtcgtgtacactaaaattaagacttttgtatttgttacctctgacagagaatgtcattctggcgtagaagttagtttttacgtttgcatacaaattttaagactttcattcctgctcctttctagttttagaactttttctgctgacctacccggtcagttgttaggaagcttagcatgaggtgggctctttaacaccattctgagaactgttgatttagagaggaaggtgaggattttgccttggagaagagactgataaaaccaagtgtttattcttgtaaatcgtctccaagacctacacagtcagctaagcatgaatagcttacatctcatgccagccttcaacacccttgaaaaatatccttttctgtcttgctcattttcttcttataccataagttttatttggtatcattttctcttctcacaaaatgttcctattatatagcattttctgtattcacctcaacattacttctaactatgataacatcttttgaaaacatacaaatttttcagaatggatactaagtggaaatagcagtctttcattttcacctttcaactgaatccttttttcccctaccgaattggtatttaaaaaaaatcacagtcagcaatatgtatcctttctctcaagctcagaaaaattatgtagccacctgctaatatccagcaagctatcaagtctgcattttgggaataaagtagtttttcacatttttgttcagtttatggtattataaaggaaaaaatctctatgcgtcagtggattttaatttctttagaatcattatgctgttaagagtatgccagcaaacgtttctagagctatttaatataccttctgctatttaatataccaaatgcttttcagagaaatgcaatttaaatactgtgcttaacatattttactaagaagcagaaatattgaattattgttctataacgtaattgtgtgttgttgttttatatctatacaatatatacccctgtattaatggagaccattgctacactagggagaggcatggcctcttcagagcccacagcaggtggccgggatgtccagttccaatgttgttcccgactctgtgactcaaagcggagcccctcactgcttggcctcgggcttctcttggtaatgtagacggtaataactcacctacctcgcaaggatgttgtcacggtaggaaatatttataacttgttttgaaatcaaaagaacctatataaatgctaagcattataatatataatctttttcttgaaataaactttgtcatatcttgatggaatcaa

SEQ ID NO: 15902 - DNA, 2729 bp, Homo sapiens
  ENST00000366545
gtaggtgccgcaaggagccggcgagcggagcgcccgctcgggaccgcagccgccgggcgacgtcgccgccgcaccgggcacttctgtctccccggagcagctcctccagctcagtctccagctccacctccggctcccgctgggcctcccgctcgccctccgcgcccggctccccgcgcgcccgtcccgagtccgctgctcgccggcggccgcccggtcatgtcaggatggagatccggcagcacgagtggctctcggcctccccccatgagggcttcgagcagatgaggctcaaaagccgccccaaggagccctccccaagcctgacccgagtgggcgcgaacttctacagcagcgtcaagcagcaggactacagcgccagcgtctggcttcggaggaaagacaagctggagcactcccagcagaagtgcatcgtgatctttgccctggtgtgctgctttgccattctggttgcactgatcttttcagccgtggacatcatgggagaggatgaggatggactctcagaaaaaaattgccaaaataaatgtcggtaagagaattgccctggtggaaaatattcctgaaggccttaactattcagaaaatgcaccatttcacttatcacttttccaaggctggatgaatttactcaacatggccaaaaagtctgttgacatagtgtcttcccattgggatctcaaccacactcatccatcagcatgtcagggtcaacgtctttttgaaaagttgctccagctgacttcgcaaaatattgaaatcaagctagtgagtgatgtaacagctgattcaaaggtattagaagccttgaaattaaagggagccgaggtgacgtacatgaacatgaccgcttacaacaagggccggctgcagtcctccttctggatcgtggacaaacagcacgtgtatatcggcagtgccggtttggactggcaatccctgggacagatgaaagaactcggtgtcatcttctacaactgcagctgcctggtcctagatttacaaaggatatttgctctatatagttcattaaaattcaaaagcagagtgcctcaaacctggtccaaaagactctatggagtctatgacaatgaaaagaaattgcaacttcagttgaatgaaaccaaatctcaagcatttgtatcgaattctccaaaactcttttgccctaaaaacagaagttttgacatagatgccatctacagtgtgatagatgatgccaagcagtatgtgtacatcgctgtcatggactacctgcctatctccagcacaagcaccaaaaggacttactggccagacttggatgcaaaaataagagaagcattagttttacgaagcgttagagttcgactccttttaagcttctggaaggaaactgatccccttacgtttaactttatttcatctcttaaagcgatttgcactgaaatagccaactgcagtttgaaagttaaattttttgatctggaaagagagaatgcttgtgctacaaaagaacaaaagaatcacacctttcctaggttaaatcgcaacaagtacatggtgacagatggagcagcttatattggaaattttgattgggtagggaatgatttcactcagaatgctggcacgggccttgttatcaaccaggcagatgtgaggaacaacagaagcatcattaagcaacttaaagatgtgtttgaaagggactggtattcaccgtatgccaaaaccttacagccaaccaaacagccgaactgctcaagcctgttcaaactcaaacccctctccaacaaaactgccacagacgacacaggcggaaaggatccccggaacgtataacatgatgaagaaactgacaggacagctctgtatttcatatttatacataaaggacttgaggagagaaaaaacactttaatatgtctctttttttagggaaaaagcacacttataaaaaatattctctgaacaacacataatacctatctaacaatatcttagcgtcgtgtacactaaaattaagacttttgtatttgttacctctgacagagaatgtcattctggcgtagaagttagtttttacgtttgcatacaaattttaagactttcattcctgctcctttctagttttagaactttttctgctgacctacccggtcagttgttaggaagcttagcatgaggtgggctctttaacaccattctgagaactgttgatttagagaggaaggtgaggattttgccttggagaagagactgataaaaccaagtgtttattcttgtaaatcgtctccaagacctacacagtcagctaagcatgaatagcttacatctcatgccagccttcaacacccttgaaaaatatccttttctgtcttgctcattttcttcttataccataagttttatttggtatcattttctcttctcacaaaatgttcctattatatagcattttctgtattcacctcaacattacttctaactatgataacatcttttgaaaacatacaaatttttcagaatggatactaagtggaaatagcagtctttcattttcacctttcaactgaatccttttttcccctaccgaattggtatttaaaaaaaatcacagtcagcaatatgtatcctttctctcaagctcagaaaaattatgtagccacctgctaatatccagcaagctatcaagtctgcattttgggaataaagtagtttttcac

SEQ ID NO: 15903 - DNA, 1353 bp, Homo sapiens
  ENST00000467561
cggagcgcccgctcgggaccgcagccgccgggcgacgtcgccgccgcaccgggcacttctgtctccccggagcaggttcctttccctccctgtcccctctcgtcccccttctccccgtccgtccccctccgcccccgcccccgcccccgcccgcacctcgccctccctccttccgccccgcgcctcccgcgatcgccccctcccgcccggccgcgctcccagctggcgctcagcaccccgcgctccccgcgcccgctcgctcctccagctcctccagctcagtctccagctccacctccggctcccgctgggcctcccgctcgccctccgcgcccggctccccgcgcgcccgtcccgagtccgctgctcgccggcggccgcccggtcatgtcaggatggagatccggcagcacgagtggctctcggcctccccccatgagggcttcgagcagatgaggctcaaaagccgccccaaggagccctccccaagcctgacccgagtgggcgcgaacttctacagcagcgtcaagcagcaggactacagcgccagcgtctggcttcggaggaaagacaagctggagcactcccagcagaagtgcatcgtgatctttgccctggtgtgctgctttgccattctggttgcactgatcttttcagccgtggacatcatgggagaggatgaggatggactctcagaaaaaaattgccaaaataaatgtcgaattgccctggtggaaaatattcctgaaggccttaactattcagaaaatgcaccatttcacttatcacttttccaaggctggatgaatttactcaacatggccaaaaagtctgttgacatagtgtcttcccattgggatctcaaccacactcatccatcagcatgtcagggtcaacgtctttttgaaaagttgctccagctgacttcgcaaaatattgaaatcaagctagtgagtgatgtaacagctgattcaaaggagccgaggtgacgtacatgaacatgaccgcttacaacaagggccggctgcagtcctccttctggatcgtggacaaacagcacgtgtatatcggcagtgccggtttggactggcaatccctgggacagatgaaagaactcggtgtcatcttctacaactgcagctgcctggtcctagatttacaaaggatatttgctctatatagttcattaaaattcaaaagcagagtgcctcaaacctggtccaaaagactctatggagtctatgacaatgaaaagaaattgcaacttcagttgaatgaaaccaaatctcaagcatttgtatcggtgagttgttttccctttctcctccccttctccttcttcctccaaaggct

SEQ ID NO: 15904 - DNA, 557 bp, Homo sapiens
  ENST00000474177
gaaaagttgctccagctgacttcgcaaaatattgaaatcaagctagtgagtgatgtaacagctgattcaaaggtattagaagccttgaaattaaagggcaaatgaattaacagggatgcaggaggctttttctgaaggacttttccccactctctgcactggaagacacgagaactacactaaaataatgttccaggcaaagccttctgttaacaacatgcctctctgtgaggtgtgtgatgaggatctctgggccagcatagcccttccttgaaaggaagttggacaccaacagcttcaagaacggcaaggagcacagcaggttcctactccagcttgcgatgtgatcattgcctgaagcttcttctcttgttaattagagaacctgattcttctaaagtgtctccactctcctttataacatacagacacatgctttccctccttctcccccaaatcctgatactctcatattcttcttaccattcccttcctttccatggcccaggagcatttcccatttgaaatttctgagtttctcagactgaatgaagact

SEQ ID NO: 15905 - DNA, 490 bp, Homo sapiens
  ENST00000459864
gggaagcagcacatcagcgacagctcctggctgctggactccgcagggagggaaggaagattggtcgcaatgtcccagcagaagtgcatcgtgatctttgccctggtgtgctgctttgccattctggttgcactgatcttttcagccgtggacatcatgggagaggatgaggatggactctcagaaaaaaattgccaaaataaatgtcgaattgccctggtggaaaatattcctgaaggccttaactattcagaaaatgcaccatttcacttatcacttttccaaggctggatgaatttactcaacatggccaaaaagtctgttgacatagtgtcttcccattgggatctcaaccacactcatccatcagcatgtcagggtcaacgtctttttgaaaagttgctccagctgacttcgcaaaatattgaaatcaagctagtgagtgatgtaacagctgattcaaaggtattagaagccttgaaattaaagg

SEQ ID NO: 15906 - DNA, 3305 bp, Homo sapiens
  ENST00000442594
gtaggtgccgcaaggagccggcgagcggagcgcccgctcgggaccgcagccgccgggcgacgtcgccgccgcaccgggcacttctgtctccccggagcagctcctccagctcagtctccagctccacctccggctcccgctgggcctcccgctcgccctccgcgcccggctccccgcgcgcccgtcccgagtccgctgctcgccggcggccgcccggtcatgtcaggatggagatccggcagcacgagtggctctcggcctccccccatgagggcttcgagcagatgaggctcaaaagccgccccaaggagccctccccaagcctgacccgagtgggcgcgaacttctacagcagcgtcaagcagcaggactacagcgccagcgtctggcttcggaggaaagacaagctggagcactcccagcagaagtgcatcgtgatctttgccctggtgtgctgctttgccattctggttgcactgatcttttcagccgtggacatcatgggagaggatgaggatggactctcagaaaaaaattgccaaaataaatgtcgaattgccctggtggaaaatattcctgaaggccttaactattcagaaaatgcaccatttcacttatcacttttccaaggctggatgaatttactcaacatggccaaaaagtctgttgacatagtgtcttcccattgggatctcaaccacactcatccatcagcatgtcagggtcaacgtctttttgaaaagttgctccagctgacttcgcaaaatattgaaatcaagctagtgagtgatgtaacagctgattcaaaggtattagaagccttgaaattaaagggagccgaggtgacgtacatgaacatgaccgcttacaacaagggccggctgcagtcctccttctggatcgtggacaaacagcacgtgtatatcggcagtgccggtttggactggcaatccctgggacagatgaaagaactcggtgtcatcttctacaactgcagctgcctggtcctagatttacaaaggatatttgctctatatagttcattaaaattcaaaagcagagtgcctcaaacctggtccaaaagactctatggagtctatgacaatgaaaagaaattgcaacttcagttgaatgaaaccaaatctcaagcatttgtatcgaattctccaaaactcttttgccctaaaaacagaagttttgacatagatgccatctacagtgtgatagatgatgccaagcagtatgtgtacatcgctgtcatggactacctgcctatctccagcacaagcaccaaaaggacttactggccagacttggatgcaaaaataagagaagcattagttttacgaagcgttagagttcgactccttttaagcttctggaaggaaactgatccccttacgtttaactttatttcatctcttaaagcgatttgcactgaaatagccaactgcagtttgaaagttaaattttttgatctggaaagagagaatgcttgtgctacaaaagaacaaaagaatcacacctttcctaggttaaatcgcaacaagtacatggtgacagatggagcagcttatattggaaattttgattgggtagggaatgatttcactcagaatgctggcacgggccttgttatcaaccaggcagatgtgaggaacaacagaagcatcattaagcaacttaaagatgtgtttgaaagggactggtattcaccgtatgccaaaaccttacagccaaccaaacagccgaactgctcaagcctgttcaaactcaaacccctctccaacaaaactgccacagacgacacaggcggaaaggatccccggaacgtataacatgatgaagaaactgacaggacagctctgtatttcatatttatacataaaggacttgaggagagaaaaaacactttaatatgtctctttttttagggaaaaagcacacttataaaaaatattctctgaacaacacataatacctatctaacaatatcttagcgtcgtgtacactaaaattaagacttttgtatttgttacctctgacagagaatgtcattctggcgtagaagttagtttttacgtttgcatacaaattttaagactttcattcctgctcctttctagttttagaactttttctgctgacctacccggtcagttgttaggaagcttagcatgaggtgggctctttaacaccattctgagaactgttgatttagagaggaaggtgaggattttgccttggagaagagactgataaaaccaagtgtttattcttgtaaatcgtctccaagacctacacagtcagctaagcatgaatagcttacatctcatgccagccttcaacacccttgaaaaatatccttttctgtcttgctcattttcttcttataccataagttttatttggtatcattttctcttctcacaaaatgttcctattatatagcattttctgtattcacctcaacattacttctaactatgataacatcttttgaaaacatacaaatttttcagaatggatactaagtggaaatagcagtctttcattttcacctttcaactgaatccttttttcccctaccgaattggtatttaaaaaaaatcacagtcagcaatatgtatcctttctctcaagctcagaaaaattatgtagccacctgctaatatccagcaagctatcaagtctgcattttgggaataaagtagtttttcacatttttgttcagtttatggtattataaaggaaaaaatctctatgcgtcagtggattttaatttctttagaatcattatgctgttaagagtatgccagcaaacgtttctagagctatttaatataccttctgctatttaatataccaaatgcttttcagagaaatgcaatttaaatactgtgcttaacatattttactaagaagcagaaatattgaattattgttctataacgtaattgtgtgttgttgttttatatctatacaatatatacccctgtattaatggagaccattgctacactagggagaggcatggcctcttcagagcccacagcaggtggccgggatgtccagttccaatgttgttcccgactctgtgactcaaagcggagcccctcactgcttggcctcgggcttctcttggtaatgtagacggtaataactcacctacctcgcaaggatgttgtcacggtaggaaatatttataacttgttttgaaatcaaaagaacctatataaatgctaagcattataatatataatctttttcttgaaataaactttgtcatatcttgatggaatcaa

SEQ ID NO: 15907 - DNA, 3018 bp, Homo sapiens
  ENST00000427495
ggtgatacgtttgtgccacatgaaacattctctgcctctgaaggctccagaggctgtgggaagcagcacatcagcgacagctcctggctgctggactccgcagggagggaaggaagattggtcgcaatgtcccagcagaagtgcatcgtgatctttgccctggtgtgctgctttgccattctggttgcactgatcttttcagccgtggacatcatgggagaggatgaggatggactctcagaaaaaaattgccaaaataaatgtcgaattgccctggtggaaaatattcctgaaggccttaactattcagaaaatgcaccatttcacttatcacttttccaaggctggatgaatttactcaacatggccaaaaagtctgttgacatagtgtcttcccattgggatctcaaccacactcatccatcagcatgtcagggtcaacgtctttttgaaaagttgctccagctgacttcgcaaaatattgaaatcaagctagtgagtgatgtaacagctgattcaaaggtattagaagccttgaaattaaagggagccgaggtgacgtacatgaacatgaccgcttacaacaagggccggctgcagtcctccttctggatcgtggacaaacagcacgtgtatatcggcagtgccggtttggactggcaatccctgggacagatgaaagaactcggtgtcatcttctacaactgcagctgcctggtcctagatttacaaaggatatttgctctatatagttcattaaaattcaaaagcagagtgcctcaaacctggtccaaaagactctatggagtctatgacaatgaaaagaaattgcaacttcagttgaatgaaaccaaatctcaagcatttgtatcgaattctccaaaactcttttgccctaaaaacagaagttttgacatagatgccatctacagtgtgatagatgatgccaagcagtatgtgtacatcgctgtcatggactacctgcctatctccagcacaagcaccaaaaggacttactggccagacttggatgcaaaaataagagaagcattagttttacgaagcgttagagttcgactccttttaagcttctggaaggaaactgatccccttacgtttaactttatttcatctcttaaagcgatttgcactgaaatagccaactgcagtttgaaagttaaattttttgatctggaaagagagaatgcttgtgctacaaaagaacaaaagaatcacacctttcctaggttaaatcgcaacaagtacatggtgacagatggagcagcttatattggaaattttgattgggtagggaatgatttcactcagaatgctggcacgggccttgttatcaaccaggcagatgtgaggaacaacagaagcatcattaagcaacttaaagatgtgtttgaaagggactggtattcaccgtatgccaaaaccttacagccaaccaaacagccgaactgctcaagcctgttcaaactcaaacccctctccaacaaaactgccacagacgacacaggcggaaaggatccccggaacgtataacatgatgaagaaactgacaggacagctctgtatttcatatttatacataaaggacttgaggagagaaaaaacactttaatatgtctctttttttagggaaaaagcacacttataaaaaatattctctgaacaacacataatacctatctaacaatatcttagcgtcgtgtacactaaaattaagacttttgtatttgttacctctgacagagaatgtcattctggcgtagaagttagtttttacgtttgcatacaaattttaagactttcattcctgctcctttctagttttagaactttttctgctgacctacccggtcagttgttaggaagcttagcatgaggtgggctctttaacaccattctgagaactgttgatttagagaggaaggtgaggattttgccttggagaagagactgataaaaccaagtgtttattcttgtaaatcgtctccaagacctacacagtcagctaagcatgaatagcttacatctcatgccagccttcaacacccttgaaaaatatccttttctgtcttgctcattttcttcttataccataagttttatttggtatcattttctcttctcacaaaatgttcctattatatagcattttctgtattcacctcaacattacttctaactatgataacatcttttgaaaacatacaaatttttcagaatggatactaagtggaaatagcagtctttcattttcacctttcaactgaatccttttttcccctaccgaattggtatttaaaaaaaatcacagtcagcaatatgtatcctttctctcaagctcagaaaaattatgtagccacctgctaatatccagcaagctatcaagtctgcattttgggaataaagtagtttttcacatttttgttcagtttatggtattataaaggaaaaaatctctatgcgtcagtggattttaatttctttagaatcattatgctgttaagagtatgccagcaaacgtttctagagctatttaatataccttctgctatttaatataccaaatgcttttcagagaaatgcaatttaaatactgtgcttaacatattttactaagaagcagaaatattgaattattgttctataacgtaattgtgtgttgttgttttatatctatacaatatatacccctgtattaatggagaccattgctacactagggagaggcatggcctcttcagagcccacagcaggtggccgggatgtccagttccaatgttgttcccgactctgtgactcaaagcggagcccctcactgcttggcctcgggcttctcttggtaatgtagacggtaataactcacctacctcgcaaggatgttgtcacggtaggaaatatttataacttgttttgaaatcaaaagaacctatataaatgctaagcattataatatataatctttttcttgaaataaactttgtcatatcttgatggaatcaa

SEQ ID NO: 15908 - DNA, 3999 bp, Homo sapiens
  ENST00000556123
gatgctgccggcccgaggctgagccaccctccccgcggagttcccgcccggccctctgcaatccggagcccaagccgccggctacgcgccctgcgcccccttggtgccgcgtccagtgcccagcgcgctttgatgctgcagctccgggccgggccgctctgcttctctgctcgctgggacgctctccgacggctccgccctcgcctctcgccccgagtccctgctgaccccggggaggtggggtccgggccgggcacagccccgctgaggcaggatgttcacgtccaagtccaactcggtgtcgccctcgccgtccctggagcaggctgactcggacgccctggatatcagcaccaaagtgcagctctacggcgtgctgtggaagaggcctttcggcaggccgtcggccaagtggtcccggcggtttttcatcatcaaagagagctttctgctttactactctgagagcgaaaaaaagagctttgaaaccaataaatacttcaatatacatcctaaggtgaggcggcccctcccagggccacagcaggggagggcccagtgcgggcatcagagcttgcatcttgtgaggggaggggactgcgctcttgctctggcctagcagagagtctggagagcaaatcctcttggggcaaaagaccccctgcccctgtcctgggctggaccctcactctcctgtgccccagaccctgccccaacccttcctcttctctctgaacatcagttctggcctctgtcccatggccccagggtctagcttccatcctggggcacttggcaggaactggctttgtccaggggcccccagaacccctgagtgaccccagttgggtggggtgggggctgcctgttctggttcttcctcagggcgtcatccctctggggggctgcctggtggagcccaaggaagagcctagcatgccctatgccatgaagatctcccaccaggacttccatgtgagtaaagctcttccctcagcctgggctccgcaggagcagaccagcctctcaggcctcttcaggacacacatcccatgtcctggcctgggagaggggcatcagcacccagggatgtggggtgggtgacagggcagagctgggcctccatcaccctcagcgtggctgcctctcaggcatgcgcatggctcctcttcctggcaggggaacatcttgcttgctgctgagtcggagtttgagcagacccagtggctggagatgctgcaggagtctgggaaggtgtaagtgctcacagccaggagggcagcctgcagatccaggatggggtgggcggggctgcccctgaactccctgcctctctgctgggatcctggtgggcacagggccagggctgtgggagatggctagggtaggggagagcagacaggccaggttttagagcatctgtgaggggtcccctgagtgagcttgaaaagtgtctaggtcacaggtggcaggtgtgggtaccatttgtctccaactcttgggagttgtatttgatgcctcctgacacccatctcacctccccaggcccataattaattctagcaaggactagagctagtgctttgtaaattagggtcaagatcacagaaatctcctgccaacccagtccatttttatgtaaaccactgtcctgacacctgcctagtcaggctaggtcatgcttttagttccaaaaacaccgaccgtgtgctctgtggcaggccttgcactgggtagcggacattcagtaatgtaaaaaagccacccaggaagcaatctcctccctgctctaaaagtgctgttggcccagcccccagtggcccactttgcagcctgggccagcctccagctactgtaactgatccgtgctggtgacatgcccagagccatgggtgccagagtgaatgcaagttgagattctggaggagaaagggtgggcgagtacaaaacgtatgccttctctttcccctctacccttctgttttaatgattttctgtttcttcctcttctctcctctgtcccatctgccctccctccccaggacctggaagaatgcccagctgggagaagccatgatcaaaagcctggaggcccaggggctgcagttggctaaggaaaagcaggagtatttaggttggctggaggggtggttccctaatggtagcagcacttggggaccaggggctatagccaggggcttggtaaaggatgcagcagggatgagggtctctcaggtggggctatgagggaacagagaccagtttggcacctggagggcttcctggtacactacgcatccttttggccaacatgactgaaggcaggagcgtctgatggttaagagcctgggctctggatccagcttcatcatttgtcacccatctcagctgtgtatatctttaggcagctcagcctctctaagcctcaatttcctcatccttaaaatcgagttaaaaatagtctctagcttttagaggattgggttaaatgagacaatgtctgtaagtgcttgagccagacatgcagtaagggctccataagtggagttgatgttgttatcctatcctgggtccccagggtctggcttgtccccagtacccttgccccaggccattttaaaccttgccacagcattccagaccttgtgcccctgacaggttggtaaacatgcactgtttgggagagaagatgagactgagggtttgccttcagcctgggaccctctcccctctgcctgcttagacacttggggccccagcacttgctcccctatgcctgcttcagaacttcctaggttctgccctccttactagccagacattagtgcaggtggaaggtgggtgtgggactagcccaggtgcagcaggcctgggggatgcagagactgctttgaacttccaaggatgaggcccctcataaccctaggaaaagaaaaagcaggatgatgatgggggaaggagggtggcagcttccatcaccaggagctggcccaccctctggctggcagggctgcaggccccttccttgggagatgctgggggtgacagcgaccacctcaggcaccagctccctcaggacctcagagcactttcctgattgtgtgtgcatgtgtgtgtgtgtgcttgttttggcagacaaactgatggaagagaccgaagaactctgccttcagagggagcagagagaggtaggtgcacaccaaggggctctcagcagccgtggtgtaatggctcacgtttctagcactagggaatgatgcaggggagctgggtgcacagaggacttgctagaagatcagatggggcagggcggggaggccaaatgggatcacagtgcttgcttgggacttgctgtaacttgttggtaagaagtgtctttctccttaccaacccctgggagtaaagtgaaaagggtgggtgatgaccttctagagaaagagccatccaaagtgtcatcagctgcatcagttggtaatgagctgcttgtcaatgatgttcacgggagctataatgccctctgttatccatagagggctatctggcacctgagggtgattgggcttgatgatctcagaagttccttcattctctgaatgtcaaaagtccacagcaggctaagcactggcttgaggcagactggagggtaaaggagactcttgccttgtgtgaaggaggggagccaccgaagccctcttcttcatttagaatctcagtgcaggctgggcgcagtggctcacgcctgtaatcccagcactgtgggaggccaaggcgggtggatcacctgaggtcgggaattcaagaccagcctggccaacatggtgaaaccccgtctctactaaaaatacaaaaataagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctc

SEQ ID NO: 15909 - DNA, 4865 bp, Homo sapiens
  ENST00000322564
ccggagcccaagccgccggctacgcgccctgcgcccccttggtgccgcgtccagtgcccagcgcgctttgatgctgcagctccgggccgggccgctctgcttctctgctcgctgggacgctctccgacggctccgccctcgcctctcgccccgagtccctgctgaccccggggaggtggggtccgggccgggcacagccccgctgaggcaggatgttcacgtccaagtccaactcggtgtcgccctcgccgtccctggagcaggctgactcggacgccctggatatcagcaccaaagtgcagctctacggcgtgctgtggaagaggcctttcggcaggccgtcggccaagtggtcccggcggtttttcatcatcaaagagagctttctgctttactactctgagagcgaaaaaaagagctttgaaaccaataaatacttcaatatacatcctaagggcgtcatccctctggggggctgcctggtggagcccaaggaagagcctagcatgccctatgccatgaagatctcccaccaggacttccatgggaacatcttgcttgctgctgagtcggagtttgagcagacccagtggctggagatgctgcaggagtctgggaaggtgacctggaagaatgcccagctgggagaagccatgatcaaaagcctggaggcccaggggctgcagttggctaaggaaaagcaggagtatttagacaaactgatggaagagaccgaagaactctgccttcagagggagcagagagaggagcttgagcgccttaaccaggtgctggaggccgagaagcagcagttcgaggaggtggtgcaggagctgagaatggagcaggagcagatcaagagggagctggaactgactgcaagatgccttaagggtgtagaacaagagaaaaaggaactgaggcacctcacggagtccttgcagcagacactggaggaactctccatagagaagaagaaaaccctggaaatgctggaggagaacgagaaccacctgcagacactggccaatcagagtgagcagccccctcccagtgggggcctccatagcaacctccggcagatcgaggagaagatgcagcagctcttagaggagaagctcctggcagagaagcggatgaaggagaacgaggagcgctcacgggccctggaggaggagcgtgagttctactccagccagtcccaggcactgcagaactcgctgcaggagctgacggcagagaagcagcaggctgagcgggagctcaaggctgaggtgaaggtccgcatggacctggagaggcgtctccgggaggcagaaggggccttgcgaagcctggaacaggggctgaattccaaggtgcggaataaggagaaggaggagaggatgcgggctgatgtgagccatctgaaaaggttctttgaggagtgcatccggaatgccgagctggaggccaagatgcctgtgatcatgaagaactccgtgtacatccataaggcagccactcgccgcatcaagagctgccgcttccaccgacgccggtccagcacctcctggaatgacatgaagccgtcccagtccttcatgacctcccagctggatgccaacaacatggaggagctaaaggaggtggccaagcggctcagcagggaccagcgcttccgggaatccatctaccacatcatggccacccagcctggagccccctcggcactctcccggggtggaaagtgatgggcgctcctcccctgcttcccaagtctcccctggatgggcgggggaggggaaggggtggcagagggaggcctcactctaccagctcctggcctctctggtctggagcctatgtctcctctgggccggagctccacttgggggccagccttgccctcaaaggacatggacgctgccttcctcatcctcaccccacaccccacctttgggtccacaccagggccatgcaggcctgagctgggtgctggttgtcatggtgaggtgaggacaggacctggttgtatgtggagatttgtgtcggttagggagtggggtggggaggtgctgtctaccactgtgccatcaggcagggtctgccccactgaggaagatggcagccctccctggtgcccactggacctctctgggactctgctgccctgcccgtggtcctcatgtagaaaggccttgcctccctaccttgacattcccttttccccagggtttcctaaccctccctttgcttctgacactcagcaaaatgtccctcagctgagacccctcatttacaccacatcatgctgtgcaggaggaaaggggcctaggacagcagcttctgggctcctgacataccacacacccgccacagtgccgcttttcctgagctcaggccctggctgtggggccacccactgattcccctcctcctctggtgagctcactcacagccttggcaccctgcaagggtagaatgatggcaccagtccctcctgcctgtgtacctagggccctggctgggagctggggccagcagtgatgctgggggctcccccagaggacacgtaacaagctcaggagtgggctgggcacagtggctcatgcctgtaatcccagcactttgagaggccgaggcgggaggattacttgaagtcaggagtttgagaccagcctggccaatacggcaaaaccctgtctctacaaaaaataaaaaaaataaaataaatagctgggcatggtggtgcatgcctgtagtcccagctacttgggagactgaaatgaggggattgattgagcctgggaggttgaggctgcagtgagctgagattgtgccactgcactccagccagggtaacagagcaagaccctgtctcaaacaaacacaaggaaaacaagctcaggagtgaaggaaagtcactctggttcctgcattatgtacttctggttgcgcagggaggcagtgttcctgctggtcgagagatcacagatatctccttcccagctgcccctgcttcagtcaccttgctgcctcctctccctgcagagatttcagcctgtgaagcaatgtgaccatgaactctggcagctggggaccctgggcctgtgatgaggccagtagtcattggttggctcagtgtcattgggagtgaagctgaaacgccaatctgcagcttctgtggaagaccaccaccctccagggggctgaagggtgtgtctgtctctcactcatggacagacagactgcccagaccctctccctgcaggcccaccctccaaagctacctgaggctattggcctccagaaaaggggtccacctgggatcagggtgctcttggacactgttgacattaaaggtgctcattctttgctgcttggaaaaccaagaagttctgagagataaacagatggcttcggggcaagtcccagcaaaaagtgcaagaacctgggagcccacaacctattctgtgggaagaggagcattgttgcctctaagaacacatgcacatctgctgctaggctggccgagcccaggccgggctgccctgctctttgctcagtgcttcctgccaaaactaatctcagtggttcctttcagtgatgggtggactttggtggcttcatacagtctctgcagaatctagctggggagagggctgagtcagtttggaataaatgcatttgacagggctgagcctaaatgtaaaactttaaacgtgtataacatgcataaacctggaacttgtttctctaacacgtatgaaggatgaactttgaattgaaggggaatatttataaaaccaagattactgtttccttttttttaaaagaattaatcatggcttgcttttagagagatctttcataattttcagatgcatttgtttttcttgggcgagctattaaccagacaggaaagtgctagtcttcgtttgctttgtactgctgtaacagaatacctgagactgggtaatttataaggaacagaaatgtactggctcacagatatggtggctaagacgtccaatatcaaggtgctggcatctggcaaggaccttcttgttgcatcatcccatggttgacaggcaaagagagggtgagagagcaagaggggccaaacttattcttttataacaaacccaccccctcgataatgacattaatcctttcataagggagagtcttcatggccaaatcacctcttaaatgttccacctcttgcggatcacctgaggtcaggagtttgagaccagcctggccaatatggcgaaaccccacctgtactaaaaatacaaaaattagctgggcgtggtggtgggtgcctatagtcccagctactcaggaggctgagacaggagaatcacttgaacctgggaggtggaggttgcagtgagccgagattgtgctattgtactccagcctgggcaacatgagtgaaactctgtctcagaaaaaaaaaaaaggtcccacctcttaatattgttacaatggcaatcaaatttctttttttaatcctgcaaactactgggatagtaattaaatttcagtgtgagtttgggagggaacaaacattcaaactgtagcagtgcttttccatgcacatttaccaatcgatacttcctcctattctcaccctgtattttccatgcctcaggcaagtctgaattatcttcagccaactgaacaatccataagtgtttattcgttaaaagctcactatgtacctagcactgtaaatagaaaaatagcaacatctctatatcaaaatacgtaggagtggaaattacttagtggagatatgttgatgtaatttttttaatttttaaaaacaaaactcttattccttggccaattaaatgcatttcctgcagtatcta

SEQ ID NO: 15910 - DNA, 635 bp, Homo sapiens
  ENST00000555982
ccatgctgtctcgggaggcggtgatagcagaatctccctggggtgccctccccaggcagcaatgccaggatgcctgtgtccacctccctccaccaggatggcagccaggagcggccggtgagcctgacctctaccacctcctcgtcgggctcctcctgtgacagtcgcagtgccatggaggagcccagcagctccgaggctcccgccaagaatggggcaggctccctgagaagccggcatctgcccaacagcaacaacaactccagcagctggttgaacgtgaaggggcccctctccccgttcaacagccgggcagcggcagggcctgcacaccacaagctcagctacctgggccgagtggtgcgggagatcgtggagacagagcgcatgtacgtacaggacctgcgcagcatcgtggaggactacctcttgaagatcattgacacacccgggctgctgaagccagaacaggtcagcgccctctttgggaacatagaaaatatctacgcgctgaacagccagctcctcagagacctggacagctgcaatagtgaccccgtggctgtggccagctgctttgtggaaaggagccaagagtttgatatctacactcagtattgcaacaattaccccaa

SEQ ID NO: 15911 - DNA, 2118 bp, Homo sapiens
  ENST00000634379
cctcgctccctcctgccctcccgctgcagctccggctccgctcgacttcctgccgggcgctggcaagccgcgcgctgcctggggtctccgggggccgcgcttgcagctggccgagtccgggccagctgaggggctggcggtgggcgggagcggtcggcggcctcagccccttcagagagcgactttcaaactcgcgcccgcgtcgcggcagcacctgggcagccccgcacgccgtgcgcgtcccgagcccgcggggcagctaccgctcgaatctccctggggtgccctccccaggcagcaatgccaggatgcctgtgtccacctccctccaccaggatggcagccaggagcggccggtgagcctgacctctaccacctcctcgtcgggctcctcctgtgacagtcgcagtgccatggaggagcccagcagctccgaggctcccgccaagaatggggcaggctccctgagaagccggcatctgcccaacagcaacaacaactccagcagctggttgaacgtgaaggggcccctctccccgttcaacagccgggcagcggcagggcctgcacaccacaagctcagctacctgggccgagtggtgcgggagatcgtggagacagagcgcatgtacgtacaggacctgcgcagcatcgtggagagccaagagtttgatatctacactcagtattgcaacaattaccccaactccgtggccgccctgacggaatgcatgcgggacaagcagcaggccaagttctttcgggaccggcaggagctgctacagcactcgctgcccttgggctcctacctgctgaagccagtccagcgcatcctcaagtaccacctgctgctccaggaaattgccaagcattttgatgaagaagaggatggctttgaggtggtggaggatgccattgacaccatgacctgtgtggcctggtacatcaacgacatgaagaggaggcatgagcacgcggtccggctccaggagattcagtcactcctcatcaactggaaggggcccgacctgaccacctacggggagcttgtcctggagggcacattccgcgtgcatcgcgtgcgcaatgaaaggacctttttcctctttgacaaaacactgcttatcaccaagaagcggggcgatcactttgtctacaagggcaacatcccgtgctcctccctgatgctgatcgaaagcaccagagactccctgtgcttcactgtcacccactacaagcacagcaagcagcagtacagcatccaggccaagacagtggaggagaaacggaactggactcaccacatcaagaggctcatcctagagaaccaccatgccaccattccccagaaggccaaggaagccatcttggaaatggattcctattatcccaatcggtaccgctgcagcccagagcggctgaagaaggcttggtcctcccaggatgaggtgtccaccaatgtgcgccaggggcgccggcaatctgagccaaccaaacacctgctcaggcaactcaacgagaaagcccgagcagcaggaatgaagggaaaggggcgcagggagtctgaaagctccaggagcagcagaaggcccagtggccggtctccaaccagtactgagaagcgcatgagcttcgagtccatttcttccctgccagaggttgagccggaccctgaggctgggagtgagcaagaggtattttctgctgtggaagggcccagtgccgaggagacgccttcagacacagaatctccagaagtcctggagacacagcttgatgcccaccagggccttctggggatggaccccccaggtgacatggtggacttcgtggcagctgagagcactgaggaccttaaggccctgagcagcgaggaggaagaagaaatgggaggtgccgcccaggagcctgagagccttctgccaccctctgtgctggaccaggccagcgtcattgcggagcgatttgtcagcagcttctctcggcggagcagcgtggcacaggaggacagcaagtccagtggctttgggagcccgcggctggtcagccggagcagcagcgtgctcagcctggagggcagcgagaagggcctggcccggcatggcagtgccacagact

SEQ ID NO: 15912 - DNA, 10351 bp, Homo sapiens
  ENST00000247226
ctcagccccttcagagagcgactttcaaactcgcgcccgcgtcgcggcagcacctgggcagccccgcacgccgtgcgcgtcccgagcccgcggggcagctaccgctcgaatctccctggggtgccctccccaggcagcaatgccaggatgcctgtgtccacctccctccaccaggatggcagccaggagcggccggtgagcctgacctctaccacctcctcgtcgggctcctcctgtgacagtcgcagtgccatggaggagcccagcagctccgaggctcccgccaagaatggggcaggctccctgagaagccggcatctgcccaacagcaacaacaactccagcagctggttgaacgtgaaggggcccctctccccgttcaacagccgggcagcggcagggcctgcacaccacaagctcagctacctgggccgagtggtgcgggagatcgtggagacagagcgcatgtacgtacaggacctgcgcagcatcgtggaggactacctcttgaagatcattgacacacccgggctgctgaagccagaacaggtcagcgccctctttgggaacatagaaaatatctacgcgctgaacagccagctcctcagagacctggacagctgcaatagtgaccccgtggctgtggccagctgctttgtggaaaggagccaagagtttgatatctacactcagtattgcaacaattaccccaactccgtggccgccctgacggaatgcatgcgggacaagcagcaggccaagttctttcgggaccggcaggagctgctacagcactcgctgcccttgggctcctacctgctgaagccagtccagcgcatcctcaagtaccacctgctgctccaggaaattgccaagcattttgatgaagaagaggatggctttgaggtggtggaggatgccattgacaccatgacctgtgtggcctggtacatcaacgacatgaagaggaggcatgagcacgcggtccggctccaggagattcagtcactcctcatcaactggaaggggcccgacctgaccacctacggggagcttgtcctggagggcacattccgcgtgcatcgcgtgcgcaatgaaaggacctttttcctctttgacaaaacactgcttatcaccaagaagcggggcgatcactttgtctacaagggcaacatcccgtgctcctccctgatgctgatcgaaagcaccagagactccctgtgcttcactgtcacccactacaagcacagcaagcagcagtacagcatccaggccaagacagtggaggagaaacggaactggactcaccacatcaagaggctcatcctagagaaccaccatgccaccattccccagaaggccaaggaagccatcttggaaatggattcctattatcccaatcggtaccgctgcagcccagagcggctgaagaaggcttggtcctcccaggatgaggtgtccaccaatgtgcgccaggggcgccggcaatctgagccaaccaaacacctgctcaggcaactcaacgagaaagcccgagcagcaggaatgaagggaaaggggcgcagggagtctgaaagctccaggagcagcagaaggcccagtggccggtctccaaccagtactgagaagcgcatgagcttcgagtccatttcttccctgccagaggttgagccggaccctgaggctgggagtgagcaagaggtattttctgctgtggaagggcccagtgccgaggagacgccttcagacacagaatctccagaagtcctggagacacagcttgatgcccaccagggccttctggggatggaccccccaggtgacatggtggacttcgtggcagctgagagcactgaggaccttaaggccctgagcagcgaggaggaagaagaaatgggaggtgccgcccaggagcctgagagccttctgccaccctctgtgctggaccaggccagcgtcattgcggagcgatttgtcagcagcttctctcggcggagcagcgtggcacaggaggacagcaagtccagtggctttgggagcccgcggctggtcagccggagcagcagcgtgctcagcctggagggcagcgagaagggcctggcccggcatggcagtgccacagactccctcagctgtcagctctccccagaagtggacatcagtgtgggggtggccacagaggacagcccttctgtcaatgggatggagcccccaagcccaggctgcccagtggagcctgaccggtcttcctgcaagaagaaggaatcagcactctccacccgagaccggctgttgctagacaagattaagagctattatgaaaatgcagaacaccatgatgcaggcttcagcgtccgtcgccgggagagcctctcctacatccccaaaggactggtaagaaactccatctccaggttcaacagccttccccggccagacccagagccagtacctccagtggggagcaagagacaggtgggctcccggccgacttcgtgggccctgtttgagctcccaggaccaagccaggcagtcaaaggggacccacctcccatctcagatgctgagttccgcccatcttcagaaattgtgaagatctgggagggaatggagtcttccggagggagccctgggaaggggccaggccagggccaggccaatggctttgacctgcatgagccactcttcatcctggaggagcatgagctgggagccatcacagaggagtcggccactgcctccccggaaagctcctctcccactgaggggcgcagcccggcccacctggcccgggagctgaaagagctggtgaaggagctgagcagcagtacccagggggagctggtggccccactgcacccccgcatcgtgcagctctcccacgtaatggacagccacgtgagcgagcgcgtcaagaacaaggtctaccagctggcccgccagtacagcctccggatcaagagcaacaagccagtgatggccaggccaccactgcagtgggaaaaggtggcccctgagagggatgggaagagccccactgtgccctgtctacaggaagaggctggagagccattaggtggcaaaggtaagaggaagccggtgctgtctctatttgactatgagcagctgatggcccaggagcacagccctcccaagccctcctcggctggggagatgtcaccacagcgtttcttcttcaacccgtctgctgtcagccagaggaccacctcgcctgggggccggccctccgcccggagccccctcagccccacagagaccttcagctggcccgacgtccgtgagctctgctccaagtatgcctcccgcgatgaggcacgccgagcagggggcggccggccccgcggcccacccgtcaacaggagccactcggtgccggagaacatggtagagccacctctgtcgggcagggtgggccgctgccgcagcctgagcaccaagaggggccggggaggcggagaggctgcccaatcccctgggcctctgccccagagcaagccggatggaggcgagaccctgtatgtcactgcagacctcaccctggaggacaaccggcgggtgattgtcatggagaagggaccccttcccagccccactgcagggctggaggagagcagtggccagggaccaagctcaccggtggccctgctggggcaggttcaggacttccagcagtctgcagagtgccagccgaaggaagagggttccagggacccggcagacccgagccagcagggcagagtgagaaaccttagagagaagttccaggccttgaactctgtcggttgatgctgactcctgggggagggaggagtcatgttggaggttggggaagaacctgggcatccttcccctcaagcctgggctcatggagcccctgcccagggccctcaggtgggcggaaagtccatcccctccgcccttcaggaaggatgctcccgtgtgcaggggtctcctgcctgtgccatccactggggctcgagacaatttcccactcacctgtgaggccggtgtggctgcttcccttgtaaatagttgttctctggtaagaagccaaatatttaagctcacttcttcccagagagaggaagctctgctcaggcctccagcgttggctggccatggccacagccagatggaggagcccatccccaggagactcaggcagtggcctggagaggctttgttctgtaacggtgccttttcttagggtccaggcaggaatgaagccaataatttattgctttccattctgtggtatgatgtgcgtgtgcgtgagtgtgtggcccctgtttattcccctcctgtcaagaatgaagtggattcagttcaggtacttttgagggttgttgtgctgaccctgtggttgtcgctgatgtacacacatttcattatttgccaatggtgcaataaccactgctgaccaacccactatgtgtgaactccttcctaggcttggctggggtagggaaggttattcatgggccagggatgtcttagggagatggagacatggaggttgttccttccacactcaattgtcacttgggcttatgaaacataaggcacccgggtactggtgggggaggtggggcaggaggatgtgagggcgggctttttctttctgctgcctagactcccatgggcttctctgtctagcagcagcctgctgtcctgtctagggtagggggtcccgcatgccagccttttgctcttttccccaagggccagagttggaccaagaaaaagggaggtggtgaggtggatagactgtttttctcataagcagatgctcccagtatctggtgccttttgcgtttctctccggtccccaggaaacatcctagaagacaaggattttttttttttttttttttgagacagagtcttattctgtcacccaggctggagtgcaatggcgtgatcttggcttactgcaacctccgcctcccaggttcaagcaattctcgttgtctcagcctcccaggtcgctgggactacaggcatgagccaccacacccagctaattttttgtatttttagtagagacggggtttcgccgtgttgaccaggctggtctcgaacttctgacctcaggtgatccacccacctcggcctcccaaagtgctgggattacaggggtgagccactgcatgcggctgaaggtaaggattctaaactcggagactagaaatgtcctaaaggtgtctgcaacattggatgaggagtacaagtgcatttttctgggatgattcctccctttttatcacattctcagaagtatctttgattcagaagagttaggaatgcctccctatttcagttgggttttctgccctttctccacagaggtccagactcattttgcttaattttttttctagctggggcctgggaggtagaggcttcagggcctgggtggtagagctgcctgacaagtgttcagcagggctgctgggtcagggccctgtgggccttctgacccaacctgaagatgggtctgctaagtctaacaaggtcaagggaagatcagagggacccagattcttttttatcccccacttgaaacggagtcttgctctgtcgcccaggctggagcgcagtggtgcaatcttggctcactgcaacctccgcctccctgaccctcacactgtccagtgcccttgtggttactcagcatcatatcttgagactggcctggcaggagccagtgactgtggaatgaccacagaagattcagggcagctgccagaccaggggctatctctgccctgcgctgcttctgctcaagagaggttgtcactagcctctgatcttcccttgaagaacccgactggggctcttcagagggtggggcccaggaagttgtagttaaccccttccccaggcagtccttacacggccatctaggtatgcctgggaaccttgcaccaggtcggtggttctcactggctgcccattggaattatctggggagccttctggaaacgcagtgcttacattccatctccctagaccaacagaaactgccctctggaggtgaatcccaggcttagagattctgatgattctgcggtccagtgagtgctgagatctgtcctgagctctgtggggaggggcctggactgatcactgcttggaaatgattttgccctacagtaggccttcaagttgatcaaatgcatgaatgagcaagcttttcttggagtttgtgatgaagcccaggaaccgggtgcttgcagtcgtcccataaggctcccagggacaagctagagaatctggctgtccctctgtctccatggtgccagccctcttaggctcagttcaaagggagaggaggctagttaaataagaaactgagagaaacatggagcattattgatttattagaaaaactagtaaatgggtttcctctggttggtggaagcacggttgagcaggtggaggacaggacccagctggccccagggccagccccagattgcatggtctgtgcccaacagggttgcattcctctgcagccgccgcctcctcatttcctccctgagcttgtttgtccaagccaccaagccatgtggtcccgctggcttcatcctcctctggattcctgcccccctcccatgaagggaggaagaggattcagggtcagcctaggggaccctggctccctccgataggcaggaaggaggagggatgcggaggagaggctgagccttccacgggcctcctgttaggggtgttggtggaggccaggttggggagggaagcctaaggaccctccacacctcccacagccagagtcagttgaggctgggacaaaggggaaggagagagggaaggaggaccgcctgaccttgcccagaaggagcttcctctaaactgccctgggaaggaagcctggtatgctggtgtggactggagctgtgtcaacctcgtttgggaatactgtcaaaagactgtagagtagaataaggagagaaaaaaaaaaaaagaccttgctagggcactgggagagcttagccctggtgtggcacacacagggtctcccaaagctggatgcctgcattttcagtctagttggtcgaatgtcttggagcctgggtgacaggagggatgtgtggggagctggcaacagaatggtcacatgcagctggctgccctggaccaggccaggggacctggggtggtgagatgctagctcttccactagagcccttcctttctcgggtctgtggagttgcttgctggaaatgcctcacttcaggtgctgatttggcacacgtggaagggggagggtgggcccttgtccctaggctccctaaagactggcccagggaaacagttgagggagatgtttgccaccatctgcccttcagcaaggaacctgctctctgccccagaggaggacatgcctgcaagtgcaccaaaggcctactttattgctaggtgagtgcagtcacctcactgccttggtttccccagatacagaaagaggctggtgagtgatacacactaggttccctgtatagggtcatatgtaccaaagccaaatgaagaccttgctcaccagggcgggaacctggggatgtcaggctccatcggatgacgtcttccttcctgtggctcctgcctgctgcagttggtgtcaccctgacatatagtgtcagggccacagggtggaactgatttctgccggcactggtcagcactcagggttcctcagggggcctcattctggatgcctgcccctgtggcttctacctgaacctcacccacttcatctccatggaactaaggtccttctcacggggaaggtgatagaaacttgactgcaggccctggggactttcatggtttccttgggggaaaatgcctgctgccctccgccctcccccccacccccgacccgcttgactgctctcttggacctaaccctagtttgatactgggccagaactgtgttgctttcggagtagagtggtggggaaaatatggaatgagctttctcttcctccagaagtatgacctgagcagcaaggggaaggccattcctggggacgttggttgcagagcttctggtgctcagggctggagggtggtagatatttgacctctgtactcatgtgaccccctccccgccaagacctggggccaggacgtggagaagctgatcaaggggtaccacaccttcatggctctggccctgacatttgtcccagttgtgcaggagtagctgtcacatgggtggtgataccaagacatggctgcgtctgccaccccgagaaaacagatgatcaactttactgtctgcccagccattaccctccaaagtcccagctgcagacaggatgcaattgagcatttggctttgggatgctttactgcaggtgcggggggtatccatcttatatctgggggcccacactgtcccgtagggggcctatgtctgttggatattgctggtttggctgccactgggagtggggcgagggtcccagcattgagagggagagccttaggcagtgttgtgacgcacctgtcactccttcagatcagagccctgtgccctagccacggttttcaatgaggaatggtctgaccttgctgcccttcctgggaccgcctgtggtggcacaaagggtgctagaggcactcagccaggccctgccaaccgtgggagggtaccctttgatctggggggagaagcagagaggagggatgtggtggcccctgaagtgagagtcccagttctgcggaagcccagtgggaaggaggctggcagctcccaaggccctgcacccagtctggtcccctcagccccccagagcccctggcccagagctagggctttgtgggccacctgaaggctccttcctcatgcccctagggggctggccatgcatttccagtgtcttcttcctttcccctttccctggctgccaccaggtgggaggtgacccgaagcaagacttgctttaggaacgggcagcgtttgaagaaccccatcagccttctccagctcttttttttttttttttttggttgggggtaaggggcctgtgccccctcggctcaggaggagggtgggagaggagggcgtgtgcctcagagaaccgtttcctgcccccaggcctggaggccccaaaggcgccagaggagctgggagcccctgtccctggagcggagccagcgcgggcgagggcatggagggggcgtcggcccaggacacgcgggcgaaggcagcttttgcagtgcagcgtggggcccgggggcccggcccgcgactcgactcatctcgattcgaccggcgggcggcggcgagaggaggccaaggcctgggctgcccggtctctgcgcgtcccgactccgccgcgcccgccagccccacctgctacttctttttggggaagaagctgaatctcttctccttgtctttcttgccgaggctggcgtcggggccggagagggaaggcaggggcaggctctgcgccttgacgcggatgctctgggactcgttgatggcggtgctcacgccctgcagccaggacagcatctcctcctgcggggcggagggtcacggtggagtctggaggcccacagccccccacctcccgggccaggcaacaatggtgggggctcttgggactgccccttctgagggggcctccagggcaagcggcctggggtcctccacctacccccttcttagccaggtctgggctaggctgcccgcgcttacctcatccttgccatggaagagccactcgctgccattactcagcctaggaggacaaagggtttcctgtcatggagacacctctggagggggcgctgggcagagggctggctctgatcccacaataccctgagccgaacatccagacccctctcaggcagcccagcactttctgagaggtcaaagtctggaccatcagcctctttgatttgaaaaacccctgaggagcagctcaggcctggcactggtcccctacagagggcctctgccctgccactaatgccaaatcaagccatcaacccgagctttcaaaggccaggaaggcctcacctcagcttaaagacgtgcttcttcttcttgtagttggcagcaatctcacagatggcatgtctcagggccaggggttcctccccatggtagggcatccccagggccaggttcttggcatccttgtagaaggttagctcactgttcctgagcacacagtacaggttgttccaggacctgcaaagatgcagacaggcaggtcacccacatcctgatatggtatctctagagtcaattcctatagcttcaccattaaaaaaaattacacca

SEQ ID NO: 15913 - DNA, 554 bp, Homo sapiens
  ENST00000554088
agtatcccctgtgcttaattgctggaggtttgtgcaggtcctcagccctgtggcgctcacctcccagggctgtggcctgggtccctacccagcggggacctgcagaattgtgtcgggaagttgcatttcctgggctagggccccccagcaatcaggaatgagagaaatgcagaaagtatgacccacacgcagaactggttctgaatagaacatttattgacgaagttttgcaggaggcggcgggcgctttaattcccgaggctgttggtggcagctcgctgctcaccccaagcctgttaactgctaggttgccggtgctggggacaatgcggctgcccggcccctcgccaccctcgtggtgcccggatgggagctctcctgaggaaagcgaatctccctggggtgccctccccaggcagcaatgccaggatgcctgtgtccacctccctccaccaggatggcagccaggagcggccggtgagcctgacctctaccacctcctcgtcgggctcctcctgtgacagtcgcagtgccatggaggagcccagcagctc

SEQ ID NO: 15914 - DNA, 658 bp, Homo sapiens
  ENST00000554499
gtgagccatcatgcctggccgagaaagcgagttttctagaagactgattcactgattgatgactgactggattgattcatgttgcaagatggaagaggtcatggctggggcatacttaagagaactggagacccaatctccctggggtgccctccccaggcagcaatgccaggatgcctgtgtccacctccctccaccaggatggcagccaggagcggccggtgagcctgacctctaccacctcctcgtcgggctcctcctgtgacagtcgcagtgccatggaggagcccagcagctccgaggctcccgccaagaatggggcaggctccctgagaagccggcatctgcccaacagcaacaacaactccagcagctggttgaacgtgaaggggcccctctccccgttcaacagccgggcagcggcagggcctgcacaccacaagctcagctacctgggccgagtggtgcgggagatcgtggagacagagcgcatgtacgtacaggacctgcgcagcatcgtggaggactacctcttgaagatcattgacacacccgggctgctgaagccagaacaggtcagcgccctctttgggaacatagaaaatatctacgcgctgaacagccagctcctcagagacctggacagctgcaatagtga

SEQ ID NO: 15915 - DNA, 244 bp, Homo sapiens
  ENST00000556801
gggcctgcacaccacaagctcagctacctgggccgagtggtgcgggagatcgtggagacagagcgcatgtacgtacaggacctgcgcagcatcgtggaggactacctcttgaagatcattgacacacccgggctgctgaagccagaacaggtcagcgccctctttgggaacatagaaaatatctacgcgctgaacagagccaagagtttgatatctacactcagtattgcaacaattaccccaa

SEQ ID NO: 15916 - DNA, 4403 bp, Homo sapiens
  ENST00000490180
gtttgatatctacactcagtattgcaacaattaccccaactccgtggccgccctgacggaatgcatgcgggacaagcagcaggccaagttctttcgggaccggcaggagctgctacagcactcgctgcccttgggctcctacctgctgaagccagtccagcgcatcctcaagtaccacctgctgctccaggaaattgccaagcattttgatgaagaagaggatggctttgaggtggtggaggatgccattgacaccatgacctgtgtggcctggtacatcaacgacatgaagaggaggcatgagcacgcggtccggctccaggagattcagtcactcctcatcaactggaaggggcccgacctgaccacctacggggagcttgtcctggagggcacattccgcgtgcatcgcgtgcgcaatgaaaggacctttttcctctttgacaaaacactgcttatcaccaagaagcggggcgatcactttgtctacaagggcaacatcccggtaaccaggccctgccccatctcctctgccatcttctctccttcccaaaggatctgggctccccttcttgtctgcttcttggggctccagcaccacccttctgagatcaccctccctgcttccccaggctgtcaaccttgtgcttgactgtcctttccctctgcccctagtgctcctccctgatgctgatcgaaagcaccagagactccctgtgcttcactgtcacccactacaagcacagcaagcagcagtacagcatccaggccaagacagtggaggagaaacggaactggactcaccacatcaagaggctcatcctagagaaccaccatgccaccattccccagaaggccaaggaagccatcttggaaatggattcctattatcccaatcggtaccgctgcagcccagagcggctgaagaaggcttggtcctcccaggatgaggtgtccaccaatgtgcgccaggggcgccggcaatctgagccaaccaaacacctgctcaggcaactcaacgagaaaggtgagtgtgtgaggtggccagccattcccagtgagcgggggaggaggagggaggaggggaagcagccgacaacctggggtgtgacctgagggtggaggattgtcagaatagtgtagagggaactctgcctccattccccccagaagagggcctcgcccctggctggctgaggagaggggctggagctctcccccatgcacaggcctcatgccctttcctccggaaacaatgagagccgagcaacaggcacagacctgcgctgctctgtggcccctgggcccctgctctgtcagtcattcttttgaaagcccaggagactaggtgagggttctgggagcaggagcccccagtgaggacttccccagggagctgtccagaggtctttttcctgcttactgatctcttcccctcccctcccctgcccctcgcccgtgtgctgggggacccggtggtgatgtctgcagcccgagcagcaggaatgaagggaaaggggcgcagggagtctgaaagctccaggagcagcagaaggcccagtggccggtctccaaccagtactgagaagcgcatgagcttcgagtccatttcttccctgccagaggttgagccggaccctgaggctgggagtgagcaagaggtattttctgctgtggaagggcccagtgccgaggagacgccttcagacacagaatctccagaagtcctggagacacagcttgatgcccaccagggccttctggggatggaccccccaggtgacatggtggacttcgtggcagctgagagcactgaggaccttaaggccctgagcagcgaggaggaagaagaaatgggaggtgccgcccaggagcctgagagccttctgccaccctctgtgctggaccaggccagcgtcattgcggagcgatttgtcagcagcttctctcggcggagcagcgtggcacaggaggacagcaagtccagtggctttgggagcccgcggctggtcagccggagcagcagcgtgctcagcctggagggcagcgagaagggcctggcccggcatggcagtgccacagactccctcagctgtcagctctccccagaagtggacatcagtgtgggggtggccacagaggacagcccttctgtcaatgggatggagcccccaagcccaggctgcccagtggagcctgaccggtcttcctgcaagaagaaggaatcagcactctccacccgagaccggctgttgctagacaagattaagagctattatgaaaatgcagaacaccatgatgcaggcttcagcgtccgtcgccgggagagcctctcctacatccccaaaggactggtaagaaactccatctccaggttcaacagccttccccggccagacccagagccagtacctccagtggggagcaagagacaggtgggctcccggccgacttcgtgggccctgtttgagctcccaggaccaagccaggcagtcaaaggggacccacctcccatctcagatgctgagttccgcccatcttcagaaattgtgaagatctgggagggaatggagtcttccggagggagccctgggaaggggccaggccagggccaggccaatggctttgacctgcatgagccactcttcatcctggaggagcatgagctgggagccatcacagaggagtcggccactgcctccccggaaagctcctctcccactgaggggcgcagcccggcccacctggcccgggagctgaaagagctggtgaaggagctgagcagcagtacccagggggagctggtggccccactgcacccccgcatcgtgcagctctcccacgtaatggacagccacgtgagcgagcgcgtcaagaacaaggtctaccagctggcccgccagtacagcctccggatcaagagcaacaagccagtgatggccaggccaccactgcagtgggaaaaggtggcccctgagagggatgggaagagccccactgtgccctgtctacaggaagaggctggagagccattaggtggcaaaggtaagaggaagccggtgctgtctctatttgactatgagcagctgatggcccaggagcacagccctcccaagccctcctcggctggggagatgtcaccacagcgtttcttcttcaacccgtctgctgtcagccagaggaccacctcgcctgggggccggccctccgcccggagccccctcagccccacagagaccttcagctggcccgacgtccgtgagctctgctccaagtatgcctcccgcgatgaggcacgccgagcagggggcggccggccccgcggcccacccgtcaacaggagccactcggtgccggagaacatggtagagccacctctgtcgggcagggtgggccgctgccgcagcctgagcaccaagaggggccggggaggcggagaggctgcccaatcccctgggcctctgccccagagcaagccggatggaggcgagaccctgtatgtcactgcagacctcaccctggaggacaaccggcgggtgattgtcatggagaagggaccccttcccagccccactgcagggctggaggagagcagtggccagggaccaagctcaccggtggccctgctggggcaggttcaggacttccagcagtctgcagagtgccagccgaaggaagagggttccagggacccggcagacccgagccagcagggcagagtgagaaaccttagagagaagttccaggccttgaactctgtcggttgatgctgactcctgggggagggaggagtcatgttggaggttggggaagaacctgggcatccttcccctcaagcctgggctcatggagcccctgcccagggccctcaggtgggcggaaagtccatcccctccgcccttcaggaaggatgctcccgtgtgcaggggtctcctgcctgtgccatccactggggctcgagacaatttcccactcacctgtgaggccggtgtggctgcttcccttgtaaatagttgttctctggtaagaagccaaatatttaagctcacttcttcccagagagaggaagctctgctcaggcctccagcgttggctggccatggccacagccagatggaggagcccatccccaggagactcaggcagtggcctggagaggctttgttctgtaacggtgccttttcttagggtccaggcaggaatgaagccaataatttattgctttccattctgtggtatgatgtgcgtgtgcgtgagtgtgtggcccctgtttattcccctcctgtcaagaatgaagtggattcagttcaggtacttttgagggttgttgtgctgaccctgtggttgtcgctgatgtacacacatttcattatttgccaatggtgcaataaccactgctgacc

SEQ ID NO: 15917 - DNA, 3106 bp, Homo sapiens
  ENST00000471182
tttcaggtctctctggaggacctgacagggcatgaaggcaacgagaagggggctgggccggagcccccaggctcagaggaggaggaggaggagcaggaggagagcctggcggtggcggagcaggtagccgactttgccagctccctgctggccgccctccactgctggcactatcgggccaacgctttacttttctcccggggcgctatgggaaaggggcgcagggagtctgaaagctccaggagcagcagaaggcccagtggccggtctccaaccagtactgagaagcgcatgagcttcgagtccatttcttccctgccagaggttgagccggaccctgaggctgggagtgagcaagaggtattttctgctgtggaagggcccagtgccgaggagacgccttcagacacagaatctccagaagtcctggagacacagcttgatgcccaccagggccttctggggatggaccccccaggtgacatggtggacttcgtggcagctgagagcactgaggaccttaaggccctgagcagcgaggaggaagaagaaatgggaggtgccgcccaggagcctgagagccttctgccaccctctgtgctggaccaggccagcgtcattgcggagcgatttgtcagcagcttctctcggcggagcagcgtggcacaggaggacagcaagtccagtggctttgggagcccgcggctggtcagccggagcagcagcgtgctcagcctggagggcagcgagaagggcctggcccggcatggcagtgccacagactccctcagctgtcagctctccccagaagtggacatcagtgtgggggtggccacagaggacagcccttctgtcaatgggatggagcccccaagcccaggctgcccagtggagcctgaccggtcttcctgcaagaagaaggaatcagcactctccacccgagaccggctgttgctagacaagattaagagctattatgaaaatgcagaacaccatgatgcaggcttcagcgtccgtcgccgggagagcctctcctacatccccaaaggactggtaagaaactccatctccaggttcaacagccttccccggccagacccagagccagtacctccagtggggagcaagagacaggtgggctcccggccgacttcgtgggccctgtttgagctcccaggaccaagccaggcagtcaaaggggacccacctcccatctcagatgctgagttccgcccatcttcagaaattgtgaagatctgggagggaatggagtcttccggagggagccctgggaaggggccaggccagggccaggccaatggctttgacctgcatgagccactcttcatcctggaggagcatgagctgggagccatcacagaggagtcggccactgcctccccggaaagctcctctcccactgaggggcgcagcccggcccacctggcccgggagctgaaagagctggtgaaggagctgagcagcagtacccagggggagctggtggccccactgcacccccgcatcgtgcagctctcccacgtaatggacagccacgtgagcgagcgcgtcaagaacaaggtctaccagctggcccgccagtacagcctccggatcaagagcaacaagccagtgatggccaggccaccactgcagtgggaaaaggtggcccctgagagggatgggaagagccccactgtgccctgtctacaggaagaggctggagagccattaggtggcaaaggtaagaggaagccggtgctgtctctatttgactatgagcagctgatggcccaggagcacagccctcccaagccctcctcggctggggagatgtcaccacagcgtttcttcttcaacccgtctgctgtcagccagaggaccacctcgcctgggggccggccctccgcccggagccccctcagccccacagagaccttcagctggcccgacgtccgtgagctctgctccaagtatgcctcccgcgatgaggcacgccgagcagggggcggccggccccgcggcccacccgtcaacaggagccactcggtgccggagaacatggtagagccacctctgtcgggcagggtgggccgctgccgcagcctgagcaccaagaggggccggggaggcggagaggctgcccaatcccctgggcctctgccccagagcaagccggatggaggcgagaccctgtatgtcactgcagacctcaccctggaggacaaccggcgggtgattgtcatggagaagggaccccttcccagccccactgcagggctggaggagagcagtggccagggaccaagctcaccggtggccctgctggggcaggttcaggacttccagcagtctgcagagtgccagccgaaggaagagggttccagggacccggcagacccgagccagcagggcagagtgagaaaccttagagagaagttccaggccttgaactctgtcggttgatgctgactcctgggggagggaggagtcatgttggaggttggggaagaacctgggcatccttcccctcaagcctgggctcatggagcccctgcccagggccctcaggtgggcggaaagtccatcccctccgcccttcaggaaggatgctcccgtgtgcaggggtctcctgcctgtgccatccactggggctcgagacaatttcccactcacctgtgaggccggtgtggctgcttcccttgtaaatagttgttctctggtaagaagccaaatatttaagctcacttcttcccagagagaggaagctctgctcaggcctccagcgttggctggccatggccacagccagatggaggagcccatccccaggagactcaggcagtggcctggagaggctttgttctgtaacggtgccttttcttagggtccaggcaggaatgaagccaataatttattgctttccattctgtggtatgatgtgcgtgtgcgtgagtgtgtggcccctgtttattcccctcctgtcaagaatgaagtggattcagttcaggtacttttgagggttgttgtgctgaccctgtggttgtcgctgatgtacacacatttcattatttgccaatggtgcaataaccactgctgaccaacc

SEQ ID NO: 15918 - DNA, 3001 bp, Homo sapiens
  ENST00000484731
cctgacagggcatgaaggcaacgagaagggggctgggccggagcccccaggctcagaggaggaggaggaggagcaggaggagagcctggcggtggcggagcagggaaaggggcgcagggagtctgaaagctccaggagcagcagaaggcccagtggccggtctccaaccagtactgagaagcgcatgagcttcgagtccatttcttccctgccagaggttgagccggaccctgaggctgggagtgagcaagaggtattttctgctgtggaagggcccagtgccgaggagacgccttcagacacagaatctccagaagtcctggagacacagcttgatgcccaccagggccttctggggatggaccccccaggtgacatggtggacttcgtggcagctgagagcactgaggaccttaaggccctgagcagcgaggaggaagaagaaatgggaggtgccgcccaggagcctgagagccttctgccaccctctgtgctggaccaggccagcgtcattgcggagcgatttgtcagcagcttctctcggcggagcagcgtggcacaggaggacagcaagtccagtggctttgggagcccgcggctggtcagccggagcagcagcgtgctcagcctggagggcagcgagaagggcctggcccggcatggcagtgccacagactccctcagctgtcagctctccccagaagtggacatcagtgtgggggtggccacagaggacagcccttctgtcaatgggatggagcccccaagcccaggctgcccagtggagcctgaccggtcttcctgcaagaagaaggaatcagcactctccacccgagaccggctgttgctagacaagattaagagctattatgaaaatgcagaacaccatgatgcaggcttcagcgtccgtcgccgggagagcctctcctacatccccaaaggactggtaagaaactccatctccaggttcaacagccttccccggccagacccagagccagtacctccagtggggagcaagagacaggtgggctcccggccgacttcgtgggccctgtttgagctcccaggaccaagccaggcagtcaaaggggacccacctcccatctcagatgctgagttccgcccatcttcagaaattgtgaagatctgggagggaatggagtcttccggagggagccctgggaaggggccaggccagggccaggccaatggctttgacctgcatgagccactcttcatcctggaggagcatgagctgggagccatcacagaggagtcggccactgcctccccggaaagctcctctcccactgaggggcgcagcccggcccacctggcccgggagctgaaagagctggtgaaggagctgagcagcagtacccagggggagctggtggccccactgcacccccgcatcgtgcagctctcccacgtaatggacagccacgtgagcgagcgcgtcaagaacaaggtctaccagctggcccgccagtacagcctccggatcaagagcaacaagccagtgatggccaggccaccactgcagtgggaaaaggtggcccctgagagggatgggaagagccccactgtgccctgtctacaggaagaggctggagagccattaggtggcaaaggtaagaggaagccggtgctgtctctatttgactatgagcagctgatggcccaggagcacagccctcccaagccctcctcggctggggagatgtcaccacagcgtttcttcttcaacccgtctgctgtcagccagaggaccacctcgcctgggggccggccctccgcccggagccccctcagccccacagagaccttcagctggcccgacgtccgtgagctctgctccaagtatgcctcccgcgatgaggcacgccgagcagggggcggccggccccgcggcccacccgtcaacaggagccactcggtgccggagaacatggtagagccacctctgtcgggcagggtgggccgctgccgcagcctgagcaccaagaggggccggggaggcggagaggctgcccaatcccctgggcctctgccccagagcaagccggatggaggcgagaccctgtatgtcactgcagacctcaccctggaggacaaccggcgggtgattgtcatggagaagggaccccttcccagccccactgcagggctggaggagagcagtggccagggaccaagctcaccggtggccctgctggggcaggttcaggacttccagcagtctgcagagtgccagccgaaggaagagggttccagggacccggcagacccgagccagcagggcagagtgagaaaccttagagagaagttccaggccttgaactctgtcggttgatgctgactcctgggggagggaggagtcatgttggaggttggggaagaacctgggcatccttcccctcaagcctgggctcatggagcccctgcccagggccctcaggtgggcggaaagtccatcccctccgcccttcaggaaggatgctcccgtgtgcaggggtctcctgcctgtgccatccactggggctcgagacaatttcccactcacctgtgaggccggtgtggctgcttcccttgtaaatagttgttctctggtaagaagccaaatatttaagctcacttcttcccagagagaggaagctctgctcaggcctccagcgttggctggccatggccacagccagatggaggagcccatccccaggagactcaggcagtggcctggagaggctttgttctgtaacggtgccttttcttagggtccaggcaggaatgaagccaataatttattgctttccattctgtggtatgatgtgcgtgtgcgtgagtgtgtggcccctgtttattcccctcctgtcaagaatgaagtggattcagttcaggtacttttgagggttgttgtgctgaccctgtggttgtcgctgatgtacacacatttcattatttgccaatggtgcaataaccactgctgaccaaccca

SEQ ID NO: 15919 - DNA, 462 bp, Homo sapiens
  ENST00000492928
cccagtggagcctgaccggtcttcctgcaagaagaaggaatcagcactctccacccgagaccggctgttgctagacaagattaagagctattatgaaaatgcagaacaccatgatgcaggcttcagcgtccgtcgccgggagagcctctcctacatccccaaaggactggtaagaaactccatctccaggagactcaggcagtggcctggagaggctttgttctgtaacggtgccttttcttagggtccaggcaggaatgaagccaataatttattgctttccattctgtggtatgatgtgcgtgtgcgtgagtgtgtggcccctgtttattcccctcctgtcaagaatgaagtggattcagttcaggtacttttgagggttgttgtgctgaccctgtggttgtcgctgatgtacacacatttcattatttgccaatggtgcaataaccactgctgaccaac

SEQ ID NO: 15920 - DNA, 4397 bp, Homo sapiens
  ENST00000394691
gctcgacttcctgccgggcgctggcaagccgcgcgctgcctggggtctccgggggccgcgcttgcagctggccgagtccgggccagctgaggggctggcggtgggcgggagcggtcggcggcctcagccccttcagagagcgactttcaaactcgcgcccgcgtcgcggcagcacctgggcagccccgcacgccgtgcgcgtcccgagcccgcggggcagctaccgctcgaatctccctggggtgccctccccaggcagcaatgccaggatgcctgtgtccacctccctccaccaggatggcagccaggagcggccggtgagcctgacctctaccacctcctcgtcgggctcctcctgtgacagtcgcagtgccatggaggagcccagcagctccgaggctcccgccaagaatggggcaggctccctgagaagccggcatctgcccaacagcaacaacaactccagcagctggttgaacgtgaaggggcccctctccccgttcaacagccgggcagcggcagggcctgcacaccacaagctcagctacctgggccgagtggtgcgggagatcgtggagacagagcgcatgtacgtacaggacctgcgcagcatcgtggagagccaagagtttgatatctacactcagtattgcaacaattaccccaactccgtggccgccctgacggaatgcatgcgggacaagcagcaggccaagttctttcgggaccggcaggagctgctacagcactcgctgcccttgggctcctacctgctgaagccagtccagcgcatcctcaagtaccacctgctgctccaggaaattgccaagcattttgatgaagaagaggatggctttgaggtggtggaggatgccattgacaccatgacctgtgtggcctggtacatcaacgacatgaagaggaggcatgagcacgcggtccggctccaggagattcagtcactcctcatcaactggaaggggcccgacctgaccacctacggggagcttgtcctggagggcacattccgcgtgcatcgcgtgcgcaatgaaaggacctttttcctctttgacaaaacactgcttatcaccaagaagcggggcgatcactttgtctacaagggcaacatcccgtgctcctccctgatgctgatcgaaagcaccagagactccctgtgcttcactgtcacccactacaagcacagcaagcagcagtacagcatccaggccaagacagtggaggagaaacggaactggactcaccacatcaagaggctcatcctagagaaccaccatgccaccattccccagaaggccaaggaagccatcttggaaatggattcctattatcccaatcggtaccgctgcagcccagagcggctgaagaaggcttggtcctcccaggatgaggtgtccaccaatgtgcgccaggggcgccggcaatctgagccaaccaaacacctgctcaggcaactcaacgagaaagcccgagcagcaggaatgaagggaaaggggcgcagggagtctgaaagctccaggagcagcagaaggcccagtggccggtctccaaccagtactgagaagcgcatgagcttcgagtccatttcttccctgccagaggttgagccggaccctgaggctgggagtgagcaagaggtattttctgctgtggaagggcccagtgccgaggagacgccttcagacacagaatctccagaagtcctggagacacagcttgatgcccaccagggccttctggggatggaccccccaggtgacatggtggacttcgtggcagctgagagcactgaggaccttaaggccctgagcagcgaggaggaagaagaaatgggaggtgccgcccaggagcctgagagccttctgccaccctctgtgctggaccaggccagcgtcattgcggagcgatttgtcagcagcttctctcggcggagcagcgtggcacaggaggacagcaagtccagtggctttgggagcccgcggctggtcagccggagcagcagcgtgctcagcctggagggcagcgagaagggcctggcccggcatggcagtgccacagactccctcagctgtcagctctccccagaagtggacatcagtgtgggggtggccacagaggacagcccttctgtcaatgggatggagcccccaagcccaggctgcccagtggagcctgaccggtcttcctgcaagaagaaggaatcagcactctccacccgagaccggctgttgctagacaagattaagagctattatgaaaatgcagaacaccatgatgcaggcttcagcgtccgtcgccgggagagcctctcctacatccccaaaggactggtaagaaactccatctccaggttcaacagccttccccggccagacccagagccagtacctccagtggggagcaagagacaggtgggctcccggccgacttcgtgggccctgtttgagctcccaggaccaagccaggcagtcaaaggggacccacctcccatctcagatgctgagttccgcccatcttcagaaattgtgaagatctgggagggaatggagtcttccggagggagccctgggaaggggccaggccagggccaggccaatggctttgacctgcatgagccactcttcatcctggaggagcatgagctgggagccatcacagaggagtcggccactgcctccccggaaagctcctctcccactgaggggcgcagcccggcccacctggcccgggagctgaaagagctggtgaaggagctgagcagcagtacccagggggagctggtggccccactgcacccccgcatcgtgcagctctcccacgtaatggacagccacgtgagcgagcgcgtcaagaacaaggtctaccagctggcccgccagtacagcctccggatcaagagcaacaagccagtgatggccaggccaccactgcagtgggaaaaggtggcccctgagagggatgggaagagccccactgtgccctgtctacaggaagaggctggagagccattaggtggcaaaggtaagaggaagccggtgctgtctctatttgactatgagcagctgatggcccaggagcacagccctcccaagccctcctcggctggggagatgtcaccacagcgtttcttcttcaacccgtctgctgtcagccagaggaccacctcgcctgggggccggccctccgcccggagccccctcagccccacagagaccttcagctggcccgacgtccgtgagctctgctccaagtatgcctcccgcgatgaggcacgccgagcagggggcggccggccccgcggcccacccgtcaacaggagccactcggtgccggagaacatggtagagccacctctgtcgggcagggtgggccgctgccgcagcctgagcaccaagaggggccggggaggcggagaggctgcccaatcccctgggcctctgccccagagcaagccggatggaggcgagaccctgtatgtcactgcagacctcaccctggaggacaaccggcgggtgattgtcatggagaagggaccccttcccagccccactgcagggctggaggagagcagtggccagggaccaagctcaccggtggccctgctggggcaggttcaggacttccagcagtctgcagagtgccagccgaaggaagagggttccagggacccggcagacccgagccagcagggcagagtgagaaaccttagagagaagttccaggccttgaactctgtcggttgatgctgactcctgggggagggaggagtcatgttggaggttggggaagaacctgggcatccttcccctcaagcctgggctcatggagcccctgcccagggccctcaggtgggcggaaagtccatcccctccgcccttcaggaaggatgctcccgtgtgcaggggtctcctgcctgtgccatccactggggctcgagacaatttcccactcacctgtgaggccggtgtggctgcttcccttgtaaatagttgttctctggtaagaagccaaatatttaagctcacttcttcccagagagaggaagctctgctcaggcctccagcgttggctggccatggccacagccagatggaggagcccatccccaggagactcaggcagtggcctggagaggctttgttctgtaacggtgccttttcttagggtccaggcaggaatgaagccaataatttattgctttccattctgtggtatgatgtgcgtgtgcgtgagtgtgtggcccctgtttattcccctcctgtcaagaatgaagtggattcagttcaggtacttttgagggttgttgtgctgaccctgtggttgtcgctgatgtacacacatttcattatttgccaatggtgcaataaccactgctgacc

SEQ ID NO: 15921 - DNA, 5221 bp, Homo sapiens
  ENST00000377748
aaactaaggccttcctggtagccaaggagcccagcagaggggctgctgctggctgctgggattgcagaggccggggtctctgtggtgttgctttcctggaaaggagggacggcacctccagggcagccagcagtgtgggagcccattccagggcgcaaatgggcactcaggaatggaaaatccaagaaggaaccaaccaccaacaaggaaatgcagtgtgagcggcggctgcgaagtctgtgccttcaaatatacagcgcccaggggacctgtgttggacggggagcaaattggcagggctgagagcgccttggttttctgtgcagacaggtccagctgcagaaattaagactggggctgagtcggggagaagccttccatgttgagatggcaactgggcaaagcaggacggagacctgtgtgtctgattagagaggcctgtggcattggcatgtggctggaggtccaggcagggtgccaccaccgcagaggtcaagcatgaattcagtcctgacaaaacatgggtctccacctcgaagctggctcagcctttgttcaggaaccgacgaccagagccccgctgaaaagaagggactgcgctgtcagaaccccgcctgcatggacaaggggcgggcggccaaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccaggtattaggactcagggctcccctcaggaagctgggcccagctgggattgccgaggggcccctagccctggcagcggtcctgggctagtcggctgcctggccggggaacctgcaggctcccacaggaagaggtgtggagacctgccctcgggggcctctcccagggtccagcctgagcccccaccaggggtctctgcccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactccactgggaagagtcctttgctttggggcccagtgactcggggcacttgagttcagggcggcctccttgtgttcctgtgctcctccacttgccacggatgggccacggatggagcttgccatgggaagcactgggaagtaatggggtgtggggtgccaccagaccaacacccccagacttccccaccttcagccaccatcagagcctctccccaggtgccccccggggattcagggctgaatctgcccagttcccacactcaggccagccctcttgggaaggtgggtcctccatgggggtcccttcaggaactttttttttttttttaatacagagtctcactctgtcacctaggttggagtgcagtggtgtgatgtcggctcactgcaacctctgcctcccgggttcaaacgattctcctgccccagccactctagtagctggaactgcaggtgtgcaccaccacgccgggctagtttttgtattttaagtagagacggcatttcaccatattggtcaggctggtctcgaactcctgaccccaagtgttccgcccgcctctgcctcccatagtgctagaattacaggcctgagctactgcgcttggccccttgcggtacttttggcccaacctcctccatggctggggacgcggaggccgagagagaagtcacttgccctggctctaccttgaagtggttctcagggttggggcgagagtcggggtggggaccgagatgcagctctatcctgtgcccctggtcgcagcaggcagcccagcgcttcgcgtgttctacttggcctgtccgctgccgcctaatgagctcaggtctaggccgagcagagggggcacctggtcggactcggttgggctcgggcggccccgcctccccccgcccgccaggcgggcccttctcgacggcgcggggcgggccctgcgggcgcggggctgaaggcggaaccacgacgggcagagagcacggagccgggaagcccctgggcgcccgtcggagggctatggagcagcggccgc

SEQ ID NO: 15922 - DNA, 2664 bp, Homo sapiens
  ENST00000487949
aggctgtgggctagcgtgatggcgccggtgctggagaaggcgcggcgcacgcgagcgctgctacagcccggggacttcctcaaaggcttcaagatggtacgggcggggccgggcgcaggcgggggcactgaggcagggctggggcgccgaaaagcctccacggcccgatccggtctgcccagcatccccaacctcccccaggcccgtaaccgcacttgaccccttgtggccaagggtgaggaattacgaggcggtcgcccgggtttgagcctccacctgaccatctacccctgatccctggccacgggtggtcactttggctgaggctcagtttcctcatcaggaaacagggatcataagcttgctgcccccttggggtggtcgcccaagtgcagtaaggaagcgcttgcgcagcgcctggcgcgggccggcccgcagggagcgcgcggtaaccggcgccgtggttgttctgccccgggccagttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccaggtattaggactcagggctcccctcaggaagctgggcccagctgggattgccgaggggcccctagccctggcagcggtcctgggctagtcggctgcctggccggggaacctgcaggctcccacaggaagaggtgtggagacctgccctcgggggcctctcccagggtccagcctgagcccccaccaggggtctctgcccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactcca

SEQ ID NO: 15923 - DNA, 3475 bp, Homo sapiens
  ENST00000377725
gagtcgactgagcccgtcccgcggctcccgtccccctctccccgcgcgccccatgaggctttggcagtctcggcccgagccttagagccttagacaccggggaggagaccctggtcctgttcctaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactcca

SEQ ID NO: 15924 - DNA, 3613 bp, Homo sapiens
  ENST00000377728
agatgaagaccagggagaggaaagggtggacctgaggcccccatggagaagggacgggcaggatgtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccaggtattaggactcagggctcccctcaggaagctgggcccagctgggattgccgaggggcccctagccctggcagcggtcctgggctagtcggctgcctggccggggaacctgcaggctcccacaggaagaggtgtggagacctgccctcgggggcctctcccagggtccagcctgagcccccaccaggggtctctgcccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactcca

SEQ ID NO: 15925 - DNA, 3753 bp, Homo sapiens
  ENST00000377732
ggacgctgacctcttttgaagggaggactgaggagatcaccccacccctcctccggttgggaggccagtggggcccaggggagcctgggtgccccgctgactgatgccctctgctcctcccctgcagacgaccagagccccgctgaaaagaagggactgcgctgtcagaaccccgcctgcatggacaaggggcgggcggccaaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccaggtattaggactcagggctcccctcaggaagctgggcccagctgggattgccgaggggcccctagccctggcagcggtcctgggctagtcggctgcctggccggggaacctgcaggctcccacaggaagaggtgtggagacctgccctcgggggcctctcccagggtccagcctgagcccccaccaggggtctctgcccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactcca

SEQ ID NO: 15926 - DNA, 3697 bp, Homo sapiens
  ENST00000400915
cccagtccccggcgtccccggcgcccccgcccgccgcccgccccccgcgcggcacggggcctgctccatggacgaccagagccccgctgaaaagaagggactgcgctgtcagaaccccgcctgcatggacaaggggcgggcggccaaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccaggtattaggactcagggctcccctcaggaagctgggcccagctgggattgccgaggggcccctagccctggcagcggtcctgggctagtcggctgcctggccggggaacctgcaggctcccacaggaagaggtgtggagacctgccctcgggggcctctcccagggtccagcctgagcccccaccaggggtctctgcccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactcca

SEQ ID NO: 15927 - DNA, 3550 bp, Homo sapiens
  ENST00000377740
cttgatctcccgctgtgaccagcccctctctgcctggcaggggaaagccaccaaactaaggccttcctggtagccaaggagcccagcagaggggctgctgctggctgctgggattgcagaggccggggtctctgtggtgttgctttcctggaaaggagggacggcacctccagggcagccagcagtgtgggagcccattccagggcgcaaatgggcactcaggaatggaaaatccaagaaggaaccaaccaccaacaaggaaatgcagtgtgagcggcggctgcgaagtctgtgccttcaaatatacagcgcccaggggacctgtgttggacggggagcaaattggcagggctgagagcgccttggttttctgtgcagacaggtccagctgcagaaattaagactggggctgagtcggggagaagccttccatgttgagatggcaactgggcaaagcaggacggagacctgtgtgtctgattagagaggcctgtggcattggcatgtggctggaggtccaggcagggtgccaccaccgcagaggtcaagcatgaattcagtcctgacaaaacatgggtctccacctcgaagctggctcagcctttgttcaggaaccgacgaccagagccccgctgaaaagaagggactgcgctgtcagaaccccgcctgcatggacaaggggcgggcggccaaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactcca

SEQ ID NO: 15928 - DNA, 210 bp, Homo sapiens
  ENST00000639593
atgtttctctactggaggaagcggggcacctacgagctggaggccctgcccggcgacctggccgagctggagctggggacggtggagcgtttctcgtggagctccaccctggacatcatcgaggacctcggggacgaccagagccccgctgaaaagaagggactgcgctgtcagaaccccgcctgcatggacaaggggcgggcggccaag

SEQ ID NO: 15929 - DNA, 4698 bp, Homo sapiens
  ENST00000400913
agcattcaaggagctccccaggagaaagagcaagttctgaggagccctctgagcccggcattggtgttgaggagggagtcagagaagagaggggcccggggccgcgcagaggcgcagaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccaggtattaggactcagggctcccctcaggaagctgggcccagctgggattgccgaggggcccctagccctggcagcggtcctgggctagtcggctgcctggccggggaacctgcaggctcccacaggaagaggtgtggagacctgccctcgggggcctctcccagggtccagcctgagcccccaccaggggtctctgcccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactccactgggaagagtcctttgctttggggcccagtgactcggggcacttgagttcagggcggcctccttgtgttcctgtgctcctccacttgccacggatgggccacggatggagcttgccatgggaagcactgggaagtaatggggtgtggggtgccaccagaccaacacccccagacttccccaccttcagccaccatcagagcctctccccaggtgccccccggggattcagggctgaatctgcccagttcccacactcaggccagccctcttgggaaggtgggtcctccatgggggtcccttcaggaactttttttttttttttaatacagagtctcactctgtcacctaggttggagtgcagtggtgtgatgtcggctcactgcaacctctgcctcccgggttcaaacgattctcctgccccagccactctagtagctggaactgcaggtgtgcaccaccacgccgggctagtttttgtattttaagtagagacggcatttcaccatattggtcaggctggtctcgaactcctgaccccaagtgttccgcccgcctctgcctcccatagtgctagaattacaggcctgagctactgcgcttggccccttgcggtacttttggcccaacctcctccatggctggggacgcggaggccgagagagaagtcacttgccctggctctaccttgaagtggttctcagggttggggcgagagtcggggtggggaccgagatgcagctctatcctgtgcccctggtcgcagcaggcagcccagcgcttcgcgtgttctacttggcctgtccgctgccgcctaatgagctcaggtctaggccgagcagagggggcacctggtcggactcggttgggctcgggcggccccgcctccccccgcccgccaggcgggcccttctcgacggcgcggggcgggccctgcgggcgcggggctgaaggcggaaccacgacgggcagagagcacggagccgggaagcccctgggcgcccgtcggagggctatggagcagcggccgc

SEQ ID NO: 15930 - DNA, 4725 bp, Homo sapiens
  ENST00000535355
gcagaccgcggcttcctccggccgccatggggacaggacccggtgtctccggacgcctagcagcctccaggccgggcccggggctgcccctccgggactcggagccctcctgggccgggggtcgtgcccgcgacggtgatagccaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccaggtattaggactcagggctcccctcaggaagctgggcccagctgggattgccgaggggcccctagccctggcagcggtcctgggctagtcggctgcctggccggggaacctgcaggctcccacaggaagaggtgtggagacctgccctcgggggcctctcccagggtccagcctgagcccccaccaggggtctctgcccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactccactgggaagagtcctttgctttggggcccagtgactcggggcacttgagttcagggcggcctccttgtgttcctgtgctcctccacttgccacggatgggccacggatggagcttgccatgggaagcactgggaagtaatggggtgtggggtgccaccagaccaacacccccagacttccccaccttcagccaccatcagagcctctccccaggtgccccccggggattcagggctgaatctgcccagttcccacactcaggccagccctcttgggaaggtgggtcctccatgggggtcccttcaggaactttttttttttttttaatacagagtctcactctgtcacctaggttggagtgcagtggtgtgatgtcggctcactgcaacctctgcctcccgggttcaaacgattctcctgccccagccactctagtagctggaactgcaggtgtgcaccaccacgccgggctagtttttgtattttaagtagagacggcatttcaccatattggtcaggctggtctcgaactcctgaccccaagtgttccgcccgcctctgcctcccatagtgctagaattacaggcctgagctactgcgcttggccccttgcggtacttttggcccaacctcctccatggctggggacgcggaggccgagagagaagtcacttgccctggctctaccttgaagtggttctcagggttggggcgagagtcggggtggggaccgagatgcagctctatcctgtgcccctggtcgcagcaggcagcccagcgcttcgcgtgttctacttggcctgtccgctgccgcctaatgagctcaggtctaggccgagcagagggggcacctggtcggactcggttgggctcgggcggccccgcctccccccgcccgccaggcgggcccttctcgacggcgcggggcgggccctgcgggcgcggggctgaaggcggaaccacgacgggcagagagcacggagccgggaagcccctgggcgcccgtcggagggctatggagcagcggccgc

SEQ ID NO: 15931 - DNA, 4715 bp, Homo sapiens
  ENST00000340850
agtttgcgctgagtcgactgagcccgtcccgcggctcccgtccccctctccccgcgcgccccatgaggctttggcagtctcggcccgagccttagagccttagacaccggggaggagaccctggtcctgttcctaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccaggtattaggactcagggctcccctcaggaagctgggcccagctgggattgccgaggggcccctagccctggcagcggtcctgggctagtcggctgcctggccggggaacctgcaggctcccacaggaagaggtgtggagacctgccctcgggggcctctcccagggtccagcctgagcccccaccaggggtctctgcccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactccactgggaagagtcctttgctttggggcccagtgactcggggcacttgagttcagggcggcctccttgtgttcctgtgctcctccacttgccacggatgggccacggatggagcttgccatgggaagcactgggaagtaatggggtgtggggtgccaccagaccaacacccccagacttccccaccttcagccaccatcagagcctctccccaggtgccccccggggattcagggctgaatctgcccagttcccacactcaggccagccctcttgggaaggtgggtcctccatgggggtcccttcaggaactttttttttttttttaatacagagtctcactctgtcacctaggttggagtgcagtggtgtgatgtcggctcactgcaacctctgcctcccgggttcaaacgattctcctgccccagccactctagtagctggaactgcaggtgtgcaccaccacgccgggctagtttttgtattttaagtagagacggcatttcaccatattggtcaggctggtctcgaactcctgaccccaagtgttccgcccgcctctgcctcccatagtgctagaattacaggcctgagctactgcgcttggccccttgcggtacttttggcccaacctcctccatggctggggacgcggaggccgagagagaagtcacttgccctggctctaccttgaagtggttctcagggttggggcgagagtcggggtggggaccgagatgcagctctatcctgtgcccctggtcgcagcaggcagcccagcgcttcgcgtgttctacttggcctgtccgctgccgcctaatgagctcaggtctaggccgagcagagggggcacctggtcggactcggttgggctcgggcggccccgcctccccccgcccgccaggcgggcccttctcgacggcgcggggcgggccctgcgggcgcggggctgaaggcggaaccacgacgggcagagagcacggagccgggaagcccctgggcgcccgtcggagggctatggagcagcggccgc

SEQ ID NO: 15932 - DNA, 4794 bp, Homo sapiens
  ENST00000537245
accgcggtgcactccagcccccaggaagagaggcagcttggagggggccaaattcagggtcaaagatgagtcttggggaacgggggtcgccccagaccttcgggggctcctctgtctctaaagggagcgatgcagggcacgaccagagccccgctgaaaagaagggactgcgctgtcagaaccccgcctgcatggacaaggggcgggcggccaaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccaggtattaggactcagggctcccctcaggaagctgggcccagctgggattgccgaggggcccctagccctggcagcggtcctgggctagtcggctgcctggccggggaacctgcaggctcccacaggaagaggtgtggagacctgccctcgggggcctctcccagggtccagcctgagcccccaccaggggtctctgcccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactccactgggaagagtcctttgctttggggcccagtgactcggggcacttgagttcagggcggcctccttgtgttcctgtgctcctccacttgccacggatgggccacggatggagcttgccatgggaagcactgggaagtaatggggtgtggggtgccaccagaccaacacccccagacttccccaccttcagccaccatcagagcctctccccaggtgccccccggggattcagggctgaatctgcccagttcccacactcaggccagccctcttgggaaggtgggtcctccatgggggtcccttcaggaactttttttttttttttaatacagagtctcactctgtcacctaggttggagtgcagtggtgtgatgtcggctcactgcaacctctgcctcccgggttcaaacgattctcctgccccagccactctagtagctggaactgcaggtgtgcaccaccacgccgggctagtttttgtattttaagtagagacggcatttcaccatattggtcaggctggtctcgaactcctgaccccaagtgttccgcccgcctctgcctcccatagtgctagaattacaggcctgagctactgcgcttggccccttgcggtacttttggcccaacctcctccatggctggggacgcggaggccgagagagaagtcacttgccctggctctaccttgaagtggttctcagggttggggcgagagtcggggtggggaccgagatgcagctctatcctgtgcccctggtcgcagcaggcagcccagcgcttcgcgtgttctacttggcctgtccgctgccgcctaatgagctcaggtctaggccgagcagagggggcacctggtcggactcggttgggctcgggcggccccgcctccccccgcccgccaggcgggcccttctcgacggcgcggggcgggccctgcgggcgcggggctgaaggcggaaccacgacgggcagagagcacggagccgggaagcccctgggcgcccgtcggagggctatggagcagcggccgc

SEQ ID NO: 15933 - DNA, 4968 bp, Homo sapiens
  ENST00000489097
gcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactggggtagggcttgatggggctcagggtggaagtgggactgggagtaggggtggccccatgttgcaggctccgggtctctgcaggtgtgacgtgtgtgtctgtgtggtggcccgtgagcgagcgcatccctgcgtgggcagacccgtgctggtgtgcacgccagtgtgagggagtgcggtggggtctgtgtacttgtgcattttaatcatgtatgcaggagccaggcctgcgtgtgggcaggcgtgtgacaggtctgccgtggtatgcagatgcgcctgtgtgagcacctctgcgggcaggtgtctgtggacctgcgtgtgatcccatgcgggcttcccttttccgttgggaaggtgggggcagctggggctgtgggtggggcgggggctcgtgggggcggggcccaagctgaagcgactggccgcctggttctaacacacatgcctcctgtcctgggggcagggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccaggtattaggactcagggctcccctcaggaagctgggcccagctgggattgccgaggggcccctagccctggcagcggtcctgggctagtcggctgcctggccggggaacctgcaggctcccacaggaagaggtgtggagacctgccctcgggggcctctcccagggtccagcctgagcccccaccaggggtctctgcccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactccactgggaagagtcctttgctttggggcccagtgactcggggcacttgagttcagggcggcctccttgtgttcctgtgctcctccacttgccacggatgggccacggatggagcttgccatgggaagcactgggaagtaatggggtgtggggtgccaccagaccaacacccccagacttccccaccttcagccaccatcagagcctctccccaggtgccccccggggattcagggctgaatctgcccagttcccacactcaggccagccctcttgggaaggtgggtcctccatgggggtcccttcaggaactttttttttttttttaatacagagtctcactctgtcacctaggttggagtgcagtggtgtgatgtcggctcactgcaacctctgcctcccgggttcaaacgattctcctgccccagccactctagtagctggaactgcaggtgtgcaccaccacgccgggctagtttttgtattttaagtagagacggcatttcaccatattggtcaggctggtctcgaactcctgaccccaagtgttccgcccgcctctgcctcccatagtgctagaattacaggcctgagctactgcgcttggccccttgcggtacttttggcccaacctcctccatggctggggacgcggaggccgagagagaagtcacttgccctggctctaccttgaagtggttctcagggttggggcgagagtcggggtggggaccgagatgcagctctatcctgtgcccctggtcgcagcaggcagcccagcgcttcgcgtgttctacttggcctgtccgctgccgcctaatgagctcaggtctaggccgagcagagggggcacctggtcggactcggttgggctcgggcggccccgcctccccccgcccgccaggcgggcccttctcgacggcgcggggcgggccctgcgggcgcggggctgaaggcggaaccacgacgggcagagagcacggagccgggaagcccctgggcgcccgtcggagggctatggagcagcggccgc

SEQ ID NO: 15934 - DNA, 6604 bp, Homo sapiens
  ENST00000329153
gggactccggcgagagcgacgcaaggtcggctgcggcggcggcccgagggcgcccgtgtgcccagtgcgcggcggggacggccgcgagctcgctggagggctccccagaataatccagaagtcgattccatcatggcagaactcaaggtggaggcgccggccagcgtagactggcagaaacgctgcctgaccctggaaactcagcttttccggttccgcctacaggccagcaagataagggagctgctggctgacaagatgcaggagctggagcagaggctgctggaggcagagcagagagcagagaacgctgagacccaggtgggtgtcatggaagagaaggtaaaactatccaatctgaagaatgtggactctgaggggagcctgcaccggaaataccaagaattgctgaaagccataaagggcaaagatgagctcatcagccagctagaggctcagctggagaagcagaagcagatgagggcagaggaagcaaaaactgttcaagaaaaagctgcaaagatcaaggaatgggtgacactcaagttggcaaagcttgagatggagaatcagcatctgaaaagccataatcagcgcctggtggagcaggtgggatcccttcaagatgcgctagaagctattcagatagctccttcacggaagctgctggtgcccccctacggagctgcagagcaggattctgtcccttcagagccgggaatccagcctatgggccaggacagtggctcccaggcccagggtctgaaggcagctgtgcttgcaccttccccaggtgccctgcagagcaaggactctgtttctgaagcagcaagccccttggaggattctagttccagcacggtccattctggggaaacagtagaggccaagccccttcaacctcatctgggaagagagagccctccccaccagccatgcatgaagcttcttaccttcagatgtagttcagcttcctggggtgagggtctggttactgctcagagagggatgctccctgggacaaagacctctgccagggaaggtggtcctggcagcagtctgaccctaccaaaggtgcgggctcctggcaccccgcgggacagcatccagttggccaaaaggcaccacagccagccccaggtgggccatgggcactttggccgtgtggtgaacattgagactgaggccttctcagccctccacccctctggccttcctgagctggagtcccgagctaggtcccgggaggaaccagagaagatggagatggaggagccacccccagcagggaagaatgaggaaagagagagcccaaaggcccttggagctgagctggaggaagtggagctgggtaacaagccacctacacccccgctgcaccagttttcatcctgggagagccggatctatgctgtggccacatcgggcatgcggctctcagatatgtctcccagaagtaatactgcatgctgcgcttcaagccctcctgcccttgtttcccctgggtctttctctggcctggtctacaagaatgtcactgtgcctgtctacacagcactgaaggggagagctacacagatcagcaacatgccctttatggacgagtcctctgggtctgacgatgactgcagctctcaggcgagtttccgaatctcggtcccctcctctgagtccaggaagaccagcggactaggcagcccccgggccatcaagagaggcgtctccatgtcctcactgagctccgagggtgactacgccatccccccggacgcctgctcactggacagtgactactcagagcctgagcacaaactgcagcgcacctcatcctactccaccgacgggctgggcctgggcggggagtcactggagaagtcgggctacctgctgaaaatggggagccaggtgaagacgtggaagaggcgctggtttgtcctgagacagggacagattatgtactacaagtccccgagtgatgtcatccggaaacctcaaggccaagtggatctgaactcccgctgccaaattgttcgaggggagggttcacagacgtttcagctcatctctgagaagaaaacctactacctgacggccgattcacccagcctgctggaggagtggatccgagtactccagagcctgctgaaggtgcaggccaccgggcctccagctctgcttcggggtggcaccaagcccaccgtgaagggctggctgaccaaggtaaagcatggccactccaaggtggtctggtgcgctcttgttgggaaaatcttctactactatcggagccatgaggacaagcgacccctgggctgcctgcctgtgcgggatgcgcacatagaggaagtagatcgatcctgtgactcagacgaggactatgaggctggaggaaccagacggttgctttcctcccactgcaccctggtgatccaccccacagagcacagccccacctacctcctcattggcaccaagcatgaaaaggatacgtggctctaccacctcacagtggctgcaggtggcagcagtgccaaggtgggcactgcctatgagcagctcattggaaaactgatggatggtgaaggagatccagattcgccgctctggaggcaccccatgctgtgctacagcaaagacggcctatacgcctccctcaccaccctgccctctgaggccttgcagacggaggccctcaagctcttcaagtcctgccagctcttcatcaacgtgccggtggaagctgcctcggtggactaccatgtgtccctggcccagaccgcactgcaggtctgcctggttcaccccgagctgcagagtgagatctactgccaactcatgaagcagaccagctgccgcccacctcagaagtactccctcatgcagtgctggcagctcctcgctctgtgtgctccacttttcctgcctcagcatcacttcctctggtatgtcaagcagcagctccaacgccatgcagatcccagaagtgaaactggccagtatgccacctactgccagcgggcagtggagcggaccctgcggaccggggagcgggaagccaggccatcgcgcatggaagtggtgtccatcctgctgcgtaaccccttccaccactccttgcccttcagcatccccgtgcactttaccaacgggacttaccatgtggttggttttgacggctcttccacggttgatgagttcctccagcggctgaaccaggagataggcatgagaaagccatcccactctggctttgccctcttcacggacgatccctcgggcagggacctggagcactgcctgcagggaagtgtcaagatctgtgatgccatctccaagtgggaacaagccatgaaggagctgcaccccggaaagtctgagggtgggacacgcgtcgtgaagctgatgtacaagaacaggctgtactttcgcagtcaagtcaaaggggagacggaccgagaacggctgctccttgcctctcaaaccagtagagagatagtggcagggaggtttcctatcaacaaggaattggctcttgagatggctgccctgatggcccaggtagaatatggggacttggagaagcctgccctgccaggccctggaggcacatcccctgccaaggctcagcatcttctccagcaggtcctagacaggttccaccccaggcgctatagacatggggcccccgctgaacagctgaggcacctggcagatatgttgaccacaaaatgggcaacattgcaaggatgctcccctcctgagtgcatccgcatctacctgaccgtggccaggaaatggcctttctttggtgctaaactttttgctgctcagcctgcccagctgtcttccaaggagaacgctctggtgtggattgctgtgaatgaggatggcgtcagcatcctggaccacaacactatgcaagtgcacatcacttacccctactcttcagtgacaacgtttggtggctgcagggatgacttcatgcttgtgattagatctatcccagacaagagctctggaaaaagccacattgagaagttgatcttccggatggctgctcccaagattgcagaagctaccttcatcatggccagctatatgaaccattgcactacaactgtgaacccccccaccaacccacccggagcctgccagctgtgggaactggatggacgacagttcttttcttctgtttcctgtgctaccaaggggccaacgttgctgtgaatatttctcctacccgattccccaacaccactagtgcctctggatttagagatatatatcctagggtatgatactactgtgacgggtctaacagcccccggctactcttgttctgtgaaatgtgtattttagtctctgtgaagcctttactctctaggtgccttataatgtttcagggctcaactttttaaaatccagacccagtgttaaaaccatttattccttttttcataagaataatgactccagatgctacctgattctagacatagacagggatgatccactgttactgagggcatcagtgctataagttaaggctttctgcactggtactctcaaggaagctaattttctttctggggggggcgggggacacagtgtcactatgtcacccagtccacagggttcaagcaattctcctgcctcagccttcggagtggctgggattacaggtgtgcgccaccatgcccggctaatttttgtatttttagtagagacggggtttcaccatgttggccaggctggtctcgaactcctgacctcaggtgatctgcccactttggcctcccaaagtgctgggattacaggcatgagccatcgcccagcccagaagctaattttttaatattgtatatggtcttatttatacttgaagttttgtgaacgtcgctaaacaggataggactaaaatttccaattctcctacactctgtcagaagcctagaactcactaaactgggctgcctttcccaaatgggaaaggtgctgacagagttggagaaaaaagaatagactcatttttccccattattggtatgtaggcattggtacagccccttctggggcagtctttgcaggataacatgctatacctgctaagattcaagctgttttcctcacactggactttaggccaaacccagtaccacgcaatgtgcaagcaagggcaggaggtaggtccaatctgacccctccctgtctcattttaatgactggacagcgctcggtgaaggctgtgttcactgtagtgggccatcatttgtttccttcttcttgtaaaagaccaagcaaatgcactctgctttttgctgctgtaagaccaccaaaaatgagtcagaaacacagaagactatttcaggcatgtgggcctggatatgctccttgagacttctggcaaacttctgctgggaattagtttgagggtgagggtacatatgtgacatttgccctagcctaagagtagcaggtaaaaaaaagtttctttcatcttttgccttactgataataccataatccccctcaattcagaccttctgattgagtgcagaggagactagacagtctcctctagacaggttgtagacacaccctcccctaacaaaaacaaaacgaaagagttcatactctgattttccaacatctaggaaactgagttttatttcctagctctaaggcagccttactatatgtcagtaaagtgctgaaaactgtatatttagcagtagcacccaaaaccaagcctttaaccccaacaatgtgtgtatcttttgcacagcaaaaactgcgaggccagaactagtttatctgaacacctcagctgctgtaagcttctcctctctcaccccgtaaactgacaagcatgatgaaaaaagaagcacatccaagtttctgcctcttttaaatgtacttgactttgcaaggcaagtagttttacagccatttctgttcacacttttcaccccacaacttggggatctagctgagacatttctacctcgaacaagtcacatgtaccacaggttcctgaataattcctgcagggctggtgacagacataacagctctggttttataatatcttgggtatctctaaggccaataaggataacattatctacccagagagtttagaagaaaagtaggagtccaaaggaagagtaaacaagaatggagctgtgttcacactgaatttggggtcaatctatttcccccaccctctctcctccccaacccttcaggaaccctttagtttattaatcttatacagaagaaactaacttagaaacaaaggattcaatatttgcttatttattctttgttaacatgagagtcccatgtctgaaaaccaaagtccaatttctgtctggccttttgtctcatccttcttggcaaaagtagcttttgaactgatataaaaaaaaatgctgagtaacagaaaagtattaatgtgcttgacaccatgactgaaatactatgatcttgtttgtcaataaaaagcagctatctgtgaaccaggtaactgtgtgttttggaagatctgtttattaacagtaaataaataagccctgtacagaacacaggcactaggttgaca

SEQ ID NO: 15935 - DNA, 3383 bp, Homo sapiens
  ENST00000558386
acaggtctgcccacccccaaagccatgctttttcctgcacatgcctggagggggtgggatgggcatcatgccgggccctgagcttcctgagacctcttgtttcaggagagccggatctatgctgtggccacatcgggcatgcggctctcagatatgtctcccagaagtaatactgcatgctgcgcttcaagccctcctgcccttgtttcccctgggtctttctctggcctggtctacaagaatgtcactgtgcctgtctacacagcactgaaggggagagctacacagatcagcaacatgccctttatggacgagtcctctgggtctgacgatgactgcagctctcaggcgagtttccgaatctcggtcccctcctctgagtccaggaagaccagcggactaggcagcccccgggccatcaagagaggcgtctccatgtcctcactgagctccgagggtgactacgccatccccccggacgcctgctcactggacagtgactactcagagcctgagcacaaactgcagcgcacctcatcctactccaccgacgggctgggcctgggcggggagtcactggagaagtcgggctacctgctgaaaatggggagccaggtgaagacgtggaagaggcgctggtttgtcctgagacagggacagattatgtactacaagtccccgagtgatgtcatccggaaacctcaaggccaagtggatctgaactcccgctgccaaattgttcgaggggagggttcacagacgtttcagctcatctctgagaagaaaacctactacctgacggccgattcacccagcctgctggaggagtggatccgagtactccagagcctgctgaaggtgcaggccaccgggcctccagctctgcttcggggtggcaccaagcccaccgtgaagggctggctgaccaaggtaaagcatggccactccaaggtggtctggtgcgctcttgttgggaaaatcttctactactatcggagccatgaggacaagcgacccctgggctgcctgcctgtgcgggatgcgcacatagaggaagtagatcgatcctgtgactcagacgaggactatgaggctggaggaaccagacggttgctttcctcccactgcaccctggtgatccaccccacagagcacagccccacctacctcctcattggcaccaagcatgaaaaggatacgtggctctaccacctcacagtggctgcaggtggcagcagtgccaaggtgggcactgcctatgagcagctcattggaaaactgatggatggtgaaggagatccagattcgccgctctggaggcaccccatgctgtgctacagcaaagacggcctatacgcctccctcaccaccctgccctctgaggccttgcagacggaggccctcaagctcttcaagtcctgccagctcttcatcaacgtgccggtggaagctgcctcggtggactaccatgtgtccctggcccagaccgcactgcaggtctgcctggttcaccccgagctgcagagtgagatctactgccaactcatgaagcagaccagctgccgcccacctcagaagtactccctcatgcagtgctggcagctcctcgctctgtgtgctccacttttcctgcctcagcatcacttcctctggtatgtcaagcagcagctccaacgccatgcagatcccagaagtgaaactggccagtatgccacctactgccagcgggcagtggagcggaccctgcggaccggggagcgggaagccaggccatcgcgcatggaagtggtgtccatcctgctgcgtaaccccttccaccactccttgcccttcagcatccccgtgcactttaccaacgggacttaccatgtggttggttttgacggctcttccacggttgatgagttcctccagcggctgaaccaggagataggcatgagaaagccatcccactctggctttgccctcttcacggacgatccctcgggcagggacctggagcactgcctgcagggaagtgtcaagatctgtgatgccatctccaagtgggaacaagccatgaaggagctgcaccccggaaagtctgagggtgggacacgcgtcgtgaagctgatgtacaagaacaggctgtactttcgcagtcaagtcaaaggggagacggaccgagaacggctgctccttgcctctcaaaccagtagagagatagtggcagggaggtttcctatcaacaaggaattggctcttgagatggctgccctgatggcccaggtagaatatggggacttggagaagcctgccctgccaggccctggaggcacatcccctgccaaggctcagcatcttctccagcaggtcctagacaggttccaccccaggcgctatagacatggggcccccgctgaacagctgaggcacctggcagatatgttgaccacaaaatgggcaacattgcaaggatgctcccctcctgagtgcatccgcatctacctgaccgtggccaggaaatggcctttctttggtgctaaactttttgctgctcagcctgcccagctgtcttccaaggagaacgctctggtgtggattgctgtgaatgaggatggcgtcagcatcctggaccacaacactatgcaagtgcacatcacttacccctactcttcagtgacaacgtttggtggctgcagggatgacttcatgcttgtgattagatctatcccagacaagagctctggaaaaagccacattgagaagttgatcttccggatggctgctcccaagattgcagaagctaccttcatcatggccagctatatgaaccattgcactacaactgtgaacccccccaccaacccacccggagcctgccagctgtgggaactggatggacgacagttcttttcttctgtttcctgtgctaccaaggggccaacgttgctgtgaatatttctcctacccgattccccaacaccactagtgcctctggatttagagatatatatcctagggtatgatactactgtgacgggtctaacagcccccggctactcttgttctgtgaaatgtgtattttagtctctgtgaagcctttactctctaggtgccttataatgtttcagggctcaactttttaaaatccagacccagtgttaaaaccatttattccttttttcataagaataatgactccagatgctacctgattctagacatagacagggatgatccactgttactgagggcatcagtgctataagttaaggctttctgcactggtactctcaaggaagctaattttctttctggggggggcgggggacacagtgtcactatgtcacccagtccacagggttcaagcaattctcctgcctcagccttcggagtggctg

SEQ ID NO: 15936 - DNA, 595 bp, Homo sapiens
  ENST00000561456
atggagatcatggtccccaaagggagtcaaggggagaagatgaacagggccctggcccccctcttgagatctgtcactggcctgctcctggagggaatgccatctgcccagttctctgcttcccccacaccccttcctgggttatgcccttgagtaatctcattcctctcttccctgctcagcttcaagccctcctgcccttgtttcccctgggtctttctctggcctggtctacaagaatgtcactgtgcctgtctacacagcactgaaggggagagctacacagatcagcaacatgccctttatggacgagtcctctgggtctgacgatgactgcagctctcaggcgagtttccgaatctcggtcccctcctctgagtccaggaagaccagcggactaggcagcccccgggccatcaagagaggcgtctccatgtcctcactgagctccgagggtgactacgccatccccccggacgcctgctcactggacagtgactactcagagcctgagcacaaactgcagcgcacctcatcctactccaccgacgggctgggcctgggcggggagtcactggagaagtcgggctacctg

SEQ ID NO: 15937 - DNA, 2146 bp, Homo sapiens
  ENST00000558981
ttttttatagaagaataaaaaaccaaaagtgaaatttcctctcacgtcgcttttccctaattcctaagcccagaggaagctatcatgaatggtttagtgtttattcagtaaggccttccgatgcatttataaatatgcagcacactctcactgtctcctgtgtgcacacaaaaggtgctcatatacatgtcattctatgccttgcttgttcccctaaccacgtgaataaccacgtgtcaggtcatccttccctacctcctcctttttatttttccgagacagagtctggctctgttgccaggctggagtgcagtggtgcaaccttggctcactgcaacttccacctcctgggttcaagcgattctcctgcctcagcctcctgaatagctggaactacaggcgcgcaccaccatgcccagctaatttttgtatttttagtagagacggggtttcaccatgttggccaggatggtcttgatctcttgaccttgtgatccgcctgcctcagcctcccaaagtgctaggattacaggcatgagccaccatgcctggcccctacctcctccttctataggtgtccagtacccttggtatcgaagcaccataactattaatacctaaagctttcctccaataataatttagtctgtgtccctgtttttctctaaaatgaatgttgccatgaacatcactgtgcacatatatctttgggaacttatatctacatgtgtctgtaggacagagttctagaggtgggatttctgggcaaattatatacatgttttaatttttgacaggtactgccaaattaccttctaaaaatgccttacacactagagttttttcccccatcttctccccatactctcaccaacactgagatagtcagtcactttaaatgtttgccaatggagatgcaatcattgattgttgcgacgtccccacacatttttaaagctcgcatggcacacttagtctgtggtgtagctttctggccccctagtggcaaggagcgagggtcacagtgggcaggcattcagtcgtgatgggcagctgctttggggaccacagaagatggtgtgtgggaagggaggcctgagaagcatggaggtcatgacacaggagtgaggccaggagggaccttacactggacagttgtctgttcagagtcccggctgggggttggccacaccatgggcacttggaccaggagtgcaagctgcagggttgggagaggactgttttgcagcctgagctgcagtgagggaggggcctgtcttgcagagagctacacagatcagcaacatgccctttatggacgagtcctctgggtctgacgatgactgcagctctcaggcgagtttccgaatctcggtcccctcctctgagtccaggaagaccagcggactaggcagcccccgggccatcaagagaggcgtctccatgtcctcactgagctccgagggtgactacgccatccccccggacgcctgctcactggacagtgactactcagagcctgagcacaaactgcagcgcacctcatcctactccaccgacgggctgggcctgggcggggagtcactggagaagtcgggctacctgctgaaaatggggagccaggtgaagacgtggaagaggcgctggtttgtcctgagacagggacagattatgtactacaagtccccgagtgatgtcatccggaaacctcaaggccaagtggatctgaactcccgctgccaaattgttcgaggggagggttcacagacgtttcagctcatctctgagaagaaaacctactacctgacggccgattcacccagcctgctggaggagtggatccgagtactccagagcctgctgaaggtgcaggccaccgggcctccagctctgcttcggggtggcaccaagcccaccgtgaagggctggctgaccaaggtaaagcatggccactccaaggtggtctggtgcgctcttgttgggaaaatcttctactactatcggagccatgaggacaaggtacttctcagcctcctcacaatacccactctcctgcttcccccgaagcacatgactgccactctatgtcctgatgaaagtccctaccccacgtaaccccacaataaatacaaaatcagttggctgg

SEQ ID NO: 15938 - DNA, 5555 bp, Homo sapiens
  ENST00000557971
gaagcaccataactattaatacctaaagctttcctccaataataatttagtctgtgtccctgtttttctctaaaatgaatgttgccatgaacatcactgtgcacatatatctttgggaacttatatctacatgtgtctgtaggacagagttctagaggtgggatttctgggcaaattatatacatgttttaatttttgacaggtactgccaaattaccttctaaaaatgccttacacactagagttttttcccccatcttctccccatactctcaccaacactgagatagtcagtcactttaaatgtttgccaatggagatgcaatcattgattgttgcgacgtccccacacatttttaaagctcgcatggcacacttagtctgtggtgtagctttctggccccctagtggcaaggagcgagggtcacagtgggcaggcattcagtcgtgatgggcagctgctttggggaccacagaagatggtgtgtgggaagggaggcctgagaagcatggaggtcatgacacaggagtgaggccaggagggaccttacactggacagttgtctgttcagagtcccggctgggggttggccacaccatgggcacttggaccaggagtgcaagctgcagggttgggagaggactgttttgcagcctgagctgcagtgagggaggggcctgtcttgcagagagctacacagatcagcaacatgccctttatggacgagtcctctgggtctgacgatgactgcagctctcaggcgagtttccgaatctcggtcccctcctctgagtccaggaagaccagcggactaggcagcccccgggccatcaagagaggcgtctccatgtcctcactgagctccgagggtgactacgccatccccccggacgcctgctcactggacagtgactactcagagcctgagcacaaactgcagcgcacctcatcctactccaccgacgggctgggcctgggcggggagtcactggagaagtcgggctacctgctgaaaatggggagccaggtgaagacgtggaagaggcgctggtttgtcctgagacagggacagattatgtactacaagtccccgagtgatgtcatccggaaacctcaaggccaagtggatctgaactcccgctgccaaattgttcgaggggagggttcacagacgtttcagctcatctctgagaagaaaacctactacctgacggccgattcacccagcctgctggaggagtggatccgagtactccagagcctgctgaaggtgcaggccaccgggcctccagctctgcttcggggtggcaccaagcccaccgtgaagggctggctgaccaaggtaaagcatggccactccaaggtggtctggtgcgctcttgttgggaaaatcttctactactatcggagccatgaggacaagcgacccctgggctgcctgcctgtgcgggatgcgcacatagaggaagtagatcgatcctgtgactcagacgaggactatgaggctggaggaaccagacggttgctttcctcccactgcaccctggtgatccaccccacagagcacagccccacctacctcctcattggcaccaagcatgaaaaggatacgtggctctaccacctcacagtggctgcaggtggcagcagtgccaaggtgggcactgcctatgagcagctcattggaaaactgatggatggtgaaggagatccagattcgccgctctggaggcaccccatgctgtgctacagcaaagacggcctatacgcctccctcaccaccctgccctctgaggccttgcagacggaggccctcaagctcttcaagtcctgccagctcttcatcaacgtgccggtggaagctgcctcggtggactaccatgtgtccctggcccagaccgcactgcaggtctgcctggttcaccccgagctgcagagtgagatctactgccaactcatgaagcagaccagctgccgcccacctcagaagtactccctcatgcagtgctggcagctcctcgctctgtgtgctccacttttcctgcctcagcatcacttcctctggtatgtcaagcagcagctccaacgccatgcagatcccagaagtgaaactggccagtatgccacctactgccagcgggcagtggagcggaccctgcggaccggggagcgggaagccaggccatcgcgcatggaagtggtgtccatcctgctgcgtaaccccttccaccactccttgcccttcagcatccccgtgcactttaccaacgggacttaccatgtggttggttttgacggctcttccacggttgatgagttcctccagcggctgaaccaggagataggcatgagaaagccatcccactctggctttgccctcttcacggacgatccctcgggcagggacctggagcactgcctgcagggaagtgtcaagatctgtgatgccatctccaagtgggaacaagccatgaaggagctgcaccccggaaagtctgagggtgggacacgcgtcgtgaagctgatgtacaagaacaggctgtactttcgcagtcaagtcaaaggggagacggaccgagaacggctgctccttgcctctcaaaccagtagagagatagtggcagggaggtttcctatcaacaaggaattggctcttgagatggctgccctgatggcccaggtagaatatggggacttggagaagcctgccctgccaggccctggaggcacatcccctgccaaggctcagcatcttctccagcaggtcctagacaggttccaccccaggcgctatagacatggggcccccgctgaacagctgaggcacctggcagatatgttgaccacaaaatgggcaacattgcaaggatgctcccctcctgagtgcatccgcatctacctgaccgtggccaggaaatggcctttctttggtgctaaactttttgctgctcagcctgcccagctgtcttccaaggagaacgctctggtgtggattgctgtgaatgaggatggcgtcagcatcctggaccacaacactatgcaagtgcacatcacttacccctactcttcagtgacaacgtttggtggctgcagggatgacttcatgcttgtgattagatctatcccagacaagagctctggaaaaagccacattgagaagttgatcttccggatggctgctcccaagattgcagaagctaccttcatcatggccagctatatgaaccattgcactacaactgtgaacccccccaccaacccacccggagcctgccagctgtgggaactggatggacgacagttcttttcttctgtttcctgtgctaccaaggggccaacgttgctgtgaatatttctcctacccgattccccaacaccactagtgcctctggatttagagatatatatcctagggtatgatactactgtgacgggtctaacagcccccggctactcttgttctgtgaaatgtgtattttagtctctgtgaagcctttactctctaggtgccttataatgtttcagggctcaactttttaaaatccagacccagtgttaaaaccatttattccttttttcataagaataatgactccagatgctacctgattctagacatagacagggatgatccactgttactgagggcatcagtgctataagttaaggctttctgcactggtactctcaaggaagctaattttctttctggggggggcgggggacacagtgtcactatgtcacccagtccacagggttcaagcaattctcctgcctcagccttcggagtggctgggattacaggtgtgcgccaccatgcccggctaatttttgtatttttagtagagacggggtttcaccatgttggccaggctggtctcgaactcctgacctcaggtgatctgcccactttggcctcccaaagtgctgggattacaggcatgagccatcgcccagcccagaagctaattttttaatattgtatatggtcttatttatacttgaagttttgtgaacgtcgctaaacaggataggactaaaatttccaattctcctacactctgtcagaagcctagaactcactaaactgggctgcctttcccaaatgggaaaggtgctgacagagttggagaaaaaagaatagactcatttttccccattattggtatgtaggcattggtacagccccttctggggcagtctttgcaggataacatgctatacctgctaagattcaagctgttttcctcacactggactttaggccaaacccagtaccacgcaatgtgcaagcaagggcaggaggtaggtccaatctgacccctccctgtctcattttaatgactggacagcgctcggtgaaggctgtgttcactgtagtgggccatcatttgtttccttcttcttgtaaaagaccaagcaaatgcactctgctttttgctgctgtaagaccaccaaaaatgagtcagaaacacagaagactatttcaggcatgtgggcctggatatgctccttgagacttctggcaaacttctgctgggaattagtttgagggtgagggtacatatgtgacatttgccctagcctaagagtagcaggtaaaaaaaagtttctttcatcttttgccttactgataataccataatccccctcaattcagaccttctgattgagtgcagaggagactagacagtctcctctagacaggttgtagacacaccctcccctaacaaaaacaaaacgaaagagttcatactctgattttccaacatctaggaaactgagttttatttcctagctctaaggcagccttactatatgtcagtaaagtgctgaaaactgtatatttagcagtagcacccaaaaccaagcctttaaccccaacaatgtgtgtatcttttgcacagcaaaaactgcgaggccagaactagtttatctgaacacctcagctgctgtaagcttctcctctctcaccccgtaaactgacaagcatgatgaaaaaagaagcacatccaagtttctgcctcttttaaatgtacttgactttgcaaggcaagtagttttacagccatttctgttcacacttttcaccccacaacttggggatctagctgagacatttctacctcgaacaagtcacatgtaccacaggttcctgaataattcctgcagggctggtgacagacataacagctctggttttataatatcttgggtatctctaaggccaataaggataacattatctacccagagagtttagaagaaaagtaggagtccaaaggaagagtaaacaagaatggagctgtgttcacactgaatttggggtcaatctatttcccccaccctctctcctccccaacccttcaggaaccctttagtttattaatcttatacagaagaaactaacttagaaacaaaggattcaatatttgcttatttattctttgttaacatgagagtcccatgtctgaaaaccaaagtccaatttctgtctggccttttgtctcatccttcttggcaaaagtagcttttgaactgatataaaaaaaaa

SEQ ID NO: 15939 - DNA, 591 bp, Homo sapiens
  ENST00000561135
gagtcctctgggtctgacgatgactgcagctctcaggcgagtttccgaatctcggtcccctcctctgagtccaggaagaccagcggactaggcagcccccgggccatcaagagaggtacagagaaggggagcaggggcagggtgcagcagcaaggagcccctcacctcttcccatgggcacttgaacatgggcgtccccacttgatctgagctcgtgaccccccagcagctccacccccagccccagagaccgggtcccgggtgggtggtcaagtctcagcagctcctgggctgcgtgagtcggggaggtgtgggacccgggccttgactcctcctccctcggcaaggcgtctccatgtcctcactgagctccgagggtgactacgccatccccccggacgcctgctcactggacagtgactactcagagcctgagcacaaactgcagcgcacctcatcctactccaccgacgggctgggcctgggcggggagtcactggagaagtcgggctacctgctgaaaatggggagccaggtgaagacgtggaagaggcgctggtttgtcctgagacagggacagattatgtacta

SEQ ID NO: 15940 - DNA, 1820 bp, Homo sapiens
  ENST00000561370
acttttcctgcctcagcatcacttcctctggtatgtcaagcagcagctccaacgccatgcagatcccagaagtgaaactggccagtatgccacctactgccagcgggcagtggagcggaccctgcggaccggggagcgggaagccaggccatcgcgcatggaagtggtgtccatcctgctgcgtaaccccttccaccactccttgcccttcagcatccccgtgcactttaccaacgggacttaccatgtggttggttttgacggctcttccacggttgatgagttcctccagcggctgaaccaggagataggcatgagaaagccatcccactctggctttgccctcttcacggacgatccctcgggcagggacctggagcactgcctgcagggaagtgtcaagatctgtgatgccatctccaagtgggaacaagccatgaaggagctgcaccccggaaagtctgagggctgtactttcgcagtcaagtcaaaggggagacggaccgagaacggctgctccttgcctctcaaaccagtagagagatagtggcagggaggtttcctatcaacaaggaattggctcttgagatggctgccctgatggcccaggtagaatatggggacttggagaagcctgccctgccaggccctggaggcacatcccctgccaaggctcagcatcttctccagcaggtcctagacaggttccaccccaggcgctatagacatggggcccccgctgaacagctgaggcacctggcagatatgttgaccacaaaatgggcaacattgcaaggatgctcccctcctgagtgcatccgcatctacctgaccgtggccaggaaatggcctttctttggtgctaaactttttgctgctcagcctgcccagctgtcttccaaggagaacgctctggtgtggattgctgtgaatgaggatggcgtcagcatcctggaccacaacactatgcaagtgcacatcacttacccctactcttcagtgacaacgtttggtggctgcagggatgacttcatgcttgtgattagatctatcccagacaagagctctggaaaaagccacattgagaagttgatcttccggatggctgctcccaagccccagcatcatgcagtcctcagttgggtgcttacgtgctcttctcttccttgcagcagtcctcaaggcagggcagattcctctttaagagctaaccagagcagaacactgggcctccttttctcagaagggcactgtgcatctgagaggatctccagaccaacaggagcccacaccactgggcctctgaacagcacagttatgattccctttggatattttctcccagattgcagaagctaccttcatcatggccagctatatgaaccattgcactacaactgtgaacccccccaccaacccacccggagcctgccagctgtgggaactggatggacgacagttcttttcttctgtttcctgtgctaccaaggggccaacgttgctgtgaatatttctcctacccgattccccaacaccactagtgcctctggatttagagatatatatcctagggtatgatactactgtgacgggtctaacagcccccggctactcttgttctgtgaaatgtgtattttagtctctgtgaagcctttactctctaggtgccttataatgtttcagggctcaactttttaaaatccagacccagtgttaaaaccatttattccttttttcataagaataatgactccagatgctacctgattctagacatagacagggatgatccactgttactgagggcatcagtgctataa

SEQ ID NO: 15941 - DNA, 605 bp, Homo sapiens
  ENST00000558296
accaacgggacttaccatgtggttggttttgacggctcttccacggttgatgagttcctccagcggctgaaccaggagataggcatgagaaagccatcccactctggctttgccctcttcacggacgatccctcgggcagggacctggagcactgcctgcagggaagtgtcaaggtgacagcctcccactaagccagctgagcccctccctgctcagggatattggtggtggggaaagagcccatctgatgggtgtctgactgtttggtagctcatttggtgctgagcccaaggtgctgccctagtcagcatttctgtgccatcctaaaatgtacctgggcagggagaaaaaagctgttgtgtgcccttgtctctggagacaagatcgctacacacctacttccctcgagtggctgtgcagcgtccagaagaaaagcctcttcttggcttggtgtagggacagtgaggccccacgaagccactgcctacacgtgcccactcagaggctcacagctgtgtgcttggaccccctggatgtcaggtggtacccagcacctcacttttaccctttctttcagggcctatgccatgcttataggttgaac

SEQ ID NO: 15942 - DNA, 638 bp, Homo sapiens
  ENST00000560100
tatgaactcactgcatgaacagggaagctgagatgctgaccaagaaataagaaagggcctccaaaagattgttggtaaaggagggacccaggtatgcccagttcatttacagtggataagctcacatccctcatgcactggccctttgcctgtgaacacagaaaccaacttgctttggccttttgtatttgcccttgctcctttccacctgctgtatccagacacctccaccagccctagtgagctcctctcaggaggttcactcagggttggaactcttctcccgcctcaggtggttggttttgacggctcttccacggttgatgagttcctccagcggctgaaccaggagataggcatgagaaagccatcccactctggctttgccctcttcacggacgatccctcgggcagggacctggagcactgcctgcagggaagtgtcaagatctgtgatgccatctccaagtgggaacaagccatgaaggagctgcaccccggaaagtctgagggtgggacacgcgtcgtgaagctgatgtacaagaacaggctgtactttcgcagtcaagtcaaaggggagacggaccgagaacggctgctccttgcctctcaaaccagtagagagatagtggcaggga

SEQ ID NO: 15943 - DNA, 594 bp, Homo sapiens
  ENST00000558366
cttatcaggaaattttctgactttcttcttttgccttttcaagatctgtgatgccatctccaagtgggaacaagccatgaaggagctgcaccccggaaagtctgagggtgggacacgcgtcgtgaagctgatgtacaagaacaggctgtactttcgcagtcaagtcaaaggggagacggaccgagaacggctgctccttgcctctcaaaccagtagagagatagtggcagggaggtttcctatcaacaaggaattggctcttgagatggctgccctgatggcccaggtagaatatggggacttggagaagcctgccctgccaggccctggaggcacatcccctgccaaggctcagcatcttctccagcaggtcctagacaggttccaccccaggcgctatagacatggggcccccgctgaacagctgaggcacctggcagatatgttgaccacaaaatgggcaacattgcaaggatgctcccctcctgagtgcatccgcatctacctgaccgtggccaggaaatggcctttctttggtgctaaactttttgctgctcagcctgcccagctgtcttccaaggagaacgctctggt

SEQ ID NO: 15944 - DNA, 3670 bp, Homo sapiens
  ENST00000559981
atgagagtgaaattttgtataagcaccagctagttatagctaaagactaagtacttcctataccaattccaggaaatacagaagtagacatcctgactttctatcaatttgagtaagaaaatcccatccctccatctcagtatgtctccaggcaaatagtttccagtagtctcttggactcttacctcatccagtcccctaatctataactccaggtaccagatttcccttactaaatccagtaagcttaatggtatcttcagaatgaaccatgccctcctgttggtatgagatcagcatgaccctgcatctgctctgtgtcatactcggttatatgtttctggaggcaatacaaaataggctcataaatagtgggaaaagagtactttatctttttggaaataaaggtaacagacccagagaaagccccatccctgtttggaatccctgctgagtcctggtttcttattctcttctttgtaggctgtactttcgcagtcaagtcaaaggggagacggaccgagaacggctgctccttgcctctcaaaccagtagagagatagtggcagggaggtttcctatcaacaaggaattggctcttgagatggctgccctgatggcccaggtagaatatggggacttggagaagcctgccctgccaggccctggaggcacatcccctgccaaggctcagcatcttctccagcaggtcctagacaggttccaccccaggcgctatagacatggggcccccgctgaacagctgaggcacctggcagatatgttgaccacaaaatgggcaacattgcaaggatgctcccctcctgagtgcatccgcatctacctgaccgtggccaggaaatggcctttctttggtgctaaactttttgctgctcagcctgcccagctgtcttccaaggagaacgctctggtgtggattgctgtgaatgaggatggcgtcagcatcctggaccacaacactatgcaagtgcacatcacttacccctactcttcagtgacaacgtttggtggctgcagggatgacttcatgcttgtgattagatctatcccagacaagagctctggaaaaagccacattgagaagttgatcttccggatggctgctcccaagattgcagaagctaccttcatcatggccagctatatgaaccattgcactacaactgtgaacccccccaccaacccacccggagcctgccagctgtgggaactggatggacgacagttcttttcttctgtttcctgtgctaccaaggggccaacgttgctgtgaatatttctcctacccgattccccaacaccactagtgcctctggatttagagatatatatcctagggtatgatactactgtgacgggtctaacagcccccggctactcttgttctgtgaaatgtgtattttagtctctgtgaagcctttactctctaggtgccttataatgtttcagggctcaactttttaaaatccagacccagtgttaaaaccatttattccttttttcataagaataatgactccagatgctacctgattctagacatagacagggatgatccactgttactgagggcatcagtgctataagttaaggctttctgcactggtactctcaaggaagctaattttctttctggggggggcgggggacacagtgtcactatgtcacccagtccacagggttcaagcaattctcctgcctcagccttcggagtggctgggattacaggtgtgcgccaccatgcccggctaatttttgtatttttagtagagacggggtttcaccatgttggccaggctggtctcgaactcctgacctcaggtgatctgcccactttggcctcccaaagtgctgggattacaggcatgagccatcgcccagcccagaagctaattttttaatattgtatatggtcttatttatacttgaagttttgtgaacgtcgctaaacaggataggactaaaatttccaattctcctacactctgtcagaagcctagaactcactaaactgggctgcctttcccaaatgggaaaggtgctgacagagttggagaaaaaagaatagactcatttttccccattattggtatgtaggcattggtacagccccttctggggcagtctttgcaggataacatgctatacctgctaagattcaagctgttttcctcacactggactttaggccaaacccagtaccacgcaatgtgcaagcaagggcaggaggtaggtccaatctgacccctccctgtctcattttaatgactggacagcgctcggtgaaggctgtgttcactgtagtgggccatcatttgtttccttcttcttgtaaaagaccaagcaaatgcactctgctttttgctgctgtaagaccaccaaaaatgagtcagaaacacagaagactatttcaggcatgtgggcctggatatgctccttgagacttctggcaaacttctgctgggaattagtttgagggtgagggtacatatgtgacatttgccctagcctaagagtagcaggtaaaaaaaagtttctttcatcttttgccttactgataataccataatccccctcaattcagaccttctgattgagtgcagaggagactagacagtctcctctagacaggttgtagacacaccctcccctaacaaaaacaaaacgaaagagttcatactctgattttccaacatctaggaaactgagttttatttcctagctctaaggcagccttactatatgtcagtaaagtgctgaaaactgtatatttagcagtagcacccaaaaccaagcctttaaccccaacaatgtgtgtatcttttgcacagcaaaaactgcgaggccagaactagtttatctgaacacctcagctgctgtaagcttctcctctctcaccccgtaaactgacaagcatgatgaaaaaagaagcacatccaagtttctgcctcttttaaatgtacttgactttgcaaggcaagtagttttacagccatttctgttcacacttttcaccccacaacttggggatctagctgagacatttctacctcgaacaagtcacatgtaccacaggttcctgaataattcctgcagggctggtgacagacataacagctctggttttataatatcttgggtatctctaaggccaataaggataacattatctacccagagagtttagaagaaaagtaggagtccaaaggaagagtaaacaagaatggagctgtgttcacactgaatttggggtcaatctatttcccccaccctctctcctccccaacccttcaggaaccctttagtttattaatcttatacagaagaaactaacttagaaacaaaggattcaatatttgcttatttattctttgttaacatgagagtcccatgtctgaaaaccaaagtccaatttctgtctggccttttgtctcatccttcttggcaaaagtagcttttgaactgatataaaaaaaaatgctgagtaacagaaaagtattaatgtgcttgacaccatgactgaaatactatgatcttgtttgtcaataaaaagcagctatctgtgaaccaggtaactgtgtgttttggaagatctgtttattaacagtaaataaataagccctgtacagaacacaggcactaggttgac

SEQ ID NO: 15945 - DNA, 510 bp, Homo sapiens
  ENST00000561057
tttttgctgctcagcctgcccagctgtcttccaaggagaacgctctggtgtggattgctgtgaatgaggatggcgtcagcatcctggaccacaacactatgtgacaacgtttggtggctgcagggatgacttcatgcttgtgattagatctatcccagacaagagctctggaaaaagccacattgagaagttgatcttccggatggctgctcccaagattgcagaagctaccttcatcatggccagctatatgaaccattgcactacaactgtgaacccccccaccaacccacccggagcctgccagctgtgggaactggatggacgacagttcttttcttctgtttcctgtgctaccaaggggccaacgttgctgtgaatatttctcctacccgattccccaacaccactagtgcctctggatttagagatatatatcctagggtatgatactactgtgacgggtctaacagcccccggctactcttgttctgtgaaatgtgtatttta

SEQ ID NO: 15946 - DNA, 573 bp, Homo sapiens
  ENST00000559766
ttcttttacagcacctaggagattggctgaagtcagaagcacttcggcttggagactataggtggaatgccgtgtttccaagactaggagaaaaccagctgttccccattcccctaacagagcagctagggctggcctctattctgtagcacagagctttccatccagtgtgctgtggcagcatgggttctagggacatcaaaagaatgatcgcctctgcctttgagatggttagtaggtggccagagccccaaggccaagggtctcctgtcacaagcagccttgtctatttcctgcatacactgtacaaatatcatctttgttttccaagatgaggtggctggaaatcactgcttagcagatccctggatgtgccttctttctcagaaagttattatagttcaaaatctctaactatggatatatctgatgggttgtttctgtttccccagcctgcccagctgtcttccaaggagaacgctctggtgtggattgctgtgaatgaggatggcgtcagcatcctggaccacaacactatgcaagtgcacatcacttacccctactcttcagtga

SEQ ID NO: 15947 - DNA, 171 bp, Homo sapiens
  ENST00000559832
ttggtggctgcagggatgacttcatgcttgtgattagatctatcccagacaagagctctggaaaaagccacattgagaagttgatcttccggatggctgctcccaagaagggcactgtgcatctgagaggatctccagaccaacaggagcccacaccactgggcctctgaa

SEQ ID NO: 15948 - DNA, 747 bp, Homo sapiens
  ENST00000559168
gcttgtgattagatctatcccagacaagagctctggaaaaagccacattgagaagttgatcttccggatggctgctcccaagattgcagaagctaccttcatcatggccagctatatgaaccattgcactacaactgtgaacccccccaccaacccacccggagcctgccagctgtgggaactggatggacgacagttcttttcttctgtttcctgtgctaccaaggggccaacgttgctgtgaatatttctcctacccgattccccaacaccactagtgcctctggatttagagatatatatcctaggcaaaaactgcgaggccagaactagtttatctgaacacctcagctgctgtaagcttctcctctctcaccccgtaaactgacaagcatgatgaaaaaagaagcacatccaagtttctgcctcttttaaatgtacttgactttgcaaggcaagtagttttacagccatttctgttcacacttttcaccccacaacttggggatctagctgagacatttctacctcgaacaagtcacatgtaccacaggttcctgaataattcctgcagggctggtgacagacataacagctctggttttataatatcttgggtatctctaaggccaataaggataacattatctacccagagagtttagaagaaaagtaggagtccaaaggaagagtaaacaagaatggagctgtgttcacactgaatttggggtcaatctatttccccca

SEQ ID NO: 15949 - DNA, 2999 bp, Homo sapiens
  ENST00000558214
ctcttccttgcagcagtcctcaaggcagggcagattcctctttaaggtgctcgcatgttacccctgggttctgctgacccaacattagctacaaagtgggacagtcccacagtgctccctcttccttgttgtggggaagaccgcaaaaagacctcttttgctttagtgactttgttcctactcaatacaggaagtgttgaccagcaaaaataataattacaaaggctaagttctgatttattgttcctgactcccgtgtgattaactggaaaccctgttgttctcctttttaatcctaaagttagagtttgccaaacctactcctcctttaataccacccctgctaaaggggaggatctccagatccctttcttaagaaggccccttccctggttgtagagctaaccagagcagaacactgggcctccttttctcagaagggcactgtgcatctgagaggatctccagaccaacaggagcccacaccactgggcctctgaacagcacagttatgattccctttggatattttctcccagattgcagaagctaccttcatcatggccagctatatgaaccattgcactacaactgtgaacccccccaccaacccacccggagcctgccagctgtgggaactggatggacgacagttcttttcttctgtttcctgtgctaccaaggggccaacgttgctgtgaatatttctcctacccgattccccaacaccactagtgcctctggatttagagatatatatcctagggtatgatactactgtgacgggtctaacagcccccggctactcttgttctgtgaaatgtgtattttagtctctgtgaagcctttactctctaggtgccttataatgtttcagggctcaactttttaaaatccagacccagtgttaaaaccatttattccttttttcataagaataatgactccagatgctacctgattctagacatagacagggatgatccactgttactgagggcatcagtgctataagttaaggctttctgcactggtactctcaaggaagctaattttctttctggggggggcgggggacacagtgtcactatgtcacccagtccacagggttcaagcaattctcctgcctcagccttcggagtggctgggattacaggtgtgcgccaccatgcccggctaatttttgtatttttagtagagacggggtttcaccatgttggccaggctggtctcgaactcctgacctcaggtgatctgcccactttggcctcccaaagtgctgggattacaggcatgagccatcgcccagcccagaagctaattttttaatattgtatatggtcttatttatacttgaagttttgtgaacgtcgctaaacaggataggactaaaatttccaattctcctacactctgtcagaagcctagaactcactaaactgggctgcctttcccaaatgggaaaggtgctgacagagttggagaaaaaagaatagactcatttttccccattattggtatgtaggcattggtacagccccttctggggcagtctttgcaggataacatgctatacctgctaagattcaagctgttttcctcacactggactttaggccaaacccagtaccacgcaatgtgcaagcaagggcaggaggtaggtccaatctgacccctccctgtctcattttaatgactggacagcgctcggtgaaggctgtgttcactgtagtgggccatcatttgtttccttcttcttgtaaaagaccaagcaaatgcactctgctttttgctgctgtaagaccaccaaaaatgagtcagaaacacagaagactatttcaggcatgtgggcctggatatgctccttgagacttctggcaaacttctgctgggaattagtttgagggtgagggtacatatgtgacatttgccctagcctaagagtagcaggtaaaaaaaagtttctttcatcttttgccttactgataataccataatccccctcaattcagaccttctgattgagtgcagaggagactagacagtctcctctagacaggttgtagacacaccctcccctaacaaaaacaaaacgaaagagttcatactctgattttccaacatctaggaaactgagttttatttcctagctctaaggcagccttactatatgtcagtaaagtgctgaaaactgtatatttagcagtagcacccaaaaccaagcctttaaccccaacaatgtgtgtatcttttgcacagcaaaaactgcgaggccagaactagtttatctgaacacctcagctgctgtaagcttctcctctctcaccccgtaaactgacaagcatgatgaaaaaagaagcacatccaagtttctgcctcttttaaatgtacttgactttgcaaggcaagtagttttacagccatttctgttcacacttttcaccccacaacttggggatctagctgagacatttctacctcgaacaagtcacatgtaccacaggttcctgaataattcctgcagggctggtgacagacataacagctctggttttataatatcttgggtatctctaaggccaataaggataacattatctacccagagagtttagaagaaaagtaggagtccaaaggaagagtaaacaagaatggagctgtgttcacactgaatttggggtcaatctatttcccccaccctctctcctccccaacccttcaggaaccctttagtttattaatcttatacagaagaaactaacttagaaacaaaggattcaatatttgcttatttattctttgttaacatgagagtcccatgtctgaaaaccaaagtccaatttctgtctggccttttgtctcatccttcttggcaaaagtagcttttgaactgatataaaaaaaaatgctgagtaacagaaaagtattaatgtgcttgacaccatgactgaaatactatgatcttgtttgtcaataaaaagcagctatctgtgaaccag

SEQ ID NO: 15950 - DNA, 6981 bp, Homo sapiens
  ENST00000282406
gagctcggcttgaggcgggcgcgggctgagagtccggggatcccgggggccagtcgcggccgggacatcgggcgctgcggccggggacccgctgctgagatagacagaatatggcagagctttctgagccagagggaccagtagattggaaggaacgatgtgtagctctggagtcccaactcatgaaatttagagttcaagcaagcaagatacgagagcttttagcagagaagatgcaacagcttgagagacaagttattgatgctgaacgtcaagcagaaaaagcttttcaacaggtacaagttatggaagataaattaaaagcagctaatattcaaaccagtgaatcagagacaagattatataataagtgtcaagatctggagtcgctaatacaggaaaaagatgacgtcattcaaaacttggaattgcaacttgaagagcagaaacaaataagaatacaagaagctaaaataatagaagagaaagcagctaagataaaagaatgggtaacagttaagttaaatgagctggaattggagaatcagaatcttcgtttgatcaaccaaaaccaaactgaagagataagaacaatgcagtcaaaactacaagaagttcaaggaaagaagtcatccactgtctctacactaaagctttcggaaggccagcgcctgagcagtttgacctttgggtgctttttatctcgagcaaggagtcctcctcaagtagtaaaatctgaggaaatgagcaagatatcatcgaaagaacctgagttcactgaaggaaaagacatggaagaaatggaaattccagaaaagtctgttgataaccaagttctagaaaacaacagaggccagagaacattgcatcaaaccccttgtggctcagaacagaatcggaaaacaagaacaagctttgccacagatggtggcatctcccagaattctggggctcctgtgagtgactggagctctgatgaggaagacgggagcaaaggaagatccaagtccagatgcacatccaccctctccagtcacacatctgaggaaggggtccagtgtagcaggatgggaagtgaaatgtatctgacagcatctgatgacagcagctctatatttgaggaagagacttttggcataaagagaccagaacacaagaagctatattcttggcagcaggaggcacagtggaaagctctaaatagtcctcttggaaagggaaattctgaattaagtaaaaaggaacaagatagttcctcggatgaactgaataaaaaatttcaatcccagagactcgattattcatcttcatcgagtgaagccaacaccccaagccctattttgaccccagctttaatgccaaagcatcctaactcactctctggaaaaggaacacaattagtgccttcatcacacctgccacccccaaagttaaggattcctaatgttttcagtataagtgtagcactagccaaaaggcacttaagccagccacagttaagctctgacaggatgtttggtacaaatagaaacgctataagcatgatacgaccactgagacctcaggaaactgatcttgatctagttgatggagacagtacagaagttttagagaatatggacacgagttgtgatgatggattattttcctatgactccttggactctccaaattcagatgaccaggaacactgtgactcagcaaagaaggtggcatacagcaaacctccaactcctcccctgcaccgttttccttcttgggaaagcagaatttatgctgtagccaaatcaggtattcgaatgtctgaggccttcaatatggagagtgttaataaaaattctgctgcaaccctttcctatactacatcaggactttatacatctctgatatacaagaacatgaccaccccagtgtatacaactttgaaggggaaggcgacccaaataagtagcagccctttcctggatgactcatctgggtcagaggaagaagacagctccagatccagctcccggacgtcagagtcagactcacgcagtaggagtgggccaggcagccccagagccatgaaacgaggtgtgtctctctcctctgtggcttctgaaagtgattatgctattcctcctgatgcttactccacagacacggagtactcacagccagagcagaagctcccaaaaacttgctcatcttccagtgataatgggaaaaatgaaccactggaaaaatctggttatttattaaaaatgagtggtaaagtcaagtcttggaagcggcggtggtttgttcttaaaggtggtgaattactttactacaaatctccgagtgatgtaattagaaaaccccagggccatattgaacttagtgcatcctgtagtattttaagaggagataacaaacaaacagttcagttgaccactgaaaaacacacatactatctgactgcagattctcccaatatattggaagagtggattaaagtgttacagaatgttcttcgagtacaagctgccaacccactttccctgcagcctgagggcaaacccaccatgaagggattgctcactaaggtaaaacatggatattccaagagagtctggtgtacactaataggaaagacattatattattttcggagtcaagaagataagtttcctttaggtcagatcaaactctgggaggctaaagtggaagaggttgacagatcttgtgattcagatgaagattatgaagccagtggacgaagtctgttatccacacattatactatcgttatccatcccaaagaccaaggtccaacttacctcctaattggatccaagcatgaaaaggacacttggctttatcatctgactgttgcagctggaagcaacaatgtaaacgttggatctgaatttgaacaactggtttgcaaattgctaaatatagacggggagccttcctctcagatatggagacaccccactttgtgtcacagtaaagaaggaatcatttcccctctgacaactctaccttccgaagccctgcagacagaagctattaaattatttaagacctgccagctttttataaatgctgcagttgactctcctgcaattgattaccacatatctttagcccagagtgctttgcaaatctgcctgacacatcctgagctgcagaatgaaatttgctgtcagcttattaaacagacaagacgaagacagccacagaatcaaccaggaccattgcagggctggcagctcttggcactctgcgttgggctcttccttccccatcatcctttcctgtggctcctcaggcttcacctaaagaggaatgcagattccaggacagaatttggaaaatatgccatttactgccagcgttgtgtagaaagaacgcaacaaaatggtgacagagaagcaagaccctcaaggatggaaattctttcaactcttctccgaaacccttatcaccattctttgccctttagtatacctgtgcacttcatgaatgggatataccaggtagttggttttgacgcatctaccacagtggaagaatttttgaatactttgaaccaggacacaggaatgaggaaaccagcgcagtctggatttgcgttgttcactgacgatccttctggcagagatttagagcattgtcttcaaggaaacatcaagatttgtgacattatttccaaatgggaacaggcttccaaagaacagcagcctggaaaatgtgaaggtacaaggactgttcgtctgacatacaaaaacagactatatttctcagtgcaagctcgtggagagactgatagagaaaagttgctgttaatgtatcagacaaatgatcaaatcataaatggactttttcctctgaacaaagatctggcattagaaatggcagctcttttatctcaggtagagattggagattttgaaagacctttctcaactccagcagggcatgttaccaatcagtgcaaagtgaatcaaactctaaagcaagtcatagagaaattttatcctaaaaggtatagagatggctgttctgaagagcagttaaggcagctttgccagcgactttcaaccagatggatggccctccggggacacagtgctgctgactgtgtgcgcatttatttgacagtagccaggaagtggccattctttggtgccaagttgtttcttgcaaaacccataactccatcatcacttggaagtactttcttgtggctggctgtacatgaggatggtttaagcctcttagaatacaactccatgaggttaatagtcagctatgtgtacaagagtctaatgacctttggaggctatcaagatgattttatggtagtcattaacaatacacattcaaaggacaaaccaacagagaaattactttttgccatggcaaaacccaagattcttgaaatcactcttttgatcgccagttacataaacaacttccatcagcaaaaggcagcatttcaccacctctctgctccagcactgctctcagcccagacccggggaccccaagccagaatgatgggaagccagcctcttctgtcaagcagcagaccgaccaaaggccccaccttactctgaaagctggggagcctgaacattcactccttgtcctccatgctgtggctgtatcagctccctacaagttcgtttacacctggcagcacggcagccacacaccggtattccaaaccttaacaatgaagggggttagtctcttttatttgattcttaaatattcaaataaatattaacagtaaaacataaacacaaaatttgccaacacactaattttcttatagagtaaatgagtaagaattcatcattttttccatctcccttctcccttgtcatcagacacattgtgcaatgtggcttttcttttcttttctttttttcccctttttaatattctggcaatctttagaaagggagattccaaactcccatttggtaaaccagttgattatttggaaatgttcactgccaaaatagtaagtgctataactaaatgcgcttttaattaatgatatagtgtttggaaaggagtagaacatgcagcataagaaactgctgcagagtggtgcgaggagtacattttcagagcaggtgcagtacatcttccggctctatgaatcattatgtgagaaagcaggataacattaggtaacctgagcctcctgtgtggtattagaaagtataccgtcaccttttcacatcactggagtgtaaaatttaaaacaagatggtgattcctgacattccttggctgtcagtgctgcccagattcagaagaatattgcccacatttcactgtatttggtgctgggtcattttgaccttgctttgttaataatatctttaaaaacaaagacaatccttaaagctttgctcctcacacattaccttctaattatagtttgaaaatagattccctacacatacatacatatgtatgcacagatagggtcttgctatgttgcccaggctggtcttgaactcctggcctcaagcaatcctctctcctcagcctcccaaagtgctgggattacaagtgtgagccaccacacctggctccagaaattttattttatttttttgaggcagggtctcactctggttgcccaggctggagtgcagtggtgccatcatagctcactgtagcctcgaccttccgggatcaagcaatcccacttcagcctcttgaatagctgggactagaagcatgcaccaccatgcccatctaatatttgtatttttagtagagacaggatctccctatgttgtccagcctagtctcaaactcctgggttcaagcaatcctcccacctcggcctcccaaagtgctgggattgcaggcatgagccaccgtgcccagcctcaaaaatattttttaaaagaaaagagaaaataattcttctgtcaaaggaggttaaattttagttgatagagtacttaaatgcattactttattaggttatgtaagtggtcagtgcattccagtatgtgtcacaacagtgtagttcatattcatgataaaaatgaaactgtgataagacatgaaaattatattattaaaatgttcaattgtaatggtaatcatgagtatacttaattttatttatgtatagaatatttgtatttattttttggacatatatttatcactttgtcattttttttaaccaatttgagaaatgttagctgctgaattaatttgttgcccgagccttcatattttcttctttgctgccttctccctgtggcaatgtactgttctcacattaagccttttaaaaatgttccatactgtattagcatccttagaagggacagaactaagaaatacattgctcaaataatattttactttattgataatgacaaaaagaatattttttaaaccccatcaaaatagatttcaattgactgtttcccctacatcttttgagccacagtcgcccatcgaataagcaaatttgtttttgagaataaactggtaaccagtttgtgatgactctcagaagccttttggctgggttacagaagagtttctaagttcctagagagccatttaataattagttggtgagccagaggcttgacagagctgttacttatgtgtgagggctttattctcaggcagtagtttattcatcatttggtaagcccctccccacactcctctaatttaaacaagtagtgaaggcttatcttaaactgtgtagtaccttagacttggcatttatttttgatagagcagagataaaatattttgatggaaggaaatcaattttctgtaactgatgatgtgaaaattttattttctgggaaattatatagccattcaaaaattcaaagtatgttattatgattggttacaagagaataatgttacatgtttaattgtaatatttgtctcctatcattttcttccctttcagtcataataaatgatttacaaaaccca

SEQ ID NO: 15951 - DNA, 3623 bp, Homo sapiens
  ENST00000405223
gagagtccggggatcccgggggccagtcgcggccgggacatcgggcgctgcggccggggacccgctgctgagatagacagaatatggcagagctttctgagccagagggaccagtagattggaaggaacgatgtgtagctctggagtcccaactcatgaaatttagagttcaagcaagcaagatacgagagcttttagcagagaagatgcaacagcttgagagacaagttattgatgctgaacgtcaagcagaaaaagcttttcaacaggtacaagttatggaagataaattaaaagcagctaatattcaaaccagtgaatcagagacaagattatataataagtgtcaagatctggagtcgctaatacaggaaaaagatgacgtcattcaaaacttggaattgcaacttgaagagcagaaacaaataagaatacaagaagctaaaataatagaagagaaagcagctaagataaaagaatgggtaacagttaagttaaatgagctggaattggagaatcagaatcttcgtttgatcaaccaaaaccaaactgaagagataagaacaatgcagtcaaaactacaagttcaaggaaagaagtcatccactgtctctacactaaagctttcggaaggccagcgcctgagcagtttgacctttgggtgctttttatctcgagcaaggagtcctcctcaagtagtaaaatctgaggaaatgagcaagatatcatcgaaagaacctgagttcactgaaggaaaagacatggaagaaatggaaattccagaaaagtctgttgataaccaagttctagaaaacaacagaggccagagaacattgcatcaaaccccttgtggctcagaacagaatcggaaaacaagaacaagctttgccacagatggtggcatctcccagaattctggggctcctgtgagtgactggagctctgatgaggaagacgggagcaaaggaagatccaagtccagatgcacatccaccctctccagtcacacatctgaggaaggggtccagtgtagcaggatgggaagtgaaatgtatctgacagcatctgatgacagcagctctatatttgaggaagagacttttggcataaagagaccagaacacaagaagctatattcttggcagcaggaggcacagtggaaagctctaaatagtcctcttggaaagggaaattctgaattaagtaaaaaggaacaagatagttcctcggatgaactgaataaaaaatttcaatcccagagactcgattattcatcttcatcgagtgaagccaacaccccaagccctattttgaccccagctttaatgccaaagcatcctaactcactctctggaaaaggaacacaattagtgccttcatcacacctgccacccccaaagttaaggattcctaatgttttcagtataagtgtagcactagccaaaaggcacttaagccagccacagttaagctctgacaggatgtttggtacaaatagaaacgctataagcatgatacgaccactgagacctcaggaaactgatcttgatctagttgatggagacagtacagaagttttagagaatatggacacgagttgtgatgatggattattttcctatgactccttggactctccaaattcagatgaccaggaacactgtgactcagcaaagaaggtggcatacagcaaacctccaactcctcccctgcaccgttttccttcttgggaaagcagaatttatgctgtagccaaatcaggtattcgaatgtctgaggccttcaatatggagagtgttaataaaaattctgctgcaaccctttcctatactacatcaggactttatacatctctgatatacaagaacatgaccaccccagtgtatacaactttgaaggggaaggcgacccaaataagtagcagccctttcctggatgactcatctgggtcagaggaagaagacagctccagatccagctcccggacgtcagagtcagactcacgcagtaggagtgggccaggcagccccagagccatgaaacgaggtgtgtctctctcctctgtggcttctgaaagtgattatgctattcctcctgatgcttactccacagacacggagtactcacagccagagcagaagctcccaaaaacttgctcatcttccagtgataatgggaaaaatgaaccactggaaaaatctggttatttattaaaaatgagtggtaaagtcaagtcttggaagcggcggtggtttgttcttaaaggtggtgaattactttactacaaatctccgagtgatgtaattagaaaaccccagggccatattgaacttagtgcatcctgtagtattttaagaggagataacaaacaaacagttcagttgaccactgaaaaacacacatactatctgactgcagattctcccaatatattggaagagtggattaaagtgttacagaatgttcttcgagtacaagctgccaacccactttccctgcagcctgagggcaaacccaccatgaagggattgctcactaaggtaaaacatggatattccaagagagtctggtgtacactaataggaaagacattatattattttcggagtcaagaagataagtttcctttaggtcagatcaaactctgggaggctaaagtggaagaggttgacagatcttgtgattcagatgaagattatgaagccagtggacgaagtctgttatccacacattatactatcgttatccatcccaaagaccaaggtccaacttacctcctaattggatccaagcatgaaaaggacacttggctttatcatctgactgttgcagctggaagcaacaatgtaaacgttggatctgaatttgaacaactggtttgcaaattgctaaatatagacggggagccttcctctcagatatggagacaccccactttgtgtcacagtaaagaaggaatcatttcccctctgacaactctaccttccgaagccctgcagacagaagctattaaattatttaagacctgccagctttttataaatgctgcagttgactctcctgcaattgattaccacatatctttagcccagagtgctttgcaaatctgcctgacacatcctgagctgcagaatgaaatttgctgtcagcttattaaacagacaagacgaagacagccacagaatcaaccaggaccattgcagggctggcagctcttggcactctgcgttgggctcttccttccccatcatcctttcctgtggctcctcaggcttcacctaaagaggaatgcagattccaggtgtgcagaatactagccagctgaactgtttatgtggcctctgaaagtctacgataaatcataagtatttaacgatctgccaggtacattttcagaagaatgtatgaaacaaatattggtacaggaagcctttggttatcattgatgtggagctaggaaaatatttcctttgttatgttaaatctcttagggaagattgcaataaatacttgaaaaactgacagagaatatttttaagtgaaaagtgcatttgcatttcaagtatgaatgacttagcattagtgggtgttcattcaataaaagcaactattttgtttcctta

SEQ ID NO: 15952 - DNA, 6685 bp, Homo sapiens
  ENST00000405000
ggggatcccgggggccagtcgcggccgggacatcgggcgctgcggccggggacccgctgctgagatagacagaatatggcagagctttctgagccagagggaccagtagattggaaggaacgatgtgtagctctggagtcccaactcatgaaatttagagttcaagcaagcaagatacgagagcttttagcagagaaggactgcttgagggttctcacaacatggtggctggcttcccccagagcaagtcatccaagagaatgcaaggtggaagatgcagtgcgtcttatgacctactctcagaagtcatacttcatcatttccacaatatcctgttggttgcaaaggtcagccctatgttgtgaaggaagcaactacacatgggtgtgattaccagaagatgcaacagcttgagagacaagttattgatgctgaacgtcaagcagaaaaagcttttcaacaggtacaagttatggaagataaattaaaagcagctaatattcaaaccagtgaatcagagacaagattatataataagtgtcaagatctggagtcgctaatacaggaaaaagatgacgtcattcaaaacttggaattgcaacttgaagagcagaaacaaataagaatacaagaagctaaaataatagaagagaaagcagctaagataaaagaatgggtaacagttaagttaaatgagctggaattggagaatcagaatcttcgtttgatcaaccaaaaccaaactgaagagataagaacaatgcagtcaaaactacaagaagttcaaggaaagaagtcatccactgtctctacactaaagctttcggaaggccagcgcctgagcagtttgacctttgggtgctttttatctcgagcaaggagtcctcctcaagtagtaaaatctgaggaaatgagcaagatatcatcgaaagaacctgagttcactgaaggaaaagacatggaagaaatggaaattccagaaaagtctgttgataaccaagttctagaaaacaacagaggccagagaacattgcatcaaaccccttgtggctcagaacagaatcggaaaacaagaacaagctttgccacagatggtggcatctcccagaattctggggctcctgtgagtgactggagctctgatgaggaagacgggagcaaaggaagatccaagtccagatgcacatccaccctctccagtcacacatctgaggaaggggtccagtgtagcaggatgggaagtgaaatgtatctgacagcatctgatgacagcagctctatatttgaggaagagacttttggcataaagagaccagaacacaagaagctatattcttggcagcaggaggcacagtggaaagctctaaatagtcctcttggaaagggaaattctgaattaagtaaaaaggaacaagatagttcctcggatgaactgaataaaaaatttcaatcccagagactcgattattcatcttcatcgagtgaagccaacaccccaagccctattttgaccccagctttaatgccaaagcatcctaactcactctctggaaaaggaacacaattagtgccttcatcacacctgccacccccaaagttaaggattcctaatgttttcagtataagtgtagcactagccaaaaggcacttaagccagccacagttaagctctgacaggatgtttggtacaaatagaaacgctataagcatgatacgaccactgagacctcaggaaactgatcttgatctagttgatggagacagtacagaagttttagagaatatggacacgagttgtgatgatggattattttcctatgactccttggactctccaaattcagatgaccaggaacactgtgactcagcaaagaaggtggcatacagcaaacctccaactcctcccctgcaccgttttccttcttgggaaagcagaatttatgctgtagccaaatcaggtattcgaatgtctgaggccttcaatatggagagtgttaataaaaattctgctgcaaccctttcctatactacatcaggactttatacatctctgatatacaagaacatgaccaccccagtgtatacaactttgaaggggaaggcgacccaaataagtagcagccctttcctggatgactcatctgggtcagaggaagaagacagctccagatccagctcccggacgtcagagtcagactcacgcagtaggagtgggccaggcagccccagagccatgaaacgaggtgtgtctctctcctctgtggcttctgaaagtgattatgctattcctcctgatgcttactccacagacacggagtactcacagccagagcagaagctcccaaaaacttgctcatcttccagtgataatgggaaaaatgaaccactggaaaaatctggttatttattaaaaatgagtggtaaagtcaagtcttggaagcggcggtggtttgttcttaaaggtggtgaattactttactacaaatctccgagtgatgtaattagaaaaccccagggccatattgaacttagtgcatcctgtagtattttaagaggagataacaaacaaacagttcaggtacttaacttttttttttttttttttttttttgtatcatgccagactcaattctcaattatccaacctaatggaaaggagataggataattcagtgtttctttattcactttggggggttagtttgatgccttggaagtatgtgaaactccacgaatttttggttaaaactataatgtaagttaggtgtgtgttgagtaactcccaccacactttacctttcttcctttatactcttctttcctcatatttaatctcctaggtattttcagctgtccaactgtgaagctattttaaggaagggttatctggtaaatgaattctcaataagatgttagttatataatgtactgtgaaattcaggaatgtttgtattttaatatagaatctgaaaatgacagttcttatatgaacttcagatgccataacaccaaagtgggaaatatattggtgagcagagggagtgtgctgccaagcaagtcacactgtaggggcagctgctgcccattttactcacacataaggccagtcttgccagaaatctgttaaatttaaaacacaggctgttgagatattctagtatatgtaatttaaagtcagacactttatttctgaaatgtcttcaataaccattattttcttatattgctcctttggagggtggaggacaactttgccagaaaggtacattatcaatgtttccagtgatttgtacctgaaaacctctcaaaaatttagaaaggagaatcaaggaaagctttgtctttgggcatggcagttaagaatcatttgtaagtttctgaaatttggaaaatttgcagtgtggctaatttgagactggaacattctgagttcataatatctaatcacatgttcgttccaataatttatcttcttatatgcaagatcttcttattttatttatagttgattttgtcatttgtattaagaaacctcttctttagttgctaaaactatgctattttattatagtctttaatcattctgctcctcatttcaataagtaggaacctggccgggcgcggtggctcacgcctgtaatctcagcacttcaggaggctgaggcaggcggatcatgaggtcaggagatcgagaccatcctggctaacacggtgaaaccccgtctctactaaaaattcaaaaaaaattatccgggcatggtggcaggtgcctgtaagtcccagctgctcgggaggccgaggcaggagaatggtgtgaacccaggaggcggagcttgcagtgagccaagatggcgccactgcactccagcctgggcgacagaaagagactctgtctcaaaaaaaaaaaaaaaagaaaagtaggaacctgtaacacatttaagcaagaaagggaaaatgtgacaaataaacaagatataaaatcataaccccaaaattaggtaaactggagtaacaaagttatttccacaaaaatttaattgctgtaattctcacaaagtggttaaaatattctaactgatatggagtcatttatttagaaactgggacttgagatttagcatgtttgcttctgtgttaagtaatgacgtttgaataatgaacaaggaaatgctaacaatcctaaatcttcacagttttctttcctatacctttctcgttgcattctagttgaccactgaaaaacacacatactatctgactgcagattctcccaatatattggaagagtggattaaagtgttacagaatgttcttcgagtacaagctgccaacccactttccctgcagcctgagggcaaacccaccatgaagggattgctcactaaggtaaaacatggatattccaagagagtctggtgtacactaataggaaagacattatattattttcggagtcaagaagataagtttcctttaggtcagatcaaactctgggaggctaaagtggaagaggttgacagatcttgtgattcagatgaagattatgaagccagtggacgaagtctgttatccacacattatactatcgttatccatcccaaagaccaaggtccaacttacctcctaattggatccaagcatgaaaaggacacttggctttatcatctgactgttgcagctggaagcaacaatgtaaacgttggatctgaatttgaacaactggtttgcaaattgctaaatatagacggggagccttcctctcagatatggagacaccccactttgtgtcacagtaaagaaggaatcatttcccctctgacaactctaccttccgaagccctgcagacagaagctattaaattatttaagacctgccagctttttataaatgctgcagttgactctcctgcaattgattaccacatatctttagcccagagtgctttgcaaatctgcctgacacatcctgagctgcagaatgaaatttgctgtcagcttattaaacagacaagacgaagacagccacagaatcaaccaggaccattgcagggctggcagctcttggcactctgcgttgggctcttccttccccatcatcctttcctgtggctcctcaggcttcacctaaagaggaatgcagattccaggtgtgcagaatactagccagctgaactgtttatgtggcctctgaaagtctacgataaatcataagtatttaacgatctgccaggacagaatttggaaaatatgccatttactgccagcgttgtgtagaaagaacgcaacaaaatggtgacagagaagcaagaccctcaaggatggaaattctttcaactcttctccgaaacccttatcaccattctttgccctttagtatacctgtgcacttcatgaatgggatataccaggtagttggttttgacgcatctaccacagtggaagaatttttgaatactttgaaccaggacacaggaatgaggaaaccagcgcagtctggatttgcgttgttcactgacgatccttctggcagagatttagagcattgtcttcaaggaaacatcaagatttgtgacattatttccaaatgggaacaggcttccaaagaacagcagcctggaaaatgtgaaggtacaaggactgttcgtctgacatacaaaaacagactatatttctcagtgcaagctcgtggagagactgatagagaaaagttgctgttaatgtatcagacaaatgatcaaatcataaatggactttttcctctgaacaaagatctggcattagaaatggcagctcttttatctcaggtagagattggagattttgaaagacctttctcaactccagcagggcatgttaccaatcagtgcaaagtgaatcaaactctaaagcaagtcatagagaaattttatcctaaaaggtatagagatggctgttctgaagagcagttaaggcagctttgccagcgactttcaaccagatggatggccctccggggacacagtgctgctgactgtgtgcgcatttatttgacagtagccaggaagtggccattctttggtgccaagttgtttcttgcaaaacccataactccatcatcacttggaagtactttcttgtggctggctgtacatgaggatggtttaagcctcttagaatacaactccatgaggttaatagtcagctatgtgtacaagagtctaatgacctttggaggctatcaagatgattttatggtagtcattaacaatacacattcaaaggacaaaccaacagagaaattactttttgccatggcaaaacccaagattcttgaaatcactcttttgatcgccagttacataaacaacttccatcagcaaaaggcagcatttcaccacctctctgctccagcactgctctcagcccagacccggggaccccaagccagaatgatgggaagccagcctcttctgtcaagcagcagaccgaccaaaggccccaccttactctgaaagctggggagcctgaacattcactccttgtcctccatgctgtggctgtatcagctccctacaagttcgtttacacctggcagcacggcagccacacaccggtattccaaaccttaacaatgaagggggttagtctcttttatttgattcttaaatattcaaataaatattaacagtaaaacataaacacaaaa

SEQ ID NO: 15953 - DNA, 737 bp, Homo sapiens
  ENST00000491692
atcgggcgctgcggccggggacccgctgctgagatagacagaatatggcagagctttctgagccagagggaccagtagattggaaggaacgatgtgtagctctggagtcccaactcatgaaatttagagttcaagcaagcaagatacgagagcttttagcagagaagatgcaacagcttgagagacaagttattgatgctgaacgtcaagcagaaaaagcttttcaacagacggaatcttgctctgtggcccaggctggagtgcagtggcgcgatcttggcttactgcaacctccgcctcccgggttcaagtgattctcctgcctcaatctcctgaataactgggattacaggtacaagttatggaagataaattaaaagcagctaatattcaaaccagtgaatcagagacaagattatataataagtgtcaagatctggagtcgctaatacaggaaaaagatgacgtcattcaaaacttggaattgcaacttgaagagcagaaacaaataagaatacaagaagctaaaataatagaagagaaagcagctaagataaaagaatgggtaacagttaagttaaatgagctggaattggagaatcagaatcttcgtttgatcaaccaaaaccaaactgaagagataagaacaatgcagtcaaaactacaagaagttcaaggaaagaagtcatccactgtctctacactaaagctttcggaaggccagcgcctgagcagtt

SEQ ID NO: 15954 - DNA, 580 bp, Homo sapiens
  ENST00000460356
taaacactttgcatattgtcatcgctctaggaaacatgtacattactttatatgatagcaatattctgagaatttcttatgtttgtatgtacctccaaggtaacaccacttggtgaaataggcttgagactttataatcattaaatatattaaaccttgctgtttaatattttcctttttgaagtcttttaggaatctacataatattaaggtaaaattctaggtttaatactgtgataacctgagtacacacacaattttaatattttatcctttgaatttaggtacaagttatggaagataaattaaaagcagctaatattcaaaccagtgaatcagagacaagattatataataagtgtcaagatctggagtcgctaatacaggaaaaagatgacgtcattcaaaacttggaattgcaacttgaagagcagaaacaaataagaatacaagaagctaaaataatagaagagaaagcagctaagataaaagaatgggtaacagttaagttaaatgagctggaattggagaatcagaatcttcgtttgatcaaccaaaaccaaactgaagagataagaac

SEQ ID NO: 15955 - DNA, 685 bp, Homo sapiens
  ENST00000480103
tttcccctctgacaactctaccttccgaagccctgcagacagaagctattaaattatttaagacctgccagctttttataaatgctgcagttgactctcctgcaattgattaccacatatctttagcccagagtgctttgcaaatctgcctgacacatcctgagctgcagaatgaaatttgctgtcagcttattaaacagacaagacgaagacagccacagaatcaaccaggaccattgcagatcatgcatatgtgaaagaagcaaaacgtttttgggttaagagagactgtcatcagcccattgcactcactcagatgtggatctctgactggcacgtggtatctaacctgtggtgcttctccctgcccagggctggcagctcttggcactctgcgttgggctcttccttccccatcatcctttcctgtggctcctcaggcttcacctaaagaggaatgcagattccaggacagaatttggaaaatatgccatttactgccagcgttgtgtagaaagaacgcaacaaaatggtgacagagaagcaagaccctcaaggatggaaattctttcaactcttctccgaaacccttatcaccattctttgccctttagtatacctgtgcacttcatgaatgggatataccaggtagttggttttgacgcatctaccacagtggaagaat

SEQ ID NO: 15956 - DNA, 538 bp, Homo sapiens
  ENST00000493408
ccccatcatcctttcctgtggctcctcaggcttcacctaaagaggaatgcagattccaggacagaatttggaaaatatgccatttactgccagcgttgtgtagaaagaacgcaacaaaatggtgacagagaagcaagaccctcaaggatggaaattctttcaactcttctccgaaacccttatcaccattctttgccctttagtatacctgtgcacttcatgaatgggatataccaggtagttggttttgacgcatctaccacagtggaagaatttttgaatactttgaaccaggacacaggaatgaggaaaccagcgcagtctggatttgcgttgttcactgacgatccttctggcagagatttagagcattgtcttcaaggaaacatcaaggtgaaaccaagtccttttcaggagccaagcccaacgaacagcaaagaagctactctttacaagaagagtaaactttgcaagaagtttaattcaggagttttccaaaactttaaccaatctaatctccacgataagaaaaaaaaaa

SEQ ID NO: 15957 - DNA, 632 bp, Homo sapiens
  ENST00000490038
tccaaagaacagcagcctggaaaatgtgaaggtacaaggactgttcgtctgacatacaaaaacagactatatttctcagtgcaagctcgtggagagactgatagagaaaagttgctgttaatgtatcagacaaatgatcaaatcataaatggactttttcctctgaacaaagatctggcattagaaatggcagctcttttatctcaggcagctttgccagcgactttcaaccagatggatggccctccggggacacagtgctgctgactgtgtgcgcatttatttgacagtagccaggaagtggccattctttggtgccaagttgtttcttgcaaaacccataactccatcatcacttggaagtactttcttgtggctggctgtacatgaggatggtttaagcctcttagaatacaactccatgaggttaatagtcagctatgtgtacaagagtctaatgacctttggaggctatcaagatgattttatggtagtcattaacaatacacattcaaaggacaaaccaacagagaaattactttttgccatggcaaaacccaagattcttgaaatcactcttttgatcgccagttacataaacaacttccatcagcaaaaggcagcatttcacc

SEQ ID NO: 15958 - DNA, 3720 bp, Homo sapiens
  ENST00000323544
cttgggcccccggcagccggcgggacagaacgcggagagtcgccgcctggccgggcgtagacgcggtggcagagcccgcgcggcgctggaagcgagtggcggagcggcgggacctcggcggactcgccatggaggaggagggtgtgaaggaagccggtgagaagcctcggggagcacagatggtggacaaggctggctggatcaagaagagcagtgggggcctcctgggtttctggaaagaccgatatctgctcctctgccaggcccagctgctggtctatgagaatgaggatgatcagaagtgtgtggagactgtggagctgggcagctatgagaagtgccaggaccttcgtgccctcctcaagcgaaaacaccgctttatcctgctgcgatccccagggaacaaggtcagcgacatcaaattccaggcacccaccggggaggagaaggaatcctggatcaaagccctcaatgaagggattaaccgaggcaaaaacaaggctttcgatgaggtaaaggtggacaagagctgcgccctggagcatgtgacacgggaccgggtgcgagggggccagcgacgccggccaccaacgagagtccacctgaaggaggtggccagtgcagcttctgacggtcttctgcgcctggatcttgatgttccggacagtgggccaccagtgtttgcccccagcaatcatgtcagtgaagcccaacctcgggagacaccccggcccctcatgcctcctaccaagcctttcctagcacctgagaccaccagccctggtgacagggtggagacccctgtgggggagagagccccaacccctgtctcagcaagctctgaggtctcccctgagagccaagaggactcagagaccccagcagaggaggacagtggctctgagcagcctcccaacagcgtcctgcctgacaaactgaaggtgagctgggagaaccccagcccccaggaggcccctgctgcagagagtgcagaaccgtcccaggcaccctgttctgagacttctgaggctgcccccagggagggtgggaagccccctacacccccacccaagatcttatcagagaaactgaaagcctccatgggtgagatgcaggcttctgggccacctgctccaggcacagtgcaggtctcagtgaatggcatggatgacagtcctgagcctgccaagccctctcaggctgagggcaccccaggaactcctccaaaggatgcaacaacatccacagcactgcccccctgggacctgccacctcagttccatccccgctgctcctcccttggggacttgcttggggaaggcccgcggcatcccttgcagcccagggaacggctatatcgggcccagctggaggtgaaggtggcctcggaacagacggagaaactgttgaacaaggtgctgggcagtgagccggcccctgttagtgccgaaacattgctcagccaggctgtggagcagctgaggcaggccacccaggtcctgcaggaaatgagagatttgggagagctgagccaggaagcacctgggctaagggagaagcggaaggagctggtgaccctctacaggagaagtgcaccctagggccttctgggccagaggcaccatcccttctggccatccatcaagtccatcaaggcccagccctgctgagaaatgtgcttctgcttctacagcaatggctgcaggagggccattgggcatgtcagggtttggccatgacccgaagagactcctggcgtccttcctactctgctctggccagtggtgccaggtgccacccagggctactgcctggctatctggcctggcctctgggctggggctggggctgggagcacacacgctgggacctatgtgtttgtgtggtcgttccaaactgccccagggctttgggggcggcacttggggtttctgggaatgacatcatctctgttccccatccccagtagtttacattcctgacttctgaatacagcacagctgagccccctgcagctcccatctccagctattcctaggcaaagagcctcatggctaaggcagcctcaaagccagcccctcctcccacctattctgagtagctgcagaggccttgggtccaggctctaggttcatccctcagttggggggaacgtaggacccagctggagcctcttgagggagatgagaggcctctttgtgaggaggacattagctgtgtggcctctctctctttggccctgtttccttttttgcaaaacaaggacattttctgcagccccttcctctcagtgagctatgattggagggcttaggtctggaggattcaagagtggaagaggaatttaaggggtcccctagtctagtctctgcccctggatagtgtccagccttgtatatttctgaagaggtggatcccagagtggctctgatgtccacattagaaaaacttacttgtaatgatcatgtcagccttcagaagagaatccccaccaacttctgtgcctcctcagatggggatttatctggatctctgtggttccttctcagccgaaacaggtccagtatcccagtcatttcttcaaatgctgataggggtatgttggaatccgaagccacttccccgccttcaagccccagatgggctgctctcctgtaactttctaggagaagagacattttcttctttccctttcctggtccatccctgcaccctggtcctctcccagcctctcccccacattgtccctgactctaggggcacatccagtctccatcgtgctgcagcagctggactgagggcagagcctgtaggtgcagaggccctggctcccgaggtccagccactctccctggggcctctggggtgagagcagcttccgataggacctgcccagatttctgcatgtgcacttttgtttactgaaagagagaaaggggggggtcacagcaacatgccctggcctttctgctctgttccccaaccccactgaggcctgctgcacaggtcaatgccttcgttatcgttattgtactgtcactttgttcttgaggtagtagtcaaggatcaggaggggcagatgtcttctctgggctgcgtggggccggagcagaggtgagcagcaatgcactggttcgggagcccccatcagcctccttgtgcaaactgggcccccatgccacagtctggctttccctccatctgccccaggacaagagcaagaaggacatcagttgcccagtcatgtgatcccctgccatcttgccttaggaacagccttcccccaccagcagccatggctggctggggctttagccaagccacctactgccaggaattggagcctcagttccctcctgtgtcaagtagctaactgcagcagctggactgagggcagagtctgtgggtgcagagaccctgcatgtaggtcacaggttgaggcccagccactctccctggggcctggtgggtaggcaagtagctctggggccacctcaagtgaccaaatgctattaatttccatcctttagcaggctgggccctaggcaggaagctggcttctgggagaggagtgagaacgtgcagggcctgcctagcttgcgtgcttgaggaaggtggcattccgtgcttgcctccttgaggagggtggcattctgtgtcttctgcttatgaagcgcctttcttaaagtttggcaataaatccatttttatggaacttca

SEQ ID NO: 15959 - DNA, 3569 bp, Homo sapiens
  ENST00000616065
aagtttcttgggcccccggcagccggcgggacagaacgcggagagtcgccgcctggccgggcgtagacgcggtggcagagcccgcgcggcgctggaagcgagtggcggagcggcgggacctcggcggactcgccatggaggaggaggatgatcagaagtgtgtggagactgtggagctgggcagctatgagaagtgccaggaccttcgtgccctcctcaagcgaaaacaccgctttatcctgctgcgatccccagggaacaaggtcagcgacatcaaattccaggcacccaccggggaggagaaggaatcctggatcaaagccctcaatgaagggattaaccgaggcaaaaacaaggctttcgatgaggtaaaggtggacaagagctgcgccctggagcatgtgacacgggaccgggtgcgagggggccagcgacgccggccaccaacgagagtccacctgaaggaggtggccagtgcagcttctgacggtcttctgcgcctggatcttgatgttccggacagtgggccaccagtgtttgcccccagcaatcatgtcagtgaagcccaacctcgggagacaccccggcccctcatgcctcctaccaagcctttcctagcacctgagaccaccagccctggtgacagggtggagacccctgtgggggagagagccccaacccctgtctcagcaagctctgaggtctcccctgagagccaagaggactcagagaccccagcagaggaggacagtggctctgagcagcctcccaacagcgtcctgcctgacaaactgaaggtgagctgggagaaccccagcccccaggaggcccctgctgcagagagtgcagaaccgtcccaggcaccctgttctgagacttctgaggctgcccccagggagggtgggaagccccctacacccccacccaagatcttatcagagaaactgaaagcctccatgggtgagatgcaggcttctgggccacctgctccaggcacagtgcaggtctcagtgaatggcatggatgacagtcctgagcctgccaagccctctcaggctgagggcaccccaggaactcctccaaaggatgcaacaacatccacagcactgcccccctgggacctgccacctcagttccatccccgctgctcctcccttggggacttgcttggggaaggcccgcggcatcccttgcagcccagggaacggctatatcgggcccagctggaggtgaaggtggcctcggaacagacggagaaactgttgaacaaggtgctgggcagtgagccggcccctgttagtgccgaaacattgctcagccaggctgtggagcagctgaggcaggccacccaggtcctgcaggaaatgagagatttgggagagctgagccaggaagcacctgggctaagggagaagcggaaggagctggtgaccctctacaggagaagtgcaccctagggccttctgggccagaggcaccatcccttctggccatccatcaagtccatcaaggcccagccctgctgagaaatgtgcttctgcttctacagcaatggctgcaggagggccattgggcatgtcagggtttggccatgacccgaagagactcctggcgtccttcctactctgctctggccagtggtgccaggtgccacccagggctactgcctggctatctggcctggcctctgggctggggctggggctgggagcacacacgctgggacctatgtgtttgtgtggtcgttccaaactgccccagggctttgggggcggcacttggggtttctgggaatgacatcatctctgttccccatccccagtagtttacattcctgacttctgaatacagcacagctgagccccctgcagctcccatctccagctattcctaggcaaagagcctcatggctaaggcagcctcaaagccagcccctcctcccacctattctgagtagctgcagaggccttgggtccaggctctaggttcatccctcagttggggggaacgtaggacccagctggagcctcttgagggagatgagaggcctctttgtgaggaggacattagctgtgtggcctctctctctttggccctgtttccttttttgcaaaacaaggacattttctgcagccccttcctctcagtgagctatgattggagggcttaggtctggaggattcaagagtggaagaggaatttaaggggtcccctagtctagtctctgcccctggatagtgtccagccttgtatatttctgaagaggtggatcccagagtggctctgatgtccacattagaaaaacttacttgtaatgatcatgtcagccttcagaagagaatccccaccaacttctgtgcctcctcagatggggatttatctggatctctgtggttccttctcagccgaaacaggtccagtatcccagtcatttcttcaaatgctgataggggtatgttggaatccgaagccacttccccgccttcaagccccagatgggctgctctcctgtaactttctaggagaagagacattttcttctttccctttcctggtccatccctgcaccctggtcctctcccagcctctcccccacattgtccctgactctaggggcacatccagtctccatcgtgctgcagcagctggactgagggcagagcctgtaggtgcagaggccctggctcccgaggtccagccactctccctggggcctctggggtgagagcagcttccgataggacctgcccagatttctgcatgtgcacttttgtttactgaaagagagaaaggggggggtcacagcaacatgccctggcctttctgctctgttccccaaccccactgaggcctgctgcacaggtcaatgccttcgttatcgttattgtactgtcactttgttcttgaggtagtagtcaaggatcaggaggggcagatgtcttctctgggctgcgtggggccggagcagaggtgagcagcaatgcactggttcgggagcccccatcagcctccttgtgcaaactgggcccccatgccacagtctggctttccctccatctgccccaggacaagagcaagaaggacatcagttgcccagtcatgtgatcccctgccatcttgccttaggaacagccttcccccaccagcagccatggctggctggggctttagccaagccacctactgccaggaattggagcctcagttccctcctgtgtcaagtagctaactgcagcagctggactgagggcagagtctgtgggtgcagagaccctgcatgtaggtcacaggttgaggcccagccactctccctggggcctggtgggtaggcaagtagctctggggccacctcaagtgaccaaatgctattaatttccatcctttagcaggctgggccctaggcaggaagctggcttctgggagaggagtgagaacgtgcagggcctgcctagcttgcgtgcttgaggaaggtggcattccgtgcttgcctccttgaggagggtggcattctgtgtcttctgcttatgaagcgcctttcttaaagtttggcaataaatccatttttatgg

SEQ ID NO: 15960 - DNA, 2960 bp, Homo sapiens
  ENST00000274289
gcgcgcggctccgctgggaagcgagacccgggtggcgggacaagacttgcttcccggccacgcgcgctcggccggccgtggggcggggcataggccgtgacgtgatgtcgcgtatcgagtctccgcccccttcccgcctccccgtatataagacttcgccgagcgctctcactcgcacaagtggaccggggtgttgggtgctagtcggcaccagaggcaagggtgcgaggaccacggccggctcggacgtgtgaccgcgcctagggggtggcagcgggcagtgcggggcggcaaggcgaccatggagcttttgcggactatcacctaccagccagccgccagcaccaaaatgtgcgagcaggcgctgggcaagggttgcggagcggactcgaagaagaagcggccgccgcagccccccgaggaatcgcagccacctcagtcccaggcgcaagtgcccccggcggcccctcaccaccatcaccaccattcgcactcggggccggagatctcgcggattatcgtcgaccccacgactgggaagcgctactgccggggcaaagtgctgggaaagggtggctttgcaaaatgttacgagatgacagatttgacaaataacaaagtctacgccgcaaaaattattcctcacagcagagtagctaaacctcatcaaagggaaaagattgacaaagaaatagagcttcacagaattcttcatcataagcatgtagtgcagttttaccactacttcgaggacaaagaaaacatttacattctcttggaatactgcagtagaaggtcaatggctcatattttgaaagcaagaaaggtgttgacagagccagaagttcgatactacctcaggcagattgtgtctggactgaaataccttcatgaacaagaaatcttgcacagagatctcaaactagggaacttttttattaatgaagccatggaactaaaagttggggacttcggtctggcagccaggctagaacccttggaacacagaaggagaacgatatgtggtaccccaaattatctctctcctgaagtcctcaacaaacaaggacatggctgtgaatcagacatttgggccctgggctgtgtaatgtatacaatgttactagggaggcccccatttgaaactacaaatctcaaagaaacttataggtgcataagggaagcaaggtatacaatgccgtcctcattgctggctcctgccaagcacttaattgctagtatgttgtccaaaaacccagaggatcgtcccagtttggatgacatcattcgacatgacttttttttgcagggcttcactccggacagactgtcttctagctgttgtcatacagttccagatttccacttatcaagcccagctaagaatttctttaagaaagcagctgctgctctttttggtggcaaaaaagacaaagcaagatatattgacacacataatagagtgtctaaagaagatgaagacatctacaagcttaggcatgatttgaaaaagacttcaataactcagcaacccagcaaacacaggacagatgaggagctccagccacctaccaccacagttgccaggtctggaacacccgcagtagaaaacaagcagcagattggggatgctattcggatgatagtcagagggactcttggcagctgtagcagcagcagtgaatgccttgaagacagtaccatgggaagtgttgcagacacagtggcaagggttcttcggggatgtctggaaaacatgccggaagctgattgcattcccaaagagcagctgagcacatcatttcagtgggtcaccaaatgggttgattactctaacaaatatggctttgggtaccagctctcagaccacaccgtcggtgtccttttcaacaatggtgctcacatgagcctccttccagacaaaaaaacagttcactattacgcagagcttggccaatgctcagttttcccagcaacagatgctcctgagcaatttattagtcaagtgacggtgctgaaatacttttctcattacatggaggagaacctcatggatggtggagatctgcctagtgttactgatattcgaagacctcggctctacctccttcagtggctaaaatctgataaggccctaatgatgctctttaatgatggcacctttcaggtgaatttctaccatgatcatacaaaaatcatcatctgtagccaaaatgaagaataccttctcacctacatcaatgaggataggatatctacaactttcaggctgacaactctgctgatgtctggctgttcatcagaattaaaaaatcgaatggaatatgccctgaacatgctcttacaaagatgtaactgaaagacttttcgaatggaccctatgggactcctcttttccactgtgagatctacagggaagccaaaagaatgatctagagtatgttgaagaagatggacatgtggtggtacgaaaacaattcccctgtggcctgctggactggttggaaccagaacaggctaaggcatacagttcttgactttggacaatccaagagtgaaccagaatgcagttttccttgagatacctgttttaaaaggtttttcagacaattttgcagaaaggtgcattgattcttaaattctctctgttgagagcatttcagccagaggactttggaactgtgaatatacttcctgaaggggagggagaagggaggaagctcccatgttgtttaaaggctgtaattggagcagcttttggctgcgtaactgtgaactatggccatatataattttttttcattaatttttgaagatacttgtggctggaaaagtgcattccttgttaataaactttttatttattacagcccaaagagcagtatttattatcaaaatgtctttttttttatgttgaccattttaaaccgttggcaataaagagtatgaaaacgcagaaa

SEQ ID NO: 15961 - DNA, 768 bp, Homo sapiens
  ENST00000502671
ccccaaattatctctctcctgaagtcctcaacaaacaaggacatggctgtgaatcagacatttgggccctgggctgtgtaatgtatacaatgttactagggaggcccccatttgaaactacaaatctcaaagaaacttataggtgcataagggaagcaaggtatacaatgccgtcctcattgctggctcctgccaagcacttaattgctagtatgttgtccaaaaacccagaggatcgtcccagtttggatgacatcattcgacatgacttttttttgcagggcttcactccggacagactgtcttctagctgttgtcatacagttccagatttccacttatcaagcccagctaagaatttctttaagaaagcagctgctgctctttttggtggcaaaaaagacaaagcaagatatattgacacacataatagagtgtctaaagaagatgaagacatctacaagcttaggcatgatttgaaaaagacttcaataactcagcaacccagcaaacacaggacagatgaggaagctcccatgttgtttaaaggctgtaattggagcagcttttggctgcgtaactgtgaactatggccatatataattttttttcattaatttttgaagatacttgtggctggaaaagtgcattccttgttaataaactttttatttattacagcccaaagagcagtatttattatcaaaatgtctttttttttatgttgaccattttaaaccgttggcaataaagagtatgaaaacgcag

SEQ ID NO: 15962 - DNA, 275 bp, Homo sapiens
  ENST00000511326
cttgcttaagtttgagaggattttcttagaataataatagagtgcatgctacaaaatctttgtaggcactaactcactctcctaatctcttccagggtggagatctgcctagtgttactgatattcgaagacctcggctctacctccttcagtggctaaaatctgataaggccctaatgatgctctttaatgatggcacctttcaggtgaatttctaccatgatcatacaaaaatcatcatctgtagccaaaatgaagaataccttctcacctac

SEQ ID NO: 15963 - DNA, 587 bp, Homo sapiens
  ENST00000503378
agatgcttgactcattgcataaatcttctctcttctaaggagctccagccacctaccaccacagttgccaggtctggaacacccgcagtagaaaacaagcagcagattggggatgctattcggatgatagtcagagggactcttggcagctgtagcagcagcagtgaatgccttgaagacagtaccatgggaagtgttgcagacacagtggcaagggttcttcggggatgtctggaaaacatgccggaagctgattgcattcccaaagagcagctgagcacatcatttcagtgggtcaccaaatgggttgattactctaacaaatatggctttgggtaccagctctcagaccacaccgtcggtgtccttttcaacaatggtgctcacatgagcctccttccagacaaaaaaacagttcactattacgcagagcttggccaatgctcagttttcccagcaacagatgctcctgagcaatttattagtcaagtgacggtgctgaaatacttttctcattacatggaggagaacctcatggatggtggagatctgcctagtgttactgatattcgaagacctcggctcta

SEQ ID NO: 15964 - DNA, 557 bp, Homo sapiens
  ENST00000505244
ttatcatggttcaaatatgtcatatttacttaaagtttttcttcaaaccctttgaaagggaagttaaaactaaaaggaagtcttttagttttacagtgcatgcaagtgagtttactgcgttatcttttatctggcttgtgtccattgctttttgatgagctttcccagcaattgcctcactctcatcttaatctggaattctcacccttaaatgaatttagatgcttgactcattgcataaatcttctctcttctaaggagctccagccacctaccaccacagttgccaggtctggaacacccgcagtagaaaacaagcagcagattggggatgctattcggatgatagtcagagggactcttggcagctgtagcagcagcagtgaatgccttgaagacagtaccatgggaagtgttgcagacacagtggcaagggttcttcggggatgtctggaaaacatgccggaagctgattgcattcccaaagagcagctgagcacatcatttcagtgggtcaccaaatgggttgattactctaacaaatatggctttgggta

SEQ ID NO: 15965 - DNA, 690 bp, Homo sapiens
  ENST00000503713
ctggctcctgccaagcacttaattgctagtatgttgtccaaaaacccagaggatcgtcccagtttggatgacatcattcgacatgacttttttttgcagggcttcactccggacagactgtcttctagctgttgtcatacagttccagatttccacttatcaagcccagctaagaatttctttaagaaagcagctgctgctctttttggtggcaaaaaagacaaagcaagatatattgacacacataatagagtgtctaaagaagatgaagacatctacaagcttaggcatgatttgaaaaagacttcaataactcagcaacccagcaaacacaggacagatgaggtgtgttgggaaagagtaaagtagatactcacgctttacgttatttccactctttattaattagcacttggactatgattatcatggttcaaatatgtcatatttacttaaagtttttcttcaaaccctttgaaagggaagttaaaactaaaaggaagtcttttagttttacagtgcatgcaagtgagtttactgcgttatcttttatctggcttgtgtccattgctttttgatgagctttcccagcaattgcctcactctcatcttaatctggaattctcacccttaaatgaatttagatgcttgactcattgcataaatcttctctcttctaaggagctccag

SEQ ID NO: 15966 - DNA, 591 bp, Homo sapiens
  ENST00000510629
tgctttatgaccattgctaaagatgtgtttctttgcacacaggtatacaatgttactagggaggcccccatttgaaactacaaatctcaaagaaacttataggtgcataagggaagcaaggtatacaatgccgtcctcattgctggctcctgccaagcacttaattgctagtatgttgtccaaaaacccagaggatcgtcccagtttggatgacatcattcgacatgacttttttttgcagggcttcactccggacagactgtcttctagctgttgtcatacagttccagatttccacttatcaagcccagctaagaatttctttaagaaagcagctgctgctctttttggtggcaaaaaagacaaagcaagatatattgacacacatagtaagttaacaagacttcttttcctttttcgtacccaatattatatttaaatttggtaaattagttaaaagagaattttatattagcataacttggccatatttgcgtattcttaaatgttgatatttatagcataataaatccataccttgaattgtgattgatagctttttattttgcaaacactaaagagggcttttgg

SEQ ID NO: 15967 - DNA, 536 bp, Homo sapiens
  ENST00000503115
ttcagatgccaaaagtcaaatgtttccaaatagaaattcagtatagattttaagattttgtttaagattttgtctcccatcaagtcatgtcaagagaaccaagtttaagtagtggaatagttcctaacacgatctcaatattttgtctttccagaacgatatgtggtaccccaaattatctctctcctgaagtcctcaacaaacaaggacatggctgtgaatcagacatttgggccctgggctgtgtaatgtatacaatgttactagggaggcccccatttgaaactacaaatctcaaagaaacttataggtgcataagggaagcaaggtatacaatgccgtcctcattgctggctcctgccaagcacttaattgctagtatgttgtccaaaaacccagaggatcgtcccagtttggatgacatcattcgacatgacttttttttgcagggcttcactccggacagactgtcttctagctgttgtcatacagttccagatttccacttatcaagcccagctaagaatttctttaag

SEQ ID NO: 15968 - DNA, 1410 bp, Homo sapiens
  ENST00000515415
tttgcattcttagcctcagaactgtgtgtctcccgcagcccagagaaatgcatcttgagtctggaagcgagggctttctacatcagacctctctccctctatctgctcccagggaattttcctgacaagtctcatcagagattatttttcatgtctccccgttccaactccctccataaagctcccctttataaaagaagaagagaaactgtttgaacttgctgtttccagcaatgcatttctcttcatgagggagctttaacgaagtcgaatgcctccctctgtccaccctcctccattcctcaatttttttttttttgcttttctttcttcccatttatttatttatttaaaatatctgccgtccatttttgtgccatcctcaattccgtctcggctttgtttcctttcagggtggctttgcaaaatgttacgagatgacagatttgacaaataacaaagtctacgccgcaaaaattattcctcacagcagagtagctaaacctcatcaaagggaaaagattgacaaagaaatagagcttcacagaattcttcatcataagcatgtagtgcagttttaccactacttcgaggacaaagaaaacatttacattctcttggaatactgcagtagaaggtcaatggctcatattttgaaagcaagaaaggtgttgacagagccagaagttcgatactacctcaggcagattgtgtctggactgaaataccttcatgaacaagaaatcttgcacagagatctcaaactaggtaagtcattgacgccaaaagctgagttttgtgttagagttcttttttctctctctgtttttttttacatattaatgttcttaattgggatctcgtgtctgcaatcttgcttttgaatgggcgactttcatataacaattggctgcctggctccaaagtggatgtgtgtgtacttggttagaacgcattttcaaagggattcacattttgttttgtttatcgtctagggaacttttttattaatgaagccatggaactaaaagttggggacttcggtctggcagccaggctagaacccttggaacacagaaggagaacgatatgtggtaccccaaattatctctctcctgaagtcctcaacaaacaaggacatggctgtgaatcagacatttgggccctgggctgtgtaatgtatacaatgttactagggaggcccccatttgaaactacaaatctcaaagaaacttataggtgcataagggaagcaaggtatacaatgccgtcctcattgctggctcctgccaagcacttaattgctagtatgttgtccaaaaacccagaggatcgtcccagtttggatgacatcattcgacatgacttttttttgcagggcttcactccggacagactgtcttctagctg

SEQ ID NO: 15969 - DNA, 556 bp, Homo sapiens
  ENST00000509555
ggcttttccgaggtgactggaagctaataagccttaccttgctttttcatttagattgacaaagaaatagagcttcacagaattcttcatcataagcatgtagtgcagttttaccactacttcgaggacaaagaaaacatttacattctcttggaatactgcagtagaaggtcaatggctcatattttgaaagcaagaaaggtgttgacagagccagaagttcgatactacctcaggcagattgtgtctggactgaaataccttcatgaacaagaaatcttgcacagagatctcaaactagggaacttttttattaatgaagccatggaactaaaagttggggacttcggtctggcagccaggctagaacccttggaacacagaaggagaacgatatgtggtaccccaaattatctctctcctgaagtcctcaacaaacaaggacatggctgtgaatcagacatttgggccctgggctgtgtaatgtatacaatgttactagggaggcccccatttgaaactacaaatctcaaagaaacttataggtgcataaggg

SEQ ID NO: 15970 - DNA, 580 bp, Homo sapiens
  ENST00000509422
ataactgttttgacagattctcttttttccttctcctcttcttagtcaatggctcatattttgaaagcaagaaaggtgttgacagagccagaagttcgatactacctcaggcagattgtgtctggactgaaataccttcatgaacaagaaatcttgcacagagatctcaaactaggtaagtcattgacgccaaaagctgagttttgtgttagagttcttttttctctctctgtttttttttacatattaatgttcttaattgggatctcgtgtctgcaatcttgcttttgaatgggcgactttcatataacaattggctgcctggctccaaagtggatgtgtgtgtacttggttagaacgcattttcaaagggattcacattttgttttgtttatcgtctagggaacttttttattaatgaagccatggaactaaaagttggggacttcggtctggcagccaggctagaacccttggaacacagaaggagaacgatatgtggtaccccaaattatctctctcctgaagtcctcaacaaacaaggacatggctgtgaatcagacatttgggccctgggctg

SEQ ID NO: 15971 - DNA, 558 bp, Homo sapiens
  ENST00000508300
catttttgtgccatcctcaattccgtctcggctttgtttcctttcagggtggctttgcaaaatgttacgagatgacagatttgacaaataacaaagtctacgccgcaaaaattattcctcacagcagagtagctaaacctcatcaaagggaaaagattgacaaagaaatagagcttcacagaattcttcatcataagcatgtagtgcagttttaccactacttcgaggacaaagaaaacatttacattctcttggaatactgcagtagaaggtcaatggctcatattttgaaagcaagaaaggtgttgacagagccagaagttcgatactacctcaggcagattgtgtctggactgaaataccttcatgaacaagaaatcttgcacagagatctcaaactagggaacttttttattaatgaagccatggaactaaaagttggggacttcggtctggcagccaggctagaacccttggaacacagaaggagaacgatatgtggtaccccaaattatctctctcctgaagtcctcaacaaacaaggacatggctgtgaat

SEQ ID NO: 15972 - DNA, 823 bp, Homo sapiens
  ENST00000514306
ggccgccgcagccccccgaggaatcgcagccacctcagtcccaggcgcaagtgcccccggcggcccctcaccaccatcaccaccattcgcactcggggccggagatctcgcggattatcgtcgaccccacgactgggaagcgctactgccggggcaaagtgctgggaaagggtggctttgcaaaatgttacgagatgacagatttgacaaataacaaagtctacgccgcaaaaattattcctcacagcagagtagctaaacctcatcaaagggaaaagattgacaaagaaatagagcttcacagaattcttcatcataagcatgtagtgcagttttaccactacttcgaggacaaagaaaacatttacattctcttggaatactgcagtagaagggtaagtgtcaactcctatttgagaacatttgcttaccccgaattaacatggtattcaaagagtattttatctgggattttagctgtggcagcacttacactgcaaagttaactttcattgctcatcctgcaaagggaaaccagtgattttgataactgttttgacagattctcttttttccttctcctcttcttagtcaatggctcatattttgaaagcaagaaaggtgttgacagagccagaagttcgatactacctcaggcagattgtgtctggactgaaataccttcatgaacaagaaatcttgcacagagatctcaaactaggtaagtcattgacgccaaaagctgagttttgtgttagagttcttttttctctctctgtttttttttacatattaatgttcttaattgggatctcgtgtctgc

SEQ ID NO: 15973 - DNA, 625 bp, Homo sapiens
  ENST00000504196
gcacaagtggaccggggtgttgggtgctagtcggcaccagaggcaagggtgcgaggaccacggccggctcggacgtgtgaccgcgcctagggggtggcagcgggcagtgcggggcggcaaggcgaccatggagcttttgcggactatcacctaccagccagccgccagcaccaaaatgtgcgagcaggcgctgggcaagggttgcggagcggactcgaagaagaagcggccgccgcagccccccgaggaatcgcagccacctcagtcccaggcgcaagtgcccccggcggcccctcaccaccatcaccaccattcgcactcggggccggagatctcgcggattatcgtcgaccccacgactgggaagcgctactgccggggcaaagtgctgggaaagggtggctttgcaaaatgttacgagatgacagatttgacaaataacaaagtctacgccgcaaaaattattcctcacagcagagtagctaaacctcatcaaagggaaaaggtgcgtatgactcttgagtaaagtattttctttgtgtgcaaggatggcccttccctgttaggaaaatgtcttctgcatgtgtaatcactggcttttccgaggtgactggaagctaataag

SEQ ID NO: 15974 - DNA, 2792 bp, Homo sapiens
  ENST00000617412
tccgcccccttcccgcctccccgtatataagacttcgccgagcgctctcactcgcacaagtggaccggggtgttgggtgctagtcggcaccagaggcaagggtgcgaggaccacggccggctcggacgtgtgaccgcgcctagggggtggcagcgggcagtgcggggcggcaaggcgaccatggagcttttgcggactatcacctaccagccagccgccagcaccaaaatgtgcgagcaggcgctgggcaagggttgcggagcggactcgaagaagaagcggccgccgcagccccccgaggaatcgcagccacctcagtcccaggcgcaagtgcccccggcgatctcgcggattatcgtcgaccccacgactgggaagcgctactgccggggcaaagtgctgggaaagggtggctttgcaaaatgttacgagatgacagatttgacaaataacaaagtctacgccgcaaaaattattcctcacagcagagtagctaaacctcatcaaagggaaaagattgacaaagaaatagagcttcacagaattcttcatcataagcatgtagtgcagttttaccactacttcgaggacaaagaaaacatttacattctcttggaatactgcagtagaaggtcaatggctcatattttgaaagcaagaaaggtgttgacagagccagaagttcgatactacctcaggcagattgtgtctggactgaaataccttcatgaacaagaaatcttgcacagagatctcaaactagggaacttttttattaatgaagccatggaactaaaagttggggacttcggtctggcagccaggctagaacccttggaacacagaaggagaacgatatgtggtaccccaaattatctctctcctgaagtcctcaacaaacaaggacatggctgtgaatcagacatttgggccctgggctgtgtaatgtatacaatgttactagggaggcccccatttgaaactacaaatctcaaagaaacttataggtgcataagggaagcaaggtatacaatgccgtcctcattgctggctcctgccaagcacttaattgctagtatgttgtccaaaaacccagaggatcgtcccagtttggatgacatcattcgacatgacttttttttgcagggcttcactccggacagactgtcttctagctgttgtcatacagttccagatttccacttatcaagcccagctaagaatttctttaagaaagcagctgctgctctttttggtggcaaaaaagacaaagcaagatatattgacacacataatagagtgtctaaagaagatgaagacatctacaagcttaggcatgatttgaaaaagacttcaataactcagcaacccagcaaacacaggacagatgaggagctccagccacctaccaccacagttgccaggtctggaacacccgcagtagaaaacaagcagcagattggggatgctattcggatgatagtcagagggactcttggcagctgtagcagcagcagtgaatgccttgaagacagtaccatgggaagtgttgcagacacagtggcaagggttcttcggggatgtctggaaaacatgccggaagctgattgcattcccaaagagcagctgagcacatcatttcagtgggtcaccaaatgggttgattactctaacaaatatggctttgggtaccagctctcagaccacaccgtcggtgtccttttcaacaatggtgctcacatgagcctccttccagacaaaaaaacagttcactattacgcagagcttggccaatgctcagttttcccagcaacagatgctcctgagcaatttattagtcaagtgacggtgctgaaatacttttctcattacatggaggagaacctcatggatggtggagatctgcctagtgttactgatattcgaagacctcggctctacctccttcagtggctaaaatctgataaggccctaatgatgctctttaatgatggcacctttcaggtgaatttctaccatgatcatacaaaaatcatcatctgtagccaaaatgaagaataccttctcacctacatcaatgaggataggatatctacaactttcaggctgacaactctgctgatgtctggctgttcatcagaattaaaaaatcgaatggaatatgccctgaacatgctcttacaaagatgtaactgaaagacttttcgaatggaccctatgggactcctcttttccactgtgagatctacagggaagccaaaagaatgatctagagtatgttgaagaagatggacatgtggtggtacgaaaacaattcccctgtggcctgctggactggttggaaccagaacaggctaaggcatacagttcttgactttggacaatccaagagtgaaccagaatgcagttttccttgagatacctgttttaaaaggtttttcagacaattttgcagaaaggtgcattgattcttaaattctctctgttgagagcatttcagccagaggactttggaactgtgaatatacttcctgaaggggagggagaagggaggaagctcccatgttgtttaaaggctgtaattggagcagcttttggctgcgtaactgtgaactatggccatatataattttttttcattaatttttgaagatacttgtggctggaaaagtgcattccttgttaataaactttttatttattacagcccaaagagcagtatttattatcaaaatgtctttttttttatgttgaccattttaaaccgttggcaataaagagtatgaaaacgc

SEQ ID NO: 15975 - DNA, 1930 bp, Homo sapiens
  ENST00000454744
ctcagagcggccccggagcggccgcagcgcggtggtctcggcccggctgcgccagagtccgcgcgatggagccccggccgcggcggcggcgcaggagtcgccccctggtcgccgccttcctgcgagacccgggctcgggccgcgtgtacaggcgcgggaagctgatcggcaagggcgccttcagccgctgctacaagctgacagacatgtccaccagcgccgtgttcgccctcaaggtggtgccgtgtggcggggctggggccgggtggcttcgcccgcagggaaaggtggagcgtgagattgccctgcatagccgcctgcgaccccgcaacatcgtggctttccacggacactttgctgaccgcgaccacgtgtacatggtgctggagtactgcagccgccagtctttggcccacgtgctgagggcgcggcagatcctgacggagccagaagtgcgcgactacctgcggggcctggtcagcggcctgcgctacctgcaccagcggtgcatcctgcaccgcgacctgaagctcagtaacttcttccttaacaagaacatggaggtgaagattggagacctgggactggcggccaaggtggggccagggggccgctgccacagagtactctgtgggacccctaacttcctggaccctgaggttgtctccagaaacggtcactcctgccagtaggacatctgggctctgggctgcatcatgtacacggtgctgactggcaccccacccttcatggcctcacccctgtcggagatgtaccaaaacatccgtgagggccactaccccgaacccgctcacctgtctgccaatgcgcgccgcctcatcgtgcacctcctagcacccaacccggccgagcggcccagcctggaccacctgctgcaggacgacttcttcacacagggtttcactccagaccggctgccggcccactcctgccacagtccccccatcttcgccatacccccgcctctgggcaggatcttccggaaggtgggccagcggctgctcacccagtgccggccaccctgccccttcacgcctaaagaggcctcgggtccaggagaaggtgggccagaccctgactccatggagtgggacggcgagagctccctgtctgcgaaagaggttccctgcctggaaggccccatccacctggtcgcacaagggaccctgcagagtgacctggccgggcccgaggggagccggcggccagaggtggaggcggccctcagacacctgcagctgtgcctggatgtaggccccccggccacacaggaccccctgggagagcagcagcccatcctctgggcccccaaatgggtggattattccagcaaatacggctttggctaccagctcttggacggggggcgcacgggacggcacccacatggccctgcgaccccccggagggaggggaccctccccacacctgtgccacctgctggacccggcctctgcctcctgcgcttcctggcctctgagcacgccctgctgctgctgttcagcaatgggatggtgcaggtgagcttcagtggagtcccggcccaactggtgctgagtggcgagggtgagggtttgcagctcaccctctgggagcaggggtcccctggcacctcctactccctggacgtcccgcggagccacggctgcgcccccaccaccggacagcaccttcaccacgccctccgcatgctgcagagtatctagtgcccctgagggtcagagtggacccctgcatggtagtgccagggacccaggctccatttccattcctgtggctcccccagaggggctgtcctgggggagggctggggggcacacgggaggtgggttcttgccttgtggcatgactgttcaacccagactttgctgggatctcttcctttttcattaaagacaatttgaaatgc

SEQ ID NO: 15976 - DNA, 1969 bp, Homo sapiens
  ENST00000642079
agagcggccccggagcggccgcagcgcggtggtctcggcccggctgcgccagagtccgcgcgatggagccccggccgcggcggcggcgcaggagtcgccccctggtcgccgccttcctgcgagacccgggctcgggccgcgtgtacaggcgcgggaagctgatcggcaagggcgccttcagccgctgctacaagctgacagacatgtccaccagcgccgtgttcgccctcaaggtggtgccgtgtggcggggctggggccgggtggcttcgcccgcagggaaaggtggagcgtgagattgccctgcatagccgcctgcgaccccgcaacatcgtggctttccacggacactttgctgaccgcgaccacgtgtacatggtgctggagtactgcagccgccagtctttggcccacgtgctgagggcgcggcagatcctgacggagccagaagtgcgcgactacctgcggggcctggtcagcggcctgcgctacctgcaccagcggtgcatcctgcaccgcgacctgaagctcagtaacttcttccttaacaagaacatggaggtgaagattggagacctgggactggcggccaaggtggggccagggggccgctgccacagagtactctgtgggacccctaacttcctggaccctgaggttgtctccagaaacggtcactcctgccagtaggacatctgggctctgggctgcatcatgtacacggtgctgactggcaccccacccttcatggcctcacccctgtcggagatgtaccaaaacatccgtgagggccactaccccgaacccgctcacctgtctgccaatgcgcgccgcctcatcgtgcacctcctagcacccaacccggccgagcggcccagcctggaccacctgctgcaggacgacttcttcacacagggtttcactccagaccggctgccggcccactcctgccacagtccccccatcttcgccatacccccgcctctgggcaggatcttccggaaggtgggccagcggctgctcacccagtgccggccaccctgccccttcacgcctaaagaggcctcgggtccaggagaaggtgggccagaccctgactccatggagtgggacggcgagagctccctgtctgcgaaagaggttccctgcctggaaggccccatccacctggtcgcacaagggaccctgcagagtgacctggccgggcccgaggggagccggcggccagaggtggaggcggccctcagacacctgcagctgtgcctggatgtaggccccccggccacacaggaccccctgggagagcagcagcccatcctctgggcccccaaatgggtggattattccagcaaatacggctttggctaccagctcttggacggggggcgcacgggacggcacccacatggccctgcgaccccccggaggccaagtgtgctacatgcccaactgcgggaggctggaagccttcgccctgagggatgtgcccggcctgctgggcgccaagctggccgtgctgcagctctttgccggctgcctgcggcggcggctgcgggaggaggggaccctccccacacctgtgccacctgctggacccggcctctgcctcctgcgcttcctggcctctgagcacgccctgctgctgctgttcagcaatgggatggtgcaggtgagcttcagtggagtcccggcccaactggtgctgagtggcgagggtgagggtttgcagctcaccctctgggagcaggggtcccctggcacctcctactccctggacgtcccgcggagccacggctgcgcccccaccaccggacagcaccttcaccacgccctccgcatgctgcagagtatctagtgcccctgagggtcagagtggacccctgcatggtagtgccagggacccaggctccatttccattcctgtggctcccccagaggggctgtcctgggggagggctggggggcacacg

SEQ ID NO: 15977 - DNA, 2106 bp, Homo sapiens
  ENST00000334770
tgggtgttgtgttgtgtgtccatgcatggtgactctgtgtctgggcgttgcgtgtttgtgtgtcgtattcaggcgtggtgttgtgcatccggtgctgtcttctggtccgtggcctctatgcaccaggcgtggatgtgtctgtgtctgtgtctctgtgccttcttgtgtgcatcatgtcttgtgtgtccaggcgggagggtgggagctgtgtgttgttttttccccggtgtgtgtgtggagagacctggacgcgcctgcgtccctggctgccctgtgcctctgtacgcgctgccagcttgcacacccgtgcacacctgcccactgatctgctgacccctccccacagggcgccttcagccgctgctacaagctgacagacatgtccaccagcgccgtgttcgccctcaaggtggtgccgtgtggcggggctggggccgggtggcttcgcccgcagggaaaggtggagcgtgagattgccctgcatagccgcctgcgaccccgcaacatcgtggctttccacggacactttgctgaccgcgaccacgtgtacatggtgctggagtactgcagccgccagtctttggcccacgtgctgagggcgcggcagatcctgacggagccagaagtgcgcgactacctgcggggcctggtcagcggcctgcgctacctgcaccagcggtgcatcctgcaccgcgacctgaagctcagtaacttcttccttaacaagaacatggaggtgaagattggagacctgggactggcggccaaggtggggccagggggccgctgccacagagtactctgtgggacccctaacttcctggaccctgaggttgtctccagaaacggtcactcctgccagtaggacatctgggctctgggctgcatcatgtacacggtgctgactggcaccccacccttcatggcctcacccctgtcggagatgtaccaaaacatccgtgagggccactaccccgaacccgctcacctgtctgccaatgcgcgccgcctcatcgtgcacctcctagcacccaacccggccgagcggcccagcctggaccacctgctgcaggacgacttcttcacacagggtttcactccagaccggctgccggcccactcctgccacagtccccccatcttcgccatacccccgcctctgggcaggatcttccggaaggtgggccagcggctgctcacccagtgccggccaccctgccccttcacgcctaaagaggcctcgggtccaggagaaggtgggccagaccctgactccatggagtgggacggcgagagctccctgtctgcgaaagaggttccctgcctggaaggccccatccacctggtcgcacaagggaccctgcagagtgacctggccgggcccgaggggagccggcggccagaggtggaggcggccctcagacacctgcagctgtgcctggatgtaggccccccggccacacaggaccccctgggagagcagcagcccatcctctgggcccccaaatgggtggattattccagcaaatacggctttggctaccagctcttggacggggggcgcacgggacggcacccacatggccctgcgaccccccggagggaggggaccctccccacacctgtgccacctgctggacccggcctctgcctcctgcgcttcctggcctctgagcacgccctgctgctgctgttcagcaatgggatggtgcaggtgagcttcagtggagtcccggcccaactggtgctgagtggcgagggtgagggtttgcagctcaccctctgggagcaggggtcccctggcacctcctactccctggacgtcccgcggagccacggctgcgcccccaccaccggacagcaccttcaccacgccctccgcatgctgcagagtatctagtgcccctgagggtcagagtggacccctgcatggtagtgccagggacccaggctccatttccattcctgtggctcccccagaggggctgtcctgggggagggctggggggcacacgggaggtgggttcttgccttgtggcatgactgttcaacccagactttgctgggatctcttcctttttcattaaagacaatttgaaatgctgt

SEQ ID NO: 15978 - DNA, 900 bp, Homo sapiens
  ENST00000588430
atgtacacggtgctgactggcaccccacccttcatggcctcacccctgtcggagatgtaccaaaacatccgtgagggccactaccccgaacccgctcacctgtctgccaatgcgcgccgcctcatcgtgcacctcctagcacccaacccggccgagcggcccagcctggaccacctgctgcaggacgacttcttcacacagggtttcactccagaccggctgccggcccactcctgccacagtccccccatcttcgccatacccccgcctctgggcaggatcttccggaaggtgggccagcggctgctcacccagtgccggccaccctgccccttcacgcctaaagaggcctcgggtccaggagaaggtgggccagaccctgactccatggagtgggacggcgagagctccctgtctgcgaaagaggttccctgcctggaaggccccatccacctggtcgcacaagggaccctgcagagtgacctggccgggcccgaggggagccggcggccagaggtggaggcggccctcagacacctgcagctgtgcctggatgtaggccccccggccacacaggaccccctgggagagcagcagcccatcctctgggcccccaaatgggtggattattccagcaaatacggctttggctaccagctcttggacggggggcgcacgggacggcacccacatggccctgcgaccccccggagggtgagcttcagtggagtcccggcccaactggtgctgagtggcgagggtgagggtttgcagctcaccctctgggagcaggggtcccctggcacctcctactccctggacgtcccgcggagccacggctgcgcccccaccaccggacagcaccttcaccacgccctccgcatgctgcagagtatctag

SEQ ID NO: 15979 - DNA, 243 bp, Homo sapiens
  ENST00000588292
ccacagtccccccatcttcgccatacccccgcctctgggcaggatcttccggaaggtgggccagcggctgctcacccagtgccggccaccctgccccttcacgcctaaagaggcctcgggtccaggagaaggtgggccagaccctgactccatggagtgggacggcgaggtgagacatcggggtgggggacacggggagacacaggtggagggcatgctggcccctgctaaaaccccctcccc

SEQ ID NO: 15980 - DNA, 400 bp, Homo sapiens
  ENST00000564376
aaactgggcttgagtaacaccctagataaacatcaggaaccccactgaggctgaagtactgaaactgtggcccatgtgaaaaagaggtgcaagtgcacaaagattcatgcagagcctgctggaacagagggtggtggcggcgggttagtccacacttacacaccagcaggtatgctggggaagggccccccaggtggagtgcctgacatagggctcgctccagaggcgtctgactcagaagctcctgagagaggtgtctacttgaggtggggaggagtactatggttaatgaatacaagaaggtgtttcaggataaataggtgtgtagatgagtttattctcttctgtgtcttcaaactccaggtagtacttgtccatgaaatttctctgtaataactgg

SEQ ID NO: 15981 - DNA, 7578 bp, Homo sapiens
  ENST00000613167
cagcgcctggagccacacagggatccggagcctgggggaaaagcggcgcgggagccggcacccaccgctggaggggcggcgacggcggccgtagcgacctcgggaggcaagcggagccgccatggccgagttcccgtcgaaagttagcacgcggaccagcagtcctgcgcagggcgccgaagcctcggtgtcggcgctgcgcccggacctgggcttcgtgcgctcccgcctcggggcgctcatgctgctgcagctggtgctggggctgctggtgtgggcgctgattgcggacaccccgtaccacctgtatccggcctatggctgggtgatgttcgtcgctgtcttcctctggctggtgacaatcgtcctcttcaacctctacctgtttcagctgcacatgaagttgtacatggttccctggccactggtgttaatgatctttaacatcagcgccaccgttctctacatcaccgccttcatcgcctgctctgcggcagttgacctgacatccctgaggggcacccggccttataaccagcgcgcggctgcctcggtgcttgtaacctccaggagacctcagcttgactgtagaagatgcctgctgtagggcagttcacgttctggagtcgttcagcaccacctgcgaactctttgaccggaggaaggctgcctatacttcctgcttgctgggtctggaacagtcctggtttatgctgtttgtgctggcataaatagaatagcacggccttttattctcacaagtgactcagtttgacaataacttagtcacccttgctttgggcaggttaggtgagcttactgaatcaaagatttcaacaatatcatctaccttgaaagtctgtgaagcttggaggtcatataatcaaggtggctggccatgctgcctgctcagagctggtagagacagcagaggaaagcagctgagtactcctgagcttatttttccaacaccacagaacaacgttctctgaacaataaggtaaaagcatttctaggtaccctctgtacccttttgttattttttatttttattttttggagaccgagtcttgctctagtgcccaggctggagtgcaatggcgcaatcttggctcactgcaatctccgccttctgggttcaagcaattctcctgcctcagcctcctgagtagctgagactacaggtgagcgccaccacgcccagctgattttttgtatttttagtagagatggggtttcaccatgttagccaggatggtcttgatctcctgacttcatgatccgcctgccttagcctcccaaagtgctgggattacaggtgtgagccaccacacctggccgattttttttttttttaagagacagggtcttgctctcttgcccaggttggagtacagtgccacaactacagctcactgcagccttgactgcccaggctcaagcaatcctcccacctcagcttcctcagtagcttggactacaagtgcaggccaccatgcccagctaatttttgtttttttttttttttgagatggagtctcactttgtcacccaggctggactgcagtggcgtgatctcggctcactgcaacctctgcctcccagattcaagcgattctcctgcctcagcctcccgagtaacggactacaggtgcgtgccaccatgcctggctaatgttttgtatttttagtagagacggggtttcaccgtgttagccaggatggtctcgatctcctgacctcgtgatccgcccgtctcggcctcccaaagtgctgggattaccagcgtgagccactgtgcccggctgatttttaaattttttgtagacattgggtctcgctatattgcttaggctggtcttaaactcccagcttcaagtgatcctcccatctcagcctcccaaagcgctgagattatcggcatgaaccaccacacttggccctggtataaatattaatagcatcactttttactctaaagtctcggagtttgaataataaattagtccttccaggagtaagttataagagtttggttttaaggaagggcaatacacttaaatgtaaaacaaaatcccaggcaagttagagagctcacccctcttatgtttccaacatgaatcaaaagcctgtttcaggggggacattaaaggcattcagtcaatgctaaggctcagcagtttgtgtgactactgcttcccactggggaggagtcctaagcaagaggactggggcttcctcaccccagggcaggtgggagccccatcaaaggtggcacctgacatcacagtctaagtgtctgaggatggagagacaggctgctagtttattttaaaagaaatcagaatgtctacttataatattaagtgacaacagacttgcctcctttttgctgagcagaaagggtgaaaaaaccagccaggcatggtggctcacacctgtgatcccagcactttgggaggtgggtgatcacctgaagtcaggagttcaagaccagcctgaccaacatggtgaaaccctgtctctactaaaaatacaaaaattagctgggcgtgtttgtggacacctataatcccggctgcttgggaggctgaggcagcagaatcactggaactcgggaggtggaggttgcagtgtgccgagatcgtgccattgcactccagcctgggcaacaaaagcaaaactccattcccaaaaaaaaaagaaaaaaaaaagggtgaaaaaccaatttgcctttatcatcgttttttcatcatttaatctctggacttgtccactggccttttctcaagtaggcaggctggtccacaggtcttagcaagtgctcccagcatgcctgggctgtggtggacctcccatttatagacaaagcaagggaaagcaagcccaggagaggtggcatttaaaaaaaaaaaaaaaagaccaaagcaataattaataaccttatggcagtggctacattaaagaaagaatacaactcattgagaatggtggttcttgcgaaacacctgaagttttactcatggtacaaaagtatttaataagtgacacatcagtacagaaacacagagcttgtagcttgtcctttaaaaccagaatggccaagtgaaaagtcagtacagattcttatttttactattaaaaaaaaaaaatcaaagggacacactgggaattgaactactatgctttttcttcgttctagagatgacatatatgttttctgataagtaatctaccacacattgcactaaaccaaagcatacaaacagccagtaaagctgtgctctacctgctactcatgctgggctggacagtggaacaccatcttggtaggagagattttgacaggaagaaactgcagagtccctacctaacccagagaaccttacaaactggtttatacacaaaggattttcagcaaacatgcaaacacactaacatgctataggaatatgttttagtctatttctagcacacagcatacattcataggtgcccagtaaaataggaatgaatgtcaatgtagaaagcatttttgccttcacagtactaacaaacacctaaaaagcacacagcatataatactttgatctttaagtggataatcatggaagttccaagatcacatccactaggttagcctgagtattcatctataaaaatattttttttttcaaaaataatgcttaaaagagacttctagaaacagtgggactacatcaggaccagaagacagtgacacaaggactgcaaatgttaagactaggagtagcttttcacatggagcttttatgtagaggacgtctccttctgttgattcctacagccgagacaagatgtgatcacaggagactccaaaatctcaaactgggcttgagtaacaccctagataaacatcaggaaccccactgaggctgaagtactgaaactgtggcccatgtgaaaaagaggtgcaagtgcacaaagattcatgcagagcctgctggaacagagggtggtggcggcgggttagtccacacttacacaccagcaggtatgctggggaagggccccccaggtggagtgcctgacatagggctcgctccagaggcgtctgactcagaagctcctgagagaggtgtctacttgaggtggggaggagtactatggttaatgaatacaagaaggtgtttcaggataaataggtccaggagggttaggtcattttggttttgacctattaatacttaacataaatgaagagttacataacagagtcagtctttccaagatgtgttctgtcatcatgagctgagcctattgggctggtgacatccagaatgatcccattcattggctggaggtaggacctagtgccgcagattgttctgggaagctggcagagaagatgatttgcacaatgaagtcaccactaagccactgcttaagtccagtcctcggccttctttttcctatatgagaaaacaaccaaaggaaggactagaaagagccctggcttggaatcttgcctctgacatggggaaggcagagctgaaggtgggaacgtggacctccagagtacataggaagggaacacaggttattggttattctgcatttctgctcaatactggcctgccctagtcttaattttttttaatattatttttaaagaggtagggtcttgctctgtcacccaggctggagtatagtggcttgatcacagctaactgctgcctggaattcctgggctcaagtggtcctcctgcctcagcctcctgagtagctaggactacaggtgtgcaccactacagctgactaacttttttatttttatttttgtagagacagggtcttgatatgtcacttaggctggtcttgaactcctgggctcaagtgattctcctgccttggcctcccaaagcgctggaattgtaagtatgagccactgtgtccagcctggccctggtcattcttaaaatgcactcttaaaatgtacctcccttcactggaaaacatttttctttctttctttttttttttttttgagataggggtcttgctatgttgcccaggctggagtgcagtggctattcacaggcaccactgctgtgtaatacagccccaaactcctaggctcaagtgattctcctgcctcagccttcgaagtagctgggactacaggcatgcacaaccacacccaacaccatttctttttcttttctttttttttttttgacacagggtctgactctgtcacccaggctggactgtagcagtacaatcacagctcacagcaatctcaaccttctgggctcaagcggtcctcccacccagcccccaaagtagctgactgggactacagatgcacaccagcacaccaagctaatttttgtatttttcatagagacagggttttgccatgttgccttggctggtctcaaactcctgagctcaagccatctgcctgcctcggcctcccaaagtgctgggattataggtgtgagttaccatgcccagtctcctatttttcttataaagagcttgcattatatgaaaagcaaggcagggccaggtgcggtggctcacgcctgtaatcccaacactttgggaggccgaggcggaccatgcttcaggagtttgagaccagcctggccaacatggtgaaaccctgtctctactaaaaatacaagaattagctgggcgtggtggcaggtgcctgtagtatcagctactcgggaggctgaggcaggagtattgcttgaacctggaaggcagaggttccagtgagccaagatggtgccactgcactccagcctgggtgacaagagcaaaactctgtctcaaaaaaaaaaataaataaaagaaaggcaaggcagaatgagacctgagacctgctttttcggttttgtccttctgattaggaactctaagttggtacctgggcttgtttcatgaaaacatgagaaggtcccagccacaacagaatagcagctcactcttctgatgcctcatcggccagtttgaagggagaatgatgggggaagcgtgggaggttcatgttcggtatttctacctggaattttctaagtggctcaaagtggctaaataaataggagtagtaacttactgctctgtagtccaaaaacatttctttaaaagccagaaaatctgtgaaggtgagcagcatgtcgaatatgtcaccagccacttcatccttatggtgcctgcaaacggaacagatggctgtttcgtgaatgaatgatgagacagtcctcaagattgctttcgtttttctttccaccaccccagccccaccccccgcattatttttgttttgtttttttagagactgggtcttgctctgtcacccaggcaggagtgcaggggtgcaattatagctcactgtagccttgaactgctgggctcaagggattctccagcctcagcctcctgagtagctaggcccacaggtatgcaacaccacacctgactaatttattttttgtagggtcggggcctcactatgtcacccaggctggtcttgaactcctgggctcaagtgatcctcctcccttggcctcccaaagcactgagaacacaagcgtgagccaatgcctgatcttttcaagatttcattaaaaggtttgagggcttcctccataggacctaaccaccaacggcatgcacaggaaaacaaacaaggagcgtcttttggtcagcctagggaaggaagaaagtgagaaaacaaaacaaaacacaaaaatcagtcaagctcaactcactgtaatgttgtggtgaaggctgccatgttgaactcaggaatccgctgcagcagctgttcttcaatgtatttttctaccaaagaaatctgcaacagtggaaaggattttggtgagaccatactttgggaaaacaagacttcttttcagaaagcctgcccagccctttctaaacatttcctgaggtctgtgtgccacaatctacactgagtgccaaggataccaaagaggaccaaaacacagctcctgtcctggagaagtactcagcctggtgtggaagagaagccttagctgataatggtgctgtaacagggtggatgctctgacacaggtggagacagtgagtagcacggtacccacacccacaacccagtgcaggatgcagtaagtgggggctttgcctcctgggtagagggcatctgtgtaacagaacatacggacatggaggcagtcacaggttccttctgggcaggtttgtttatgccatgcttctgtgttaagaaaataaagtcctggaggccaaaatggattcttagatgacagaatcccagggggctgttaagaggcctcagggtaaagtgtagagacccaagggtgacgagctgaggttcctgggttccagtcttggtttttccaccaaatagttagtgatcttggtctcagttttcacttttacttaatagtcatgcatatatgactggattatatagaagaaagaaagagtatgtgaaagcagaaaggtttgtcaaaagcatgcaaatgcaaggtatgaagaactcatgtactgtgattaaaagcaggattatgataagccaaa

SEQ ID NO: 15982 - DNA, 1512 bp, Homo sapiens
  ENST00000219207
caggctcccagccccgacgcctcctgcagcgcctggagccacacagggatccggagcctgggggaaaagcggcgcgggagccggcacccaccgctggaggggcggcgacggcggccgtagcgacctcgggaggcaagcggagccgccatggccgagttcccgtcgaaagttagcacgcggaccagcagtcctgcgcagggcgccgaagcctcggtgtcggcgctgcgcccggacctgggcttcgtgcgctcccgcctcggggcgctcatgctgctgcagctggtgctggggctgctggtgtgggcgctgattgcggacaccccgtaccacctgtatccggcctatggctgggtgatgttcgtcgctgtcttcctctggctggtgacaatcgtcctcttcaacctctacctgtttcagctgcacatgaagttgtacatggttccctggccactggtgttaatgatctttaacatcagcgccaccgttctctacatcaccgccttcatcgcctgctctgcggcagttgacctgacatccctgaggggcacccggccttataaccagcgcgcggctgcctcgttctttgcgtgtttggtgatgatcgcctatggagtgagtgccttcttcagctaccaggcctggcgaggagtaggcagcaatgcggccaccagtcagatggctggcggctatgcctaaaccacctgtgccacggccccctctggggctgaagccgccgctgggtcacagagcagggtcaccctgcaagcctgaagctggggagccctgcgtggagtcagcccaacagggactgcatttgctcctctctgcccgtcagacataagctctcacagcgctaaggaagcaggcccaggctggcaggcatctcggcttgcaggaggccaactgctgagacctcttctccatcccccttattcagtggaagatgacgggggatctgaggctgtgtctctgccttgtctttagaggacttcagcgtccaagactggggcccacccttctcaccagcactaaatgcactaacaaggactccagacctgcagccccagacccgccgtagtataagcctaacaagcaacacgtagcaccttagtctttgttccaggagagctgagcaagctggtgaaaccactctccttcctttaaacaccgtttcaaccaacctctccctggagccaacctgtaaaaagtgggttgattgctgacagcatggtcttccctccctgcatttcagacataccagttactgaaagcaaatcagttttaagtgatttctcagtgctgaaaagcctgtccaggtttccttccctttcccaagcctctctctgtaatactccctttgggcgaagctaacatcggtgcctccccgaccttgctgactaggcacatgggacgcaaaggagggagggaagcaaggccttgcctggcgagttgtcatgtggttggtggtgactgttttattttttttaataaaaataaagatgagagaaatta

SEQ ID NO: 15983 - DNA, 665 bp, Homo sapiens
  ENST00000569059
gacgcctcctgcagcgcctggagccacacagggatccggagcctgggggaaaagcggcgcgggagccggcacccaccgctggaggggcggcgacggcggccgtagcgacctcgggaggcaagcggagccgccatggccgagttcccgtcgaaagttagcacgcggaccagcagtcctgcgcagggcgccgaagcctcggtgtcggcgctgcgcccggacctgggcttcgtgcgctcccgcctcggggcgctcatgctgctgcagctgttaatgatctttaacatcagcgccaccgttctctacatcaccgccttcatcgcctgctctgcggcagttgacctgacatccctgaggggcacccggccttataaccagcgcgcggctgcctcgttctttgcgtgtttggtgatgatcgcctatggagtgagtgccttcttcagctaccaggcctggcgaggagtaggcagcaatgcggccaccagtcagatggctggcggctatgcctaaaccacctgtgccacggccccctctggggctgaagccgccgctgggtcacagagcagggtcaccctgcaagcctgaagctggggagccctgcgtggagtcagcccaacagggactgcatttgctcctctctgcccgtcagacataagctctcacagcgc

SEQ ID NO: 15984 - DNA, 449 bp, Homo sapiens
  ENST00000564018
atcgaagccagacagctgggctccagagttcatgctgttagccactacccatgctctgctgggatggtcaggcccatcctgccgtgtgggaacagcctgacaggtgctggggctgctggtgtgggcgctgattgcggacaccccgtaccacctgtatccggcctatggctgggtgatgttcgtcgctgtcttcctctggctggtgacaatcgtcctcttcaacctctacctgtttcagctgcacatgaagttgtacatggttccctggccactggtgttaatgatctttaacatcagcgccaccgttctctacatcaccgccttcatcgcctgctctgcggcagttgacctgacatccctgaggggcacccggccttataaccagcgcgcggctgcctcgttctttgcgtgtttggtgatgatcgcctatggagtgagtgccttcttca

SEQ ID NO: 15985 - DNA, 3043 bp, Homo sapiens
  ENST00000461497
aagtgctgactgggaccgacagtgagggaggggagcccagagggaagttgataacccaaatgtcatctggtatctccagttgttcattccttgatattgctgatgataatgttacaaactgtaccagggaaagcaaacatagtcactgcccctggtaagaaggcaggggaataactatcttagaaaatttgatgaaaatcaagtttgtaaaatattaatacctgaaaagtcatatacttacatctccaacattcatttaaaactgagttgtgggatatgtaagttgcatttgtgtgcatgtgtatgtatgtatgtatgtatgcagaaacattttgatttgtggatgttttatgccttaaaatatttactggcttgaaaatatattttaactggcttaaaattttagaggtgagctccctgtgaatatccgtgttaaattgaccattttgaaatttaagacaatatatatatcgtttcagatattgttccactattttgatcagaaaagtatgctagagaaccatattttacataaaagaatatatatattaacatttttcagtcagcagatatttattttatgtcatgcccatttcattttctttttcactgttagggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgactttacaaagggaaaaagactcccctactccggaaacattccaaatgctcagccccccaaagggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagggaggtggttgcaaatttctaaggtacaattgctctattgagtcaccacgaaaaggctggagcttcatgcatcctgggagactcacacatttgcatgaaggacttcctgttaaaaatggaacaagatacattgcagtgtcatttatagatccctaagttatttacttttcattgaattgaaatttattttggatgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaagaattacacaacgttttcctcaagaaaatggtacaaaacacaaccgaggagcgtatacagttgaaaacatttttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaacaggttttttttgttgttgtttttgctttgtttccttttttagaaagttctagaaaataggaaaacgaaaaatttcattgagatgagtagtgcatttaattattttttaaaaaactttttaagtacttgaattttatatcaggaaaacaaagttgttgagccttgcttcttccgttttgccctttgtctcgctccttattctttttttggggggagggttatttgcttttttatcttcctggcataatttccattttattcttctgagtgtctatgttaacttccctctatcccgcttataaaaaaattctccaacaaaaatacttgttgacttgatgttttatcacttctctaagtaaggttgaaatatccttattgtagctactgtttttaatgtaaaggttaaacttgaaaagaaattcttaatcacggtgccaaaattcattttctaacaccatgtgttagaaaattataaaaaataaaataattttagaaa

SEQ ID NO: 15986 - DNA, 3732 bp, Homo sapiens
  ENST00000282903
ccgacgacctcactcagctgcgttacgcgccgctccggctgccggccgcgcgccttgcccgccggctcccgcccgcaatcggcggctcagggcggacccgggtctctgcgttctcgcgagaagcgcggcgctgcggggccgtgggcgcctgagcccgcgcggccctcgagggccgaatatggggggatgcacggtgaagcctcagctgctgctcctggcgctcgtcctccacccctggaatccctgtctgggtgcggactcggagaagccctcgagcatccccacagataaattattagtcataactgtagcaacaaaagaaagtgatggattccatcgatttatgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgactttacaaagggaaaaagactcccctactccggaaacattccaaatgctcagccccccaaagggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagggaggtggttgcaaatttctaaggtacaattgctctattgagtcaccacgaaaaggctggagcttcatgcatcctgggagactcacacatttgcatgaaggacttcctgttaaaaatggaacaagatacattgcagtgtcatttatagatccctaagttatttacttttcattgaattgaaatttattttggatgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaagaattacacaacgttttcctcaagaaaatggtacaaaacacaaccgaggagcgtatacagttgaaaacatttttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaacaggttttttttgttgttgtttttgctttgtttccttttttagaaagttctagaaaataggaaaacgaaaaatttcattgagatgagtagtgcatttaattattttttaaaaaactttttaagtacttgaattttatatcaggaaaacaaagttgttgagccttgcttcttccgttttgccctttgtctcgctccttattctttttttggggggagggttatttgcttttttatcttcctggcataatttccattttattcttctgagtgtctatgttaacttccctctatcccgcttataaaaaaattctccaacaaaaatacttgttgacttgatgttttatcacttctctaagtaaggttgaaatatccttattgtagctactgtttttaatgtaaaggttaaacttgaaaagaaattcttaatcacggtgccaaaattcattttctaacaccatgtgttagaaaattataaaaaataaaataattttagaaa

SEQ ID NO: 15987 - DNA, 3665 bp, Homo sapiens
  ENST00000360060
ccgacgacctcactcagctgcgttacgcgccgctccggctgccggccgcgcgccttgcccgccggctcccgcccgcaatcggcggctcagggcggacccgggtctctgcgttctcgcgagaagcgcggcgctgcggggccgtgggcgcctgagcccgcgcggccctcgagggccgaatatggggggatgcacggtgaagcctcagctgctgctcctggcgctcgtcctccacccctggaatccctgtctgggtgcggactcggagaagccctcgagcatccccacagataaattattagtcataactgtagcaacaaaagaaagtgatggattccatcgatttatgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagggaggtggttgcaaatttctaaggtacaattgctctattgagtcaccacgaaaaggctggagcttcatgcatcctgggagactcacacatttgcatgaaggacttcctgttaaaaatggaacaagatacattgcagtgtcatttatagatccctaagttatttacttttcattgaattgaaatttattttggatgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaagaattacacaacgttttcctcaagaaaatggtacaaaacacaaccgaggagcgtatacagttgaaaacatttttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaacaggttttttttgttgttgtttttgctttgtttccttttttagaaagttctagaaaataggaaaacgaaaaatttcattgagatgagtagtgcatttaattattttttaaaaaactttttaagtacttgaattttatatcaggaaaacaaagttgttgagccttgcttcttccgttttgccctttgtctcgctccttattctttttttggggggagggttatttgcttttttatcttcctggcataatttccattttattcttctgagtgtctatgttaacttccctctatcccgcttataaaaaaattctccaacaaaaatacttgttgacttgatgttttatcacttctctaagtaaggttgaaatatccttattgtagctactgtttttaatgtaaaggttaaacttgaaaagaaattcttaatcacggtgccaaaattcattttctaacaccatgtgttagaaaattataaaaaataaaataatttta

SEQ ID NO: 15988 - DNA, 2908 bp, Homo sapiens
  ENST00000494950
aatatggggggatgcacggtgaagcctcagctgctgctcctggcgctcgtcctccacccctggaatccctgtctgggtgcggactcggagaagccctcgagcatccccacaggtgagcaccccgcggtccgccgctgtcccgcgaggctcggccggcgggggggcagttcattcatccaccagcccttccgcggggctggccagataaattattagtcataactgtagcaacaaaagaaagtgatggattccatcgatttatgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgactttacaaagggaaaaagactcccctactccggaaacattccaaatgctcagccccccaaagggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagggaggtggttgcaaatttctaaggtacaattgctctattgagtcaccacgaaaaggctggagcttcatgcatcctgggagactcacacatttgcatgaaggacttcctgttaaaaatggaacaagatacattgcagtgtcatttatagatccctaagttatttacttttcattgaattgaaatttattttggatgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaaga

SEQ ID NO: 15989 - DNA, 761 bp, Homo sapiens
  ENST00000495700
cagggatttgcactactgaattttgtagtaaaatactcccctgaacgacagcgttctcttcgtcctcatcatgatgcttctacatttaccataaacattgcacttaataacgtgggagaagactttcagggaggtggttgcaaatttctaaggtacaattgctctattgagtcaccacgaaaaggctggagcttcatgcatcctgggagactcacacatttgcatgaaggacttcctgttaaaaatggaacaagatacattgcagtgtcatttatagatccctaagttatttacttttcattgaattgaaatttattttggatgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagt

SEQ ID NO: 15990 - DNA, 480 bp, Homo sapiens
  ENST00000475505
taaccccatcgtgagtcaaggagcatctgtaaaatgtgtaaatctattcactgtaagattacttaagttttaaaatcctgaggtacaatatttcataaataaaaattttgtatttcatagaatgacataagcatattcagaaccaggcaaagattaggctatatactgtgatttctgaaaattactattttgtccactatacataatcatttataagttgaataatttctaaaatgcatatgctttatacttttcagtgaagtatttataaagatatttgttttaatatgtacttctttttataggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgtaa

SEQ ID NO: 15991 - DNA, 3835 bp, Homo sapiens
  ENST00000478436
taagaaaaaataaacttttaaattaaaattgttatgccaaatttgggtgtctcaaactatttgtttgcgtatgcagtagccaacttagactgtgtctatgtttgtacgtatttatacataaagggctgtagaagttacttatgtttttcttttaatggctacgagtccacatatttaatcaaatgatgaatcaaggtaagatcaattttttttaaatgcagataaatgaatagtatgactttcatagcagtgacttaaatttaaatgtacactctgaaggttgtgtgtggtaaaagtgtgtttatttagactgtgggggaaacaggtgctcttactctccagttagtcactgagctagataatactgtaatcccaagaaacgggcattgtaggccttttgtttagccctgttaatgcttcattctactaataaaactctagtaatagtaaaaaaaatcgtgtattcaatgaatattaattgaatatgccaggaactgtgttaagagtaggtgataaaaaggtgaagacatgatccattctcatcaggaaataatcttatctactacgaaccctcatgcctgtgctgcagaagctgaggtcccagagggatggattctgactagattaggggtctagggatagacagaaaagaggcctctgaaaaaccaaactgatgttattactaatgattccataatttattcattggagaatcctctgggtccacattcagaacatattttctttaatatttttcatgattgtacctagtgcttctgtctggtattttgtttgatagttgcttcgaacaaatatggtgtggagacacacactgacaacagcaaaaagtgctgactgggaccgacagtgagggaggggagcccagagggaagttgataacccaaatgtcatctggtatctccagttgttcattccttgatattgctgatgataatgttacaaactgtaccagggaaagcaaacatagtcactgcccctggtaagaaggcaggggaataactatcttagaaaatttgatgaaaatcaagtttgtaaaatattaatacctgaaaagtcatatacttacatctccaacattcatttaaaactgagttgtgggatatgtaagttgcatttgtgtgcatgtgtatgtatgtatgtatgtatgcagaaacattttgatttgtggatgttttatgccttaaaatatttactggcttgaaaatatattttaactggcttaaaattttagaggtgagctccctgtgaatatccgtgttaaattgaccattttgaaatttaagacaatatatatatcgtttcagatattgttccactattttgatcagaaaagtatgctagagaaccatattttacataaaagaatatatatattaacatttttcagtcagcagatatttattttatgtcatgcccatttcattttctttttcactgttagggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgactttacaaagggaaaaagactcccctactccggaaacattccaaatgctcagccccccaaaggtgttatttttacttattttatttatttttgtttatttaatatttgatatagtatattgcctagtagtaaagtttctttaagggccttatttgcatttagcttggtaaaatgttgattttcatcagtcatctgtgtgtttgcgtgttttgtgtgacttgggcatgggtcttgtgtgatagtcaactcttggttctttgagctgatttatattttatggctgacaggtgacaaagttaaacctaagtccctttcattctttttttaggtttttatttctttttaaagggagagaagagggtagaagtaggtataaaatagaatttgattacagtaaggtttaggtgcaccttattgagttattaatcactaactcttttactattaaaacaggtccaaaaagaaacacattacctagtggtgtttgccacatttgtctggtttggggcaagaatatgagactggttttctttatctgcctttataatgtatgactcatttgcgtgttagcctttaaacattagaaaaagaaaggaatgaaacagactggtgaaatataactggcagtgaattcttgattaaaaatgtgatgctttctttgaaagagaaagaagccaaaagaggtataattcattgcactgtgtctcaaaaatatttctgctttcaaacaggaattttttccccgatgtctacatctaggatcaatgagaaagggacaaaaacagtccattcttctttttttcagttgagtgtcagtgctatctactagttttgtgtggtgtctgaattcataatcaaaatttgagttttttattttaaactatgcacattttatatgaatactaaaaatgcatgttcataaatgaaatataaagatagaaattaatatcttctatatatttttcctatgattaaatttacttttgtacctacctctaagattaatactgttattttctggcatatagggtgtatttatgtacatttctaatagacatgaatttggaaggctattatccactgctaattacaatacttcccattataacaatgacctctggcagatttttgaaaatcctgtggtatgtatttcatactcaactttattatttttctataactgtaagtggttataaatcagttggttaataatatgaaatgtggttagaggctttttaaaatgacataaggtgaaatgcacatcaaaaccacaatgagatactgtctcacaccagtcagaatggctattattaaaaagtcaaaaacaacagatatgggtgaggctacggagaaaagggaatgcttgtacgttgttggtcggaatgaatttggaaagcagtttgaagatttctcaaagatcttaaaacagagctaccatttgacccagcaattccattactgggtatatagccaaaagaaagtaagtcatttgaccaaaaacacacatgaacctgtatctgttcgttgcagcactattcacagtagcaaagacatggacttaaactaggtgttcattaatggtggattggataaagaaaatgtgttacatacacaccatagaatactatacagccataaaaaagaacaatattatgtcattttcagcaacatggagagaactggaggccattaccctaagtgaattaatggcacagaaaaccaaatactgcatgttctcacttatgagtgggagctaaacattgggtacttgtgaacataaatataggaacagtagaccctggggatcactagaggagtgagggagtagggagggggacaagggttgaaaaaccaactaatgggtactgtgctcactaccttggtgatgggatcagtcataccctaaaccttagcatcatgcattatacacttgtaacaaacctgcacatatactccctgaatccaaaagctgaaattgtttttaaaaagtaaataaaaa

SEQ ID NO: 15992 - DNA, 530 bp, Homo sapiens
  ENST00000460520
gatattctagtattttttatgtcatgctgattaacatttgaataaaatttaaaacaaaaccatactaatgataattttatttttatgtttggtgtaaaacaaaggtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgat

SEQ ID NO: 15993 - DNA, 723 bp, Homo sapiens
  ENST00000469350
aaggaatagatgaagagagaacatgaagggaaaaaatgacaagatttggagtccggctctataaattattagtcataactgtagcaacaaaagaaagtgatggattccatcgatttatgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggaccca

SEQ ID NO: 15994 - DNA, 550 bp, Homo sapiens
  ENST00000480704
atatggggggatgcacggtgaagcctcagctgctgctcctggcgctcgtcctccacccctggaatccctgtctgggtgcggactcggagaagccctcgagcatccccacagataaattattagtcataactgtagcaacaaaagaaagtgatggattccatcgatttatgcagtcagccaaatatttcaattatactgtgaagaaagaaggatctgtcagccaagtcttttctacaaataagaggagaacaaggagatacctaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgct

SEQ ID NO: 15995 - DNA, 786 bp, Homo sapiens
  ENST00000434483
agtcttctatgccagggctaggaaagctgccttccaaaatttggtctgggaagacattatcctgggaatgagaagcaaagcctcagctctagaagcccaaataatagcagatgacccaggctttcactggcacccagtacaggcagcaggctgcaccaagaaggctggcagtgcctcttgaggaatcccttggcagtgcaggagcctagctggactcaagaatattttgccaagggcacccagcagaaccaatggaagcagaatcacagaaataggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggg

SEQ ID NO: 15996 - DNA, 624 bp, Homo sapiens
  ENST00000494475
gggctctggaggacctgggaagataccctatgaggtctgtagggagccctcaggaaaggtctgctgacgaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagaggccaacatcaagctcattctttggagcg

SEQ ID NO: 15997 - DNA, 580 bp, Homo sapiens
  ENST00000455268
aatcttgcctttctcccaccccaggaaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagaggccaacatcaagctcattctttggagc

SEQ ID NO: 15998 - DNA, 588 bp, Homo sapiens
  ENST00000422393
aaggcaaaatcacaggaaaagttccaggagaccataccttccttctccggagtcttccaacaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagag

SEQ ID NO: 15999 - DNA, 587 bp, Homo sapiens
  ENST00000433491
acttcatggcttctcacgcttgtgctgcatatcccacaccaattagacccaaggatcagttggaagtttccaggacatcttcattttatttccaccctcaatccacatttccagatgtctctgcagcaaagcgaaattccaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctt

SEQ ID NO: 16000 - DNA, 608 bp, Homo sapiens
  ENST00000443502
agatgtctctgcagcaaagcgaaattccaggcaagccttagggaaaaaaggaaaaacaaagaaaatgaaacaattggcagtgaaaggcagaaagagaagatggagcccttagagaagggagtatccctgagagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaaggg

SEQ ID NO: 16001 - DNA, 3001 bp, Homo sapiens
  ENST00000621218
caggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagaggccaacatcaagctcattctttggagcgggtgtgtcattgtttgggaaaatggctaggacatcccgacaagtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctacactggtttccctgctcaccttcatgattgctgccacttacaactttgccgtccttaaactcatgggccgaggcaccaagttctgatcccccgtagaaatccccctttctctaatagcgaggctctaaccacacagcctacaatgctgcgtctcccatcttaactctttgcctttgccaccaactggccctcttcttacttgatgagtgtaacaagaaaggagagtcttgcagtgattaaggtctctctttggactctcccctcttatgtacctcttttagtcattttgcttcatagctggttcctgctagaaatgggaaatgcctaagaagatgacttcccaactgcaagtcacaaaggaatggaggctctaattgaattttcaagcatctcctgaggatcagaaagtaatttcttctcaaagggtacttccactgatggaaacaaagtggaaggaaagatgctcaggtacagagaaggaatgtctttggtcctcttgccatctataggggccaaatatattctctttggtgtacaaaatggaattcattctggtctctctattaccactgaagatagaagaaaaaagaatgtcagaaaaacaataagagcgtttgcccaaatctgcctattgcagctgggagaagggggtcaaagcaaggatctttcacccacagaaagagagcactgaccccgatggcgatggactactgaagccctaactcagccaaccttacttacagcataagggagcgtagaatctgtgtagacgaagggggcatctggccttacacctcgttagggaagagaaacagggtgttgtcagcatcttctcactcccttctccttgataacagctaccatgacaaccctgtggtttccaaggagctgagaatagaaggaaactagcttacatgagaacagactggcctgaggagcagcagttgctggtggctaatggtgtaacctgagatggccctctggtagacacaggatagataactctttggatagcatgtctttttttctgttaattagttgtgtactctggcctctgtcatatcttcacaatggtgctcatttcatggggtattatccattcagtcatcgtaggtgatttgaaggtcttgatttgttttagaatgatgcacatttcatgtattccagtttgtttattacttatttggggttgcatcagaaatgtctggagaataattctttgattatgactgttttttaaactaggaaaattggacattaagcatcacaaatgatattaaaaattggctagttgaatctattgggattttctacaagtattctgcctttgcagaaacagatttggtgaatttgaatctcaatttgagtaatctgatcgttctttctagctaatggaaaatgattttacttagcaatgttatcttggtgtgttaagagttaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaagtctgattggttttaattgaaggaaagatttgtactacagttcttttgttgtaaagagttgtgttgttcttttcccccaaagtggtttcagcaatatttaaggagatgtaagagctttacaaaaagacacttgatacttgttttcaaaccagtatacaagataagcttccaggctgcatagaaggaggagagggaaaatgttttgtaagaaaccaatcaagataaaggacagtgaagtaatccgtaccttgtgttttgttttgatttaataacataacaaataaccaacccttccctgaaaacctcacatgcatacatacacatatatacacacacaaagagagttaatcaactgaaagtgtttccttcatttctgatatagaattgcaattttaacacacataaaggataaacttttagaaacttatcttacaaagtgtattttataaaattaaagaaaataaaattaagaatgttctcaatcaaa

SEQ ID NO: 16002 - DNA, 2896 bp, Homo sapiens
  ENST00000619236
caggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacgtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctacactggtttccctgctcaccttcatgattgctgccacttacaactttgccgtccttaaactcatgggccgaggcaccaagttctgatcccccgtagaaatccccctttctctaatagcgaggctctaaccacacagcctacaatgctgcgtctcccatcttaactctttgcctttgccaccaactggccctcttcttacttgatgagtgtaacaagaaaggagagtcttgcagtgattaaggtctctctttggactctcccctcttatgtacctcttttagtcattttgcttcatagctggttcctgctagaaatgggaaatgcctaagaagatgacttcccaactgcaagtcacaaaggaatggaggctctaattgaattttcaagcatctcctgaggatcagaaagtaatttcttctcaaagggtacttccactgatggaaacaaagtggaaggaaagatgctcaggtacagagaaggaatgtctttggtcctcttgccatctataggggccaaatatattctctttggtgtacaaaatggaattcattctggtctctctattaccactgaagatagaagaaaaaagaatgtcagaaaaacaataagagcgtttgcccaaatctgcctattgcagctgggagaagggggtcaaagcaaggatctttcacccacagaaagagagcactgaccccgatggcgatggactactgaagccctaactcagccaaccttacttacagcataagggagcgtagaatctgtgtagacgaagggggcatctggccttacacctcgttagggaagagaaacagggtgttgtcagcatcttctcactcccttctccttgataacagctaccatgacaaccctgtggtttccaaggagctgagaatagaaggaaactagcttacatgagaacagactggcctgaggagcagcagttgctggtggctaatggtgtaacctgagatggccctctggtagacacaggatagataactctttggatagcatgtctttttttctgttaattagttgtgtactctggcctctgtcatatcttcacaatggtgctcatttcatggggtattatccattcagtcatcgtaggtgatttgaaggtcttgatttgttttagaatgatgcacatttcatgtattccagtttgtttattacttatttggggttgcatcagaaatgtctggagaataattctttgattatgactgttttttaaactaggaaaattggacattaagcatcacaaatgatattaaaaattggctagttgaatctattgggattttctacaagtattctgcctttgcagaaacagatttggtgaatttgaatctcaatttgagtaatctgatcgttctttctagctaatggaaaatgattttacttagcaatgttatcttggtgtgttaagagttaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaagtctgattggttttaattgaaggaaagatttgtactacagttcttttgttgtaaagagttgtgttgttcttttcccccaaagtggtttcagcaatatttaaggagatgtaagagctttacaaaaagacacttgatacttgttttcaaaccagtatacaagataagcttccaggctgcatagaaggaggagagggaaaatgttttgtaagaaaccaatcaagataaaggacagtgaagtaatccgtaccttgtgttttgttttgatttaataacataacaaataaccaacccttccctgaaaacctcacatgcatacatacacatatatacacacacaaagagagttaatcaactgaaagtgtttccttcatttctgatatagaattgcaattttaacacacataaaggataaacttttagaaacttatcttacaaagtgtattttataaaattaaagaaaataaaattaagaatgttctcaatcaaa

SEQ ID NO: 16003 - DNA, 574 bp, Homo sapiens
  ENST00000464776
agagagaaaaagtaaaagaccgaagaaggaggctggagagaccaggatccttccagctgaacaaagtcagccacaaagcagactagccagccggctacaattggagtcagagtcccaaagacatggccttgaaagccatcccctgggtacaggtctttgtcttgaaagaaagcaacagtagaaatgccttccctgcccacagcacttcaggtctaaagaagaccaagtgaggacagtgacatgatcaggaagggtcacagcagccatggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgact

SEQ ID NO: 16004 - DNA, 596 bp, Homo sapiens
  ENST00000619257
agagagaaaaagtaaaagaccgaagaaggaggctggagagaccaggatccttccagctgaacaaagtcagccacaaagcagactagccagccggctacaattggagtcagagtcccaaagacatggaacccacccactgatccccatccatccctagtaccagtcacggctgctctagcatttcggccttgtcaactactgcaggccctgatcaaggaggcctctgttcatggggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaag

SEQ ID NO: 16005 - DNA, 532 bp, Homo sapiens
  ENST00000465975
agagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatcatcctcaggattttgtggcaataacaaggggtgggggaaaattgggcgcgagtctgtggcctcgtccccacccaaggctgggtcctctctaggggcctggcatttgagtgaggaagcgatggctgcagccgaacgagaaggtcaggaagaacgtggtgcccagctggcttagcctcacctttcaaaggttccctaagcaaatttcttctcaaaac

SEQ ID NO: 16006 - DNA, 479 bp, Homo sapiens
  ENST00000480325
aggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgtaagtacctgccctcccacacagacccatcttttttttccctctctccatcctggagatagagaactcttcagtaccttagtaactagcaggggactggggtggagccagaccggattcccgagtcttccctctgtgcagatctctcctgctccacattcgaagcccattcagaaaggaggggtctgcctgcctgcctgtcagcccct

SEQ ID NO: 16007 - DNA, 795 bp, Homo sapiens
  ENST00000485931
ggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagaggccaacatcaagctcattctttggagcgggtgtgtcattgtttgggaaaatggctaggacatcccgacaaggtgatcatcctcaggattttgtggcaataacaaggggtgggggaaaattgggcgcgagtctgtggcctcgtccccacccaaggctgggtcctctctaggggcctggcatttgagtgaggaagcgatggctgcagccgaacgagaaggtcaggaagaacgtggtgcccagctggcttagcctcacctttcaaaggttccctaagcaaatttcttctcaaaacagaaagcatgagttttgtgggatgctttgtacaatcagaccat

SEQ ID NO: 16008 - DNA, 582 bp, Homo sapiens
  ENST00000495678
gatcaggaagggtcacagcagccatggtaggtgaatggagcagcttttccttcctttcctgctttcagagcctactcagtgccaaacttacatcaaaagctcagcaagtactgattgattaatccctcttgcctacggcaaaatggccctgagggctatctctcagctctgcactggcctctgagctgtctgccaggcagggctctagaaaagagtcccaaggaagagaataaggttccccaaatcagcttcacactgcaacaaggagagaggaggaaatggtgggagactgacctgaggaacaaggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacacca

SEQ ID NO: 16009 - DNA, 671 bp, Homo sapiens
  ENST00000479569
agttcccagattcacactgaatttccatcatggagctggtccttgaggcgggcccagggcatgggaaaggagggagggagggttgggagctcttggtgcctgcttaaagagacagcatcaggatcaacacagtcccttgatgaacctggatctgtgcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacgtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtg

SEQ ID NO: 16010 - DNA, 566 bp, Homo sapiens
  ENST00000485688
atattgcccaagttggagcctccagcgtagtaggatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacgtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctacactggtttccctgctcaccttcatgattgctgccacttacaactttgccgtccttaaactcatgggccgaggcaccaagt

SEQ ID NO: 16011 - DNA, 627 bp, Homo sapiens
  ENST00000478642
gtagtaggtatggagaagccaagggaggcactaagcctctcctgttcctagaacaagttaggctcctgttccttcacccacctttcttcttgtctagctccctactcctgtgagttagcatgtctgaagggtggggcagggagagtaggtccctggttctccaggtcccagggatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagaggccaacatcaagctcattctttggagcgggtgtgtcattgtttgggaaaatggctaggacatcccgacaagtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttcc

SEQ ID NO: 16012 - DNA, 543 bp, Homo sapiens
  ENST00000476160
agtaggtatggagaagccaagggaggcactaagcctctcctgttcctagaacaagttaggctcctgttccttcacccacctttcttcttgtctagctccctactcctgtgagttagcatgtctgaagggtggggcagggagagtaggtccctggttctccaggtcccagggatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagaggccaacatcaagctcattctttggagcgggtgtgtcattgtttgggaaaatggctaggacatcccgacaaggtgatcatcctcaggattttgtggcaataacaaggggtgggggaaaattgggcgcgagtctgtggcctcgtccccacccaaggctgggtcctctctaggggcctggcattt

SEQ ID NO: 16013 - DNA, 560 bp, Homo sapiens
  ENST00000461231
agtaggtatggagaagccaagggaggcactaagcctctcctgttcctagaacaagttaggctcctgttccttcacccacctttcttcttgtctagctccctactcctgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacgtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctac

SEQ ID NO: 16014 - DNA, 861 bp, Homo sapiens
  ENST00000466486
tttacaccttatctgcccaaaaacatcctctgaagcctctctaacccagggatcctcctcactcttcccctacccattccccccaccctccgttatactggggccagttatctagtagatactgccaattacccttggcagaggtgccctgctcactaatttcatttgaaggagagccctggaacctggttttaatgtctggcacacgccactccaggatctcccagtttgtgtttctacatctgcaggctgatgctgatttctaaccaccccatgtcaatcattttagtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctacactggtttccctgctcaccttcatgattgctgccacttacaactttgccgtccttaaactcatgggccgaggcaccaagttctgatcccccgtagaaatccccctttctctaatagcgaggctctaaccacacagcctacaatgctgcgtctcccatcttaactctttgcctttgccaccaactggccctcttcttacttgatgagtgtaacaagaaaggagagtcttgcagtgattaaggtctctctttggactctcccctcttatgtacctctt

SEQ ID NO: 16015 - DNA, 566 bp, Homo sapiens
  ENST00000494119
ttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgaggtgagtgggttatttgggttattttacaagggagtagctaataccatacaaattacacccatggccttcaattttaaggactgaaagtttccctttgctggattttgaattagccgattgccttctacaacatgttggctaagtgtgcctgagccaatgagcatagaaggtaaaacacctgttttctctagagttgcatagaaagacttcctttccaacccttcccctcttaaaagagaagtttgtagctttaggtaaagatagagcctaatggcaaaatcccccacatgaaaattttcattcctttagttaaaaaccatatca

SEQ ID NO: 16016 - DNA, 548 bp, Homo sapiens
  ENST00000496836
aaatgagaggtaaaataagtacatttgaaagggaaagcactgtattgagaacagatattatatacaaatgaggcaggggaataaaagtaaatccgggggagacaggcagtaaattatttctttgacagcaaaatgttgactttaaattttgggcccctgggcacaactgtagggaaccagttaattattttggagtactgtactatttcatgactattctgtgatctgggtgttaatgggccaggtgctatggtgtacactgaagactgggaggcccacatttagggaagtgaaaacttagttagagatgtggaattagcacacaagaaagatatcaacacattcagaaagctgtattcatgatttacagtggagcatattactgctgttgcaagaaacagttcttcctctttcattttcctgcagttccaaatgaccttccacctgtttattgctgcatttgtgggggctgcagctacactggtttccctgctcaccttcatgattgctgccacttacaactttgccgtccttaaactcatgggccg

SEQ ID NO: 16017 - DNA, 3132 bp, Homo sapiens
  ENST00000612423
atggcttctcacgcttgtgctgcatatcccacaccaattagacccaaggatcagttggaagtttccaggacatcttcattttatttccaccctcaatccacatttccagatgtctctgcagcaaagcgaaattccaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagaggccaacatcaagctcattctttggagcgggtgtgtcattgtttgggaaaatggctaggacatcccgacaagtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctacactggtttccctgctcaccttcatgattgctgccacttacaactttgccgtccttaaactcatgggccgaggcaccaagttctgatcccccgtagaaatccccctttctctaatagcgaggctctaaccacacagcctacaatgctgcgtctcccatcttaactctttgcctttgccaccaactggccctcttcttacttgatgagtgtaacaagaaaggagagtcttgcagtgattaaggtctctctttggactctcccctcttatgtacctcttttagtcattttgcttcatagctggttcctgctagaaatgggaaatgcctaagaagatgacttcccaactgcaagtcacaaaggaatggaggctctaattgaattttcaagcatctcctgaggatcagaaagtaatttcttctcaaagggtacttccactgatggaaacaaagtggaaggaaagatgctcaggtacagagaaggaatgtctttggtcctcttgccatctataggggccaaatatattctctttggtgtacaaaatggaattcattctggtctctctattaccactgaagatagaagaaaaaagaatgtcagaaaaacaataagagcgtttgcccaaatctgcctattgcagctgggagaagggggtcaaagcaaggatctttcacccacagaaagagagcactgaccccgatggcgatggactactgaagccctaactcagccaaccttacttacagcataagggagcgtagaatctgtgtagacgaagggggcatctggccttacacctcgttagggaagagaaacagggtgttgtcagcatcttctcactcccttctccttgataacagctaccatgacaaccctgtggtttccaaggagctgagaatagaaggaaactagcttacatgagaacagactggcctgaggagcagcagttgctggtggctaatggtgtaacctgagatggccctctggtagacacaggatagataactctttggatagcatgtctttttttctgttaattagttgtgtactctggcctctgtcatatcttcacaatggtgctcatttcatggggtattatccattcagtcatcgtaggtgatttgaaggtcttgatttgttttagaatgatgcacatttcatgtattccagtttgtttattacttatttggggttgcatcagaaatgtctggagaataattctttgattatgactgttttttaaactaggaaaattggacattaagcatcacaaatgatattaaaaattggctagttgaatctattgggattttctacaagtattctgcctttgcagaaacagatttggtgaatttgaatctcaatttgagtaatctgatcgttctttctagctaatggaaaatgattttacttagcaatgttatcttggtgtgttaagagttaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaagtctgattggttttaattgaaggaaagatttgtactacagttcttttgttgtaaagagttgtgttgttcttttcccccaaagtggtttcagcaatatttaaggagatgtaagagctttacaaaaagacacttgatacttgttttcaaaccagtatacaagataagcttccaggctgcatagaaggaggagagggaaaatgttttgtaagaaaccaatcaagataaaggacagtgaagtaatccgtaccttgtgttttgttttgatttaataacataacaaataaccaacccttccctgaaaacctcacatgcatacatacacatatatacacacacaaagagagttaatcaactgaaagtgtttccttcatttctgatatagaattgcaattttaacacacataaaggataaacttttagaaacttatcttacaaagtgtattttataaaattaaagaaaataaaattaagaatgttctcaatc

SEQ ID NO: 16018 - DNA, 1397 bp, Homo sapiens
  ENST00000327790
ctcgtccctccgaggaccctggaggcggggacctcgcgtgaggaccagacctccctccgcgccccgcactgcgcgcgccctcccaggctcgggggtccccgcgtcccaggcccagggggatgggggtcgcgagaggcccggggagccggggccagcatcccccgccccggcagcaggaagtctgtgcggaggggccgcgcgcgcgcctccatcccgccccgcctggcctgggagcctccctgcccttcgctatcctgacgctggtgaacgccccgtacaagcgaggattttactgcggggatgactccatccggtacccctaccgtccagataccatcacccacgggctcatggctggggtcaccatcacggccaccgtcatccttgtctcggccggggaagcctacctggtgtacacagaccggctctattctcgctcggacttcaacaactacgtggctgctgtatacaaggtgctggggaccttcctgtttggggctgccgtgagccagtctctgacagacctggccaagtacatgattgggcgtctgaggcccaacttcctagccgtctgcgaccccgactggagccgggtcaactgctcggtctatgtgcagctggagaaggtgtgcaggggaaaccctgctgatgtcaccgaggccaggttgtctttctactcgggacactcttcctttgggatgtactgcatggtgttcttggcgctgtatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtctgctacatctcagacttcttcaaagcccgacccccacagcactgtctgaaggaggaggagctggaacggaagcccagcctgtcactgacgttgaccctgggcgaggctgaccacaaccactatggatacccgcactcctcctcctgaggccggaccccgcccaggcagggagctgctgtgagtccagctgaggcccacccaggtggtccctccagccctggttaggcactgagggctctggacgggctccaggaaccctgggctgatgggagcagtgagcgggctccgctgccccctgccctgcactggaccaggagtctggagatgcctgggtagccctcagcatttggaggggaacctgttcccgtcggtccccaaatatccccttctttttatggggttaaggaagggaccgagagatcagatagttgctgttttgtaaaatgtaatgtatatgtggtttttagtaaaatagggcacctgtttcacaaacgg

SEQ ID NO: 16019 - DNA, 1383 bp, Homo sapiens
  ENST00000434325
cccctcccctcctcacctctcccctcgtgccctccccgcccctcccctcctccccttcccgcccctcccctcctctccgcgcggggcgggctccgcgccacgtgactccgcggccgggccgggacgcgacgggacgcgctgggaccggcgtcgggggtcgcggggaccatgcagcggaggtgggtcttcgtgctgctcgacgtgctgtgcttactggtcgcctccctgcccttcgctatcctgacgctggtgaacgccccgtacaagcgaggattttactgcggggatgactccatccggtacccctaccgtccagataccatcacccacgggctcatggctggggtcaccatcacggccaccgtcatccttgtctcggccggggaagcctacctggtgtacacagaccggctctattctcgctcggacttcaacaactacgtggctgctgtatacaaggtgctggggaccttcctgtttggggctgccgtgagccagtctctgacagacctggccaagtacatgattgggcgtctgaggcccaacttcctagccgtctgcgaccccgactggagccgggtcaactgctcggtctatgtgcagctggagaaggtgtgcaggggaaaccctgctgatgtcaccgaggccaggttgtctttctactcgggacactcttcctttgggatgtactgcatggtgttcttggcgctgtatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtctgctacatctcagacttcttcaaagcccgacccccacagcactgtctgaaggaggaggagctggaacggaagcccagcctgtcactgacgttgaccctgggcgaggctgaccacaaccactatggatacccgcactcctcctcctgaggccggaccccgcccaggcagggagctgctgtgagtccagctgaggcccacccaggtggtccctccagccctggttaggcactgagggctctggacgggctccaggaaccctgggctgatgggagcagtgagcgggctccgctgccccctgccctgcactggaccaggagtctggagatgcctgggtagccctcagcatttggaggggaacctgttcccgtcggtccccaaatatccccttctttttatggggttaaggaagggaccgagagatcagatagttgctgttttgtaaaatgtaatgtatatgtggtttttagtaaaatagggcacctgtttcacaaacgg

SEQ ID NO: 16020 - DNA, 1228 bp, Homo sapiens
  ENST00000269812
ggccgggccgggacgcgacgggacgcgctgggaccggcgtcgggggtcgcggggaccatgcagcggagcctccctgcccttcgctatcctgacgctggtgaacgccccgtacaagcgaggattttactgcggggatgactccatccggtacccctaccgtccagataccatcacccacgggctcatggctggggtcaccatcacggccaccgtcatccttgtctcggccggggaagcctacctggtgtacacagaccggctctattctcgctcggacttcaacaactacgtggctgctgtatacaaggtgctggggaccttcctgtttggggctgccgtgagccagtctctgacagacctggccaagtacatgattgggcgtctgaggcccaacttcctagccgtctgcgaccccgactggagccgggtcaactgctcggtctatgtgcagctggagaaggtgtgcaggggaaaccctgctgatgtcaccgaggccaggttgtctttctactcgggacactcttcctttgggatgtactgcatggtgttcttggcgctgtatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtctgctacatctcagacttcttcaaagcccgacccccacagcactgtctgaaggaggaggagctggaacggaagcccagcctgtcactgacgttgaccctgggcgaggctgaccacaaccactatggatacccgcactcctcctcctgaggccggaccccgcccaggcagggagctgctgtgagtccagctgaggcccacccaggtggtccctccagccctggttaggcactgagggctctggacgggctccaggaaccctgggctgatgggagcagtgagcgggctccgctgccccctgccctgcactggaccaggagtctggagatgcctgggtagccctcagcatttggaggggaacctgttcccgtcggtccccaaatatccccttctttttatggggttaaggaagggaccgagagatcagatagttgctgttttgtaaaatgtaatgtatatgtggtttttagtaaaatagggcacctgtttcacaaa

SEQ ID NO: 16021 - DNA, 6455 bp, Homo sapiens
  ENST00000621795
gatcgctccagcccaggagtttgtgaccagcctggtcaacatgagacccctgtctctacttttaaaaatttaaaaaaaaaagatattttgggcagagagaagtggctgtgcaaaggtgggtgtttgctgagttagttcaaggagcagaaaggaggctgccaggatgtgaggggcagagcgcctgaggagtttgtgtttgtctgaggggatgcgaaagggagtgttatttgggctgtgaaaaaagctcttccttgctgtctggtgagagtagaggtgggaggcctccaggccaaggcaggtgtgtggggccccaaggcccagctggtgagagaacctcacagctcccaggcttttcttccccaccagcctccctgcccttcgctatcctgacgctggtgaacgccccgtacaagcgaggattttactgcggggatgactccatccggtacccctaccgtccagataccatcacccacgggctcatggctggggtcaccatcacggccaccgtcatccttgtaaggcaggaggggctcagagggactgggtagggggatggggtggggccagctttaccctgggggcctgatgggggggtggcacagccctgccctggaggtctgtgtggggccgggggacacagccttgccctgagtggtacctgtgggtaatagggcccccttcagagtccccagctctccagcagccttggggaggcccgtgcggaggagtgagggcccctgggccgaccgagacccccactggttcctgcggctgctcttgcaggtctcggccggggaagcctacctggtgtacacagaccggctctattctcgctcggacttcaacaactacgtggctgctgtatacaaggtgctggggaccttcctgtttggggctgccgtgagccagtctctgacagacctggccaagtacatgattgggcgtctgaggcccaacttcctagccgtctgcgaccccgactggagccgggtcaactgctcggtctatgtgcagctggagaaggtgtgcaggggaaaccctgctgatgtcaccgaggccaggtgggtgtggaccagcagccttcactcttgtggggaatgggagctgaagaaggccctggagccaaatcatgaagagccagcaggcagctgagactacaggcgtgcgccaccacgcccggctaatttttgtataagttagtgcattcttgtatgtttttgaagttcatccatgttgtaacattctgtcagtttttgctttaagtattttggggttctgttgtttagtacatttacctttgtaattgttatatatttttgaaagattgaccatttcatcatcatagaatgagatatatgagttttgtctcaacaatttttgtcttgatgtctgttttgtctgatattaacatagctattctggttctctttttgttattgtttgcatggaatattttttttttccattcttggactttcaacctgtttatgtctctgactgtaaagtaagtgtcttatacctagcatgaaattgggccatgtttcttaatgtattgtccaatctctgattttttttgagacagaggctcactctgtcacccaggctggagtgcaatgatctgagctcactgcagcctcggactcccaggctcaagccatcttcccacctgagcctcccgagtagctaggactacaggaacgtgccaccacatccagctactgtttattttttttttggtagaaacggggttttgccatattgcccaggctggtcttgaactcctgagctcaagcgatccgcccactttggcctcctaaagtgctgggattacaggtgtatgccaccacatccagccagatctctgactttttttttaatgttttttaaattatatattaatctttttattgaattaaggcatttaatgaaactttgacttttaattggagtgtttatttatattcaatgtaattactgataaggaaggacctctgtcatttcgttgaggtttgcttaggttatatcttcttttttcaattcctcattactgtctttttttgtttgtttgttttgcttttaattttttttttcttttagagatgggggtcttgctatcttgcccaggacttgaactcctgggctcaaaccatcctcccacctctgccttccaagtagctggtactacgggcatacaccaccaaatccagctggtttttaaatttttttgtagaaatagggtctcaccatgttgcccaggctggtctcgaatgcctgggctcaagcaatcctctcgcctcagcctcccaaagtgctgggattagaggtgtgagccactgagcccgttcagggtaaataatcttttttttttttcttttttttttttgagacagagtctgggcccaggctggagtgcggtggtgcaatcttggctcactgcaacctccatctcctgggttcaagtgcttctcctgcctcagcctccccagtagctgggattacaggtgtgcgccaccacgcccggctaatttttgtattttcatttacttttattaattttattttttgagacagaatgttgttctgtcacccaggctggagtgcagtgtgcagtggtgtgatcttggctcactgcaacctctgcctcctgggttcaagcgattctcctacctcagattcctgagtagctaggactacaggcgtgcaccaccacgcccgactaactttttgtatttttagtagagatggggtttcatcatgttggccaggctggtctcgaactcctgatctcaggtgatccacccaccctggcctcccaaagtgctgggattacaggcgtgagccaccatgcctggccaggctgaataatcttttttttttttctttttttcggccaggctgaataatgttttttttctccttttcttttttttttttttgagaaagagtctcactgtgtcgcccaggctggagtgcggtgacgtgatcttgtctcactacagcctctgcctcctcggtttaagcaattctcctgcctcagcctcctgagtagcaggcgtgagccaccacacctggccccagccgaataatctttttttttttctttgaaacgaagtctctctcttgtcccccaggctggagagcagtggcacgatctcggctcactgtaacctctgcctcccgggttcaagagattctctgcctcagcctgccgagtaactgggattacaagtgtgtaccactatgcccagctaattttttgtattaagtagagacggggtttcaccatgttggctaggctggtctcgaactcctgacctcaggtgatccacccgcctcggcctcccaaagtgctgggattacaggctgagccaccgtgccaggccaaataatcttaattgacctattttctttgtttttttgagttggagtcttgctctgtctcccaggctggagtgcagtggcataatctcagctcactgcaacctctgcctcctgggttcaagcgattctcctgcctcagcctcacgagtagctgggattacaggcgtgtgcctctgcgcccagctaatttttgtatttttagtagagacggggtttcgccatgttggccaggctggtctcgaactcccgacctttgtgatctgcccgtctctgcctcccaaagtgctgggatgacaggtgtgagccgctgtgcccggccaattgacctattttcaagttcattgtcttttttcttctgcttcctcagacctgctattgagcctccctcaagtgatttttcatttcagataaccaaatctttatttggttcctttttataacttctttctctttattgatattctctgtttggtgagacattgttctcatattcctttggctctttgaacatagtatttatttatttttacttttttctttgaacatattttaaatggctaactaaaagtgtttgtctagaacccaggcttggtggcacacaactgttgtcacagctatttgggagggtgaggcaggaggatcgctggagcccagaagttcaagtcaggccctctcttagaaagtgtctagtaagtccaacatctgggtgtcctgagggacaatttctattattacatttttttccctgtgtattggccacacctgtgtttttctacatgccttgtaattttttttttttttttgagacagagtctcaccctattgccaggttggagtgcagtggcgatctcggctcactgcaacctccacctcccaagttcaagcaaatctcctgcctcagcctcccaagtagctgggactacaggcatgtgctaccacacccagctaatttttgtatttttggtacagacggcgtttcaccgtgtgggccaggatggtctcggtctcttgacctcgtgatccgcctgcctcggcctcccaaagtcctgggattacaggagtgagccaccgcacccccggcctgttttgctttgttttaaactgggtgtttagaatattataatgtagcaactctggaaatatgatcctacgccctctcccgggtttgttcttgctgtttgttgcagtagttatttgtttaatgacttttctggttgtaaagtctgtattttttgtcacgtatggccgtttcttcctattcttttagcccagtggtcagtgataggacagagatttccttaaacatctggaatcaaaaaaacccataaaaccctcccagagtttgtagaagggtctgtgtgcatgtggggtcagcccttccgcggttaaacacattttcaactctgccttagcttttgcttcctgtgtgtgcggagcctgaaggcggccagacgtgagagcttagcttcggccctcgcaggcctctcctgagctcctgcacagctctgtctgcgttccaggcccccatcgcccagagcattttattccctggcctgtttggttagtctgttgtttgcctcatctgctgtctgtggccccaggcagcagagaataataaatttgttgtgaatgtttcctacaaatatcccccaggtagcacctcagcactgggagaatgtccagtcaggtgagatcaaggccagcccttgagccatactcccgtccacagttgcaaataaagtctgttcttggaatcctcaggccaccaccagtctaggcagtgggagagggaccaggatgagttaaaatgcgacaaggccgtttgttctgagattcagctggtttatcttgataagtcttctggtggctgcaagcttttgagtagttccaaaaaagttgattgtgacttttttgccatttttaaaaattgcttttgaagtttcttgctctgctattttcttgatgtccttcaccgaatcttgaatttatataaaaataagtcttccctcagttccgcagatgggagaaaatcctgaaaagaaacatggtgaaaatgaaactgtggtgttgcctgcttgccagacatgattgtctgccctgggttttgggttcaggcctcagagtcttcacggatgaggcatctcatgccacagccccagtcagagactcttattccattatcagatgactggaacagaaaaggggaacagtttctgctactgggatttgagtgcatctaacagcagcagcctccgtgtcgagccctcccttctgtgggcggggcggggacaagggggaggttggaaggcgctgagtgagccacctgccccttctccttcctcaggttgtctttctactcgggacactcttcctttgggatgtactgcatggtgttcttggcgctgtatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtctgctacatctcagacttcttcaaagcccgacccccacagcactgtctgaaggaggaggagctggaacggaagcccagcctgtcactgacgttgaccctgggcgaggctgaccacaaccactatggatacccgcactcctcctcctgaggccggaccccgcccaggcagggagctgctgtgagtccagctgaggcccacccaggtggtccctccagccctggttaggcactgagggctctggacgggctccaggaaccctgggctgatgggagcagtgagcgggctccgctgccccctgccctgcactggaccaggagtctggagatgcctgggtagccctcagcatttggaggggaacctgttcccgtcggtccccaaatatccccttctttttatggggttaaggaagggaccgagagatcagatagttgctgttttgtaaaatgtaatgtatatgtggtttttagtaaaatagggcacctgtttcac

SEQ ID NO: 16022 - DNA, 850 bp, Homo sapiens
  ENST00000633125
tccgcggccgggccgggacgcgacgggacgcgctgggaccggcgtcgggggtcgcggggaccatgcagcggaggtgggtcttcgtgctgctcgacgtgctgtgcttactgcctccctgcccttcgctatcctgacgctggtgaacgccccgtacaagcgaggattttactgcggggatgactccatccggtacccctaccgtccagataccatcacccacgggctcatggctggggtcaccatcacggccaccgtcatccttgtctcggccggggaagcctacctggtgtacacagaccggctctattctcgctcggacttcaacaactacgtggctgctgtatacaaggtgctggggaccttcctgtttggggctgccgtgagccagtctctgacagacctggccaagtacatgattgggcgtctgaggcccaacttcctagccgtctgcgaccccgactggagccgggtcaactgctcggtctatgtgcagctggagaaggtgtgcaggggaaaccctgctgatgtcaccgaggccaggttgtctttctactcgggacactcttcctttgggatgtactgcatggtgttcttggcgctgtatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtctgctacatctcagacttcttcaaagcccgacccccacagcactgtctgaaggaggaggagctggaacggaag

SEQ ID NO: 16023 - DNA, 541 bp, Homo sapiens
  ENST00000586998
ccgtgagccagtctctgacagacctggccaagtacatgattgggcgtctgaggcccaacttcctagccgtctgcgaccccgactggagccgggtcaactgctcggtctatgtgcagctggagaaggtgtgcaggggaaaccctgctgatgtcaccgaggccaggttgtctttctactcgggacactcttcctttgggatgtactgcatggtgttcttggcgctgtatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtgagcttctaaccctaactctatcccctgtgttgtccagagaccactccccagccaaccctagtgctgccctgggtacccttgccccactgagtccttccttgggcctcctccctgtcagtcctccctgggaccccttcccc

SEQ ID NO: 16024 - DNA, 581 bp, Homo sapiens
  ENST00000591572
gacgcgacgggacgcgctgggaccggcgtcgggggtcgcggggaccatgcagcggaggtgggtcttcgtgctgctcgacgtgctgtgcttactggtcggcttttcttccccaccagcctccctgcccttcgctatcctgacgctggtgaacgccccgtacaagcgaggattttactgcggggatgactccatccggtacccctaccgtccagataccatcacccacgggctcatggctggggtcaccatcacggccaccgtcatccttgtctcggccggggaagcctacctggtgtacacagaccggctctattctcgctcggacttcaacaactacgtggctgctgtatacaaggtgctggggaccttcctgtttggggctgccgtgagccagtctctgacagacctggccaagtacatgattgggcgtctgaggcccaacttcctagccgtctgcgaccccgactggagccgggtcaactgctcggtctatgtgcagctggagaaggtgtgcaggggaaaccctgctgatgtcaccgaggccaggttgtctttctactcgggacactcttcctttggga

SEQ ID NO: 16025 - DNA, 687 bp, Homo sapiens
  ENST00000589672
ggatcgctccagcccaggagtttgtgaccagcctggtcaacatgagacccctgtctctacttttaaaaatttaaaaaaaaaagatattttgggcagagagaagtggctgtgcaaaggtgggtgtttgctgagttagttcaaggagcagaaaggaggctgccaggatgtgaggggcagagcgcctgaggagtttgtgtttgtctgaggggatgcgaaagggagtgttatttgggctgtgaaaaaagctcttccttgctgtctggtgagagtagaggtgggaggcctccaggccaaggcaggtgtgtggggccccaaggcccagctggtgagagaacctcacagctcccaggcttttcttccccaccagcctccctgcccttcgctatcctgacgctggtgaacgccccgtacaagcgaggattttactgcggggatgactccatccggtacccctaccgtccagataccatcacccacgggctcatggctggggtcaccatcacggccaccgtcatccttgtctcggccggggaagcctacctggtgtacacagaccggctctattctcgctcggacttcaacaactacgtggctgctgtatacaaggtgctggggaccttcctgtttggggctgccgtgagccagtctctgacagacctggccaagtacatgattgggcgtctgagg

SEQ ID NO: 16026 - DNA, 3292 bp, Homo sapiens
  ENST00000371250
agtgcagaaaacaaacccaggcgatcacagcagcagccgccgcggcagcagcaccaacagcaggaggagcaggaggagccggaggaggaggaggaggaggaggcaaagttagagttggggctggcgctccggagttgctgggctcagcgcagctcccattcattaaggaaccagctgcggaggaaggtggccgagcgcccgcgctgcccactcgctcgctcgcgcactcagacgcgcgccacaacagcgcgccccaagctgcgcagctctgcaaaagtttctgctcgggatctggctctcttccccttggactttagaacgatttagggttgacagaggaaagcagaggcgcgcaggaggagcagaaaacaccaccttctgcagttggaggcaggcagccccggctgcactctagccgccgcgcccggagccggggccgacccgccactatccgcagcagcctcggccaggaggcgacccgggcgcctgggtgtgtggctgctgttgcgggacgtcttcgcggggcgggaggctcgcgccgcagccagcgccatgcaaaactacaagtacgacaaagcgatcgtcccggagagcaagaacggcggcagcccggcgctcaacaacaacccgaggaggagcggcagcaagcgggtgctgctcatctgcctcgacctcttctgcctcttcatggcgggcctccccttcctcatcatcgagacaagcaccatcaagccttaccaccgagggttttactgcaatgatgagagcatcaagtacccactgaaaactggtgagacaataaatgacgctgtgctctgtgccgtggggatcgtcattgccatcctcgcgatcatcacgggggaattctaccggatctattacctgaagaagtcgcggtcgacgattcagaacccctacgtggcagcactctataagcaagtgggctgcttcctctttggctgtgccatcagccagtctttcacagacattgccaaagtgtccatagggcgcctgcgtcctcacttcttgagtgtctgcaaccctgatttcagccagatcaactgctctgaaggctacattcagaactacagatgcagaggtgatgacagcaaagtccaggaagccaggaagtccttcttctctggccatgcctccttctccatgtacactatgctgtatttggtgctatacctgcaggcccgcttcacttggcgaggagcccgcctgctccggcccctcctgcagttcaccttgatcatgatggccttctacacgggactgtctcgcgtatcagaccacaagcaccatcccagtgatgttctggcaggatttgctcaaggagccctggtggcctgctgcatagttttcttcgtgtctgacctcttcaagactaagacgacgctctccctgcctgcccctgctatccggaaggaaatcctttcacctgtggacattattgacaggaacaatcaccacaacatgatgtaggtgccacccacctcctgagctgtttttgtaaaatgactgctgacagcaagttcttgctgctctccaatctcatcagacagtagaatgtagggaaaaacttttgcccgactgatttttaaaaaggaaaaaaaaaatgttttactatgtggccttccaaaataggtagtgtttgcctatgtggaaacaacagcaaactaacaccaagtgccagagtcctggatgtgcaattggtttaagtgttcatgttctagtgaacacagcttgttcaggaacaaacactaaaacgatttgagtagaggctgctggtcaccttttgtgacctgaggaatcccaggcctgtgagaaaagcaaaaattcacattgcagcacatgatgccagaaatagcactgaatcaagaaaatagccattgcggagctgccctcttgagtctttctgtccatcccattctattctgtactgtgactttagttcaggaagttttgttttgtgttttaaataaaaggaaagagcaagtttgctcagtcaagtgatcagatcccgaatctagattcccagttctaaggccttatcacctcccctgcccataggccaacaaccatagttcctcacattagtgattagcagactctttgtggacgagtgaatttcacaaacagcacaatttcagaagaaatcgagggcacaggccctcacttttcttcttttgacgcatcatcctgtgatgttgaaatgtcaattgcaggatgctgatgttgtgcacgtcaatcaccgggcacttgcatactcttagaaacagttcgacttcggttactgccttctcccttgaaatccttgctgcgtgcccaccaggatttcctgtgagggcccaggaatgagcaaggcatggtctgccaccagctgacggaaagcagccttctgtacaacagatgggagggtgaagggggcagaatgaaaatcgaaccaaccttttagctgttgcaaatcagaaggagccagagaagcaggcagtctcatgcatgagaggttacccttcaggatgacagagctgagggtctttgtaggagttgctcttgctgtgtaaagcactattgtcttggggttgagccctagggcagttcttggtaggttctgctgggcagaacatatgggttaaatctcggtagagagtttccctcatcctctatccgtaagtgtccttccatgcaaggtcccactctaggtgatagacagggaccccttctactgaacctttgaggaaaggaggaaggaagaaatgcgtttagatcttggatgcagacctttcaaagggttaaatgtaaccatatggatcaaccacatgcacatccttactacagaatccgtcctttcatttcaacttatagcaagctatgatttttatatataaatattatataaataatgtataaaacattaaaagttaactatgtaagatattatttctgaaacaatttagctatatccactatgattataaactgtgtctcgacctgtgttatttacattagctgcttaaaaaagcattgagttaatttttttaaatatcaactaaaatatcatagttctgtggtagacattgttttataatgaaataactgcaactagagaaaactgtataaaaacattaaattgtcagtatttttgtaaggttccattttgtaaagagaataatattcaaagacttttgtagcatacaaagtgaaaacttgtatctgcgaaactatacttgtattaaatgtgctttttaaataaaagctcgtaacacaactaattaaggacttgcaa

SEQ ID NO: 16027 - DNA, 696 bp, Homo sapiens
  ENST00000472957
agaccagaggaacagcctcaagttcagtcggacctttctaaggaggttttgttggaattccacaagaccctagttctgaaggtaggacaaagaaggagaagagaactgcactgacagactatacctgcaggcccgcttcacttggcgaggagcccgcctgctccggcccctcctgcagttcaccttgatcatgatggccttctacacgggactgtctcgcgtatcagaccacaagcaccatcccagtgatgttctggcaggatttgctcaaggagccctggtggcctgctgcatagttttcttcgtgtctgacctcttcaagactaagacgacgctctccctgcctgcccctgctatccggaaggaaatcctttcacctgtggacattattgacaggaacaatcaccacaacatgatgtaggtgccacccacctcctgagctgtttttgtaaaatgactgctgacagcaagttcttgctgctctccaatctcatcagacagtagaatgtagggaaaaacttttgcccgactgatttttaaaaaggaaaaaaaaaatgttttactatgtggccttccaaaataggtagtgtttgcctatgtggaaacaacagcaaactaacaccaagtgccagagtcctggatgtgcaattggtttaagtgttcatgttctagtgaacacagcttgttcaggaacaa

SEQ ID NO: 16028 - DNA, 2039 bp, Homo sapiens
  ENST00000459962
gtttagcaggcaacggcctcagtgtgatcttttttgtcagtattcttattttttcctcttaagtttttccaataatacatttttataatttcaaaatgattataaagtagtctgctgtcttccatgtctgcttatttgaaatagtgttccacgtagttgaggattcagtcctagacacttatggctaagaatgattctgggatcttccactcttctgtctcatcaagactggccactggcttgctcttttcttgccaccgaaggaaggtgtccatctgtcccaggaaggacaaactcatgtcttcagcactgccacaggtctatctttaggccatcagccacctcccctccgctctcttcccttctcctgcctctccaagtgctttgatttgtagtcggaagttcctcttgtccacttgcctcttccccctcatttcccaagttcccacaggaacctgggaataggttgtgcccagaggttagaacggaaactgcagcaagataactctgaggggacaatgcccagttgacgtcatttcaactactttgcttcagctagaggtggttttttttttaatcttccatttttcttcaggttactcttctactccaccctgtctagtgtctgtcaacttctatttgaaaattccctggcattgtctcgttggtttattgtttccttatattctcattcaatatccatagttccaagtggtgacttagaaatgtgtccttgatagagttgctttcttctgaagcagaagcatctcattggggatataataacttcctcttatcattgcatatttaatttccgtgctgacaccaggtagtgtagggattatatagccgtaatccccagggaaatacacaaatgtgttaagtaagttgtcatcaattgtaaaaaaagaaacctttacaagccctggttactgctctttaattattagtttcagtcaagaggaagataaaaggaaactatcatttattacgttcctactatgtggcagtgtgctaaggccatttacatatattatattgctcagctttccctggtttatctccctagataaactctatttttcctattttttagtgtgagaactaagactcagcatttatttatttatttacttacttacttacttatttatttttttgaggcagagtctcactctgttgcccagaccgaactgcagtggtgcgatctcggctcactgcgacctccgcctcctgggttcaagtgattttcctgcctcagcctcctgagtagctgggactataggcacatgccatcacacccagataatttttgtatttttattacagatgaggtttcactatgttggccagactggtctcaaacacctgacctcaggtgatctgcccacctcagccacacgaagtgctgggattacagacgtgagccaccgtgcctagccaggctcagcatttaaataactggcttgaggtcatgttcaaattgctgtatctacaacatgccacccaaggtccagatgatccctgttcgtagaaatgtagtgtgtgtcacctggggttatagtgcatgtgagtggggagtcacttaatgtctgttcctttttgtctcctttctccagctatacctgcaggcccgcttcacttggcgaggagcccgcctgctccggcccctcctgcagttcaccttgatcatgatggccttctacacgggactgtctcgcgtatcagaccacaagcaccatcccagtgatgttctggcaggatttgctcaaggagccctggtggcctgctgcatagttttcttcgtgtctgacctcttcaagactaagacgacgctctccctgcctgcccctgctatccggaaggaaatcctttcacctgtggacattattgacaggaacaatcaccacaacatgatgtaggtgccacccacctcctgagctgtttttgtaaaatgactgctgacagcaagttcttgctgctctccaatctcatcagacagtagaatgtagggaaaaacttttgcccgactgattttt

SEQ ID NO: 16029 - DNA, 646 bp, Homo sapiens
  ENST00000461655
gggcgagggggcggaccccgagccgcgaggggcgcggggcgggcgcggggtcccgggagagggcgctgggcgcttcgggcccagatcatctttcttgctgacaagtatcatctaggaatcactctacctcgctggcaattttgagaaaatagccagttatttttgtgctgaactttcatctggttaagggtcattccttcagtagtcaagtgagtaagaaaagacctattctgcttttgagcgggcctccccttcctcatcatcgagacaagcaccatcaagccttaccaccgagggttttactgcaatgatgagagcatcaagtacccactgaaaactggtgagacaataaatgacgctgtgctctgtgccgtggggatcgtcattgccatcctcgcgatcatcacgggggaattctaccggatctattacctgaagaagtcgcggtcgacgattcagaacccctacgtggcagcactctataagcaagtgggctgcttcctctttggctgtgccatcagccagtctttcacagacattgccaaagtgtccatagggcgcctgcgtcctcacttcttgagtgtctgcaaccctgatttcagccagatcaactgctctgaaggctacattcagaactacagatgca

SEQ ID NO: 16030 - DNA, 597 bp, Homo sapiens
  ENST00000476206
gggcgcggggcgggcgcggggtcccgggagagggcgctgggcgcttcgggcccagatcatctttcttgctgacaagtatcatctaggaatcactctacctcgctggcaattttgagaaaatagccagttatttttgtgctgaactttcatctggttaagggtcattccttcagtagtcaagacctcgtgaaataaaagtgcagaaaacaaacccaggcgatcacagcagcagccgccgcggcagcagcaccaacagcaggaggagcaggaggagccggaggaggaggaggaggaggaggcaaagttagagttggggctggcgctccggagttgctgggctcagcgcagctcccattcattaaggaaccagctgcggaggaaggtggccgagcgcccgcgctgcccactcgctcgctcgcgcactcagacgcgcgccacaacagcgcgccccaagctgcgcagctctgcaaaagtttctgctcgggatctggctctcttccccttggactttagaacgatttagggttgacagaggaaagcagaggcgcgcaggaggagcagaaaacaccaccttctgcagttggaggcaggcagccc

SEQ ID NO: 16031 - DNA, 885 bp, Homo sapiens
  ENST00000427079
agggtctggcgagccggcgccggccgagctgcgggagccgcggagagcaccagctgacgccgcgggagctgctccggccgcaccatgcgggagctggccattgagatcggggtgcgagccctgctcttcggagtcttcgtttttacagagtttttggatccgttccagagagtcatccagccagaagagatctggctctataaaaatcctttggtgcaatcagataacatacctacccgcctcatgtttgcaatttctttcctcacacccctggctgttatttgtgtggtgaaaattatccggcgaacagacaagactgaaattaaggaagccttcttagcggtgtccttggctcttgctttgaatggagtctgcacaaacactattaaattaatagtgggaagacctcgccccgatttcttttaccgctgctttccagatggagtgatgaactcggaaatgcattgcacaggtgaccccgatctggtgtccgagggccgcaaaagcttccccagcatccattcctcctttgccttttcgggccttggcttcacgacgttctacttggcgggcaagctgcactgcttcaccgagagtgggcggggaaagagctggcggctctgtgctgccatcctgcccttgtactgcgccatgatgattgccctgtcccgcatgtgcgactacaagcatcactggcaagattcctttgtgggtggagtcatcggcctcatttttgcatacatttgctacagacagcactatcctcctctggccaacacagcttgccataaaccctacgttagtctgcgagtcccagcctcactgaagaaagaggagaggcccacagctgacagcgcacccagcttgcctctggaggggatcacc

SEQ ID NO: 16032 - DNA, 1135 bp, Homo sapiens
  ENST00000369073
atgcatggaattggtccttctggcagttttacagagtttttggatccgttccagagagtcatccagccagaagagatctggctctataaaaatcctttggtgcaatcagataacatacctacccgcctcatgtttgcaatttctttcctcacacccctggctgttatttgtgtggtgaaaattatccggcgaacagacaagactgaaattaaggaagccttcttagcggtgtccttggctcttgctttgaatggagtctgcacaaacactattaaattaatagtgggaagacctcgccccgatttcttttaccgctgctttccagatggagtgatgaactcggaaatgcattgcacaggtgaccccgatctggtgtccgagggccgcaaaagcttccccagcatccattcctcctttgccttttcgggccttggcttcacgacgttctacttggcgggcaagctgcactgcttcaccgagagtgggcggggaaagagctggcggctctgtgctgccatcctgcccttgtactgcgccatgatgattgccctgtcccgcatgtgcgactacaagcatcactggcaagattcctttgtgggtggagtcatcggcctcatttttgcatacatttgctacagacagcactatcctcctctggccaacacagcttgccataaaccctacgttagtctgcgagtcccagcctcactgaagaaagaggagaggcccacagctgacagcgcacccagcttgcctctggaggggatcaccgaaggcccggtatgaccagtgtcctgggaggatggacactaagccctgggcacatctgccaccctgacatcataacacaatagaaatggttttctgtagtgtatttttcatcagttgtttctcaaagtcatcgtacttctgcttctgtttcactgatggtgttcctgctactttaaatgtctacttccaacatccttgaatttgcaagtgaaggacaacaatctctgagagacgtgtggaagaggctgtgaaggtggggtttggggagcttggccgattcgtctatctgaaatgtttgctgtaacagccaccttcctatgttttcatggttgtaaaacataataaaacctcccacgtggaagac

SEQ ID NO: 16033 - DNA, 352 bp, Homo sapiens
  ENST00000496437
tcaccgagagtgggcggggaaagagctggcggctctgtgctgccatcctgcccttgtactgcgccatgatgattgccctgtcccgcatgtgcgactacaagcatcactggcaagcagtgggaaggagtcagccaagcaggagaatggctgcgcctatttgctcttgagagaacatcaccagctgctgtgtcccaagtccagttccagagcagcgtactgggcccctggtctacatgcactgaaacttatgctgccatcacggacatgtctaaaataaaagagcttttcttttatttgtacttcttttcctgctttgctattgtggattaataaaattacatgcatgaaatta

SEQ ID NO: 16034 - DNA, 1521 bp, Homo sapiens
  ENST00000398250
cgggcttcccctccccggtccgcgggtgcccggcgcgggcccaggaggcggaggcggctcctggggagagggatccgggagtccctgaggcggccccggctccgcactaggaggcggggtccgcagtatcgccagcggccggcgcggcttcccggagccccggagcccgaggcgcgaggtttaggctgagccctccccggcgcctgcccccgcccggcgcccgcctccgcccccgcccgcggcctggagcgcgcctccctcgcctcccagggtctggcgagccggcgccggccgagctgcgggagccgcggagagcaccagctgacgccgcgggagctgctccggccgcaccatgcgggagctggccattgagatcggggtgcgagccctgctcttcggagtcttcgtttttacagagtttttggatccgttccagagagtcatccagccagaagagatctggctctataaaaatcctttggtgcaatcagataacatacctacccgcctcatgtttgcaatttctttcctcacacccctggctgttatttgtgtggtgaaaattatccggcgaacagacaagactgaaattaaggaagccttcttagcggtgtccttggctcttgctttgaatggagtctgcacaaacactattaaattaatagtgggaagacctcgccccgatttcttttaccgctgctttccagatggagtgatgaactcggaaatgcattgcacaggtgaccccgatctggtgtccgagggccgcaaaagcttccccagcatccattcctcctttgccttttcgggccttggcttcacgacgttctacttggcgggcaagctgcactgcttcaccgagagtgggcggggaaagagctggcggctctgtgctgccatcctgcccttgtactgcgccatgatgattgccctgtcccgcatgtgcgactacaagcatcactggcaagattcctttgtgggtggagtcatcggcctcatttttgcatacatttgctacagacagcactatcctcctctggccaacacagcttgccataaaccctacgttagtctgcgagtcccagcctcactgaagaaagaggagaggcccacagctgacagcgcacccagcttgcctctggaggggatcaccgaaggcccggtatgaccagtgtcctgggaggatggacactaagccctgggcacatctgccaccctgacatcataacacaatagaaatggttttctgtagtgtatttttcatcagttgtttctcaaagtcatcgtacttctgcttctgtttcactgatggtgttcctgctactttaaatgtctacttccaacatccttgaatttgcaagtgaaggacaacaatctctgagagacgtgtggaagaggctgtgaaggtggggtttggggagcttggccgattcgtctatctgaaatgtttgctgtaacagccaccttcctatgttttcatggttgtaaaacataataaaacctcccacgtggaagacttgg

SEQ ID NO: 16035 - DNA, 2495 bp, Homo sapiens
  ENST00000374874
ctccgccccctccgcgccagccttttgctctttcctttcattaaacaaacaggagatcctgaaacctggaccctgtgcaagctgcagcgccaggaggaggcagcggaggaagcagagcgcgggatgggcgcccagcggcatctgtgatcccgcgcacctccgccccacgggcgcgcgcacaaacacggacacacacatacacacactcgcgcacacactcgcacaaacacacactcgtacacgcccgcgccgctcgctcgccggcttgctctcccacgcaagcggaatgcagcagcgcctggagagcgtgtctcggaccgccgcctgaatgtacctcgctcccgggagccggacggcccagtagggcgcactggaggacgctccgctgcgggagcctggacagtttttgacggtgcagtcttgctatatggtgtgagaaatggctgtaggaaacaacactcaacgaagttattccatcatcccgtgttttatatttgttgagcttgtcatcatggctgggacagtgctgcttgcctactacttcgaatgcactgacacttttcaggtgcatatccaaggattcttctgtcaggacggagacttaatgaagccttacccagggacagaggaagaaagcttcatcacccctctggtgctctattgtgtgctggctgccaccccaactgctattatttttattggtgagatatccatgtatttcataaaatcaacaagagaatccctgattgctcaggagaaaacaattctgaccggagaatgctgttacctgaaccccttacttcgaaggatcataagattcacaggggtgtttgcatttggactttttgctactgacatttttgtaaacgccggacaagtggtcactgggcacttaacgccatacttcctgactgtgtgcaagccaaactacaccagtgcagactgccaagcgcaccaccagtttataaacaatgggaacatttgtactggggacctggaagtgatagaaaaggctcggagatcctttccctccaaacacgctgctctgagcatttactccgccttatatgccacgatgtatattacaagcacaatcaagacgaagagcagtcgactggccaagccggtgctgtgcctcggaactctctgcacagccttcctgacaggcctcaaccgggtctctgagtatcggaaccactgctcggacgtgattgctggtttcatcctgggcactgcagtggccctgtttctgggaatgtgtgtggttcataactttaaaggaacgcaaggatctccttccaaacccaagcctgaggatccccgtggagtacccctaatggctttcccaaggatagaaagccctctggaaaccttaagtgcacagaatcactctgcgtccatgaccgaagttacctgagacgactgatgtgtcacaagctgttttttaaaatcatcttccaattctatacttcaaaacacacagttgctcaatgtcaaactgtgatgacaaatattacgtttatctagttagaagctaatgttttgtacattttttgtatgaggaagtgatgtagcttgccctgattttttttttttttttttggtcagctttaatatatttatgccagaattttaaaaccaacaaaattttcttgttcaagcgtgcattgaagaaccacatttattcaatggttgacgttgttttgtgatatttgtacacaaattttcttttctcagttttataaacacagaatataacaattcactttaaacttttattaccacagttgctgcctcctccagaatttttgaattttaataaaaggcaaacttttgagctgcaggaaggacaatgttggttaataataaatctcaaagtcaattgtagaaaaaaaattgtcttcaaaaagaatgttgcactctgatctcttaacaaattgttacgttcaaagtttaaagtgatatattaacaaagtcacctagttatacaaacaattgtcagagaattctggatttggagggtattggggttatatgattctttcttagataatggcctctactaaataactcaagatctttctggaatgtcttctggcaggcaggtgccactgtcagcttttctccaaaaagcagccaacatcagcctcccctgtcaactcaacagttttgtatctcatattatatggactttatatgaaaatgaatattttacagtttgcacagtattattttacagaaaaggaatcagagaatctacaacatagggccccagaacaacagtttcactttgtggcttttaattattctagaattttaactgcatctcatttttctagcatggtgagaactaatatgtaactcctttgattgaaggagctcttttgtccgtacctatcagaatgttttcttgacacttccatgttggctcttctcagctttttttgtacatattttttttttctaaagagaagaaaaagttatcacaaaatgta

SEQ ID NO: 16036 - DNA, 472 bp, Homo sapiens
  ENST00000456287
cagaaagtgagccagatggagctggaatgtagaggactcgtcgtgagcggggagcccacttggtcagctcagtgaaggctctccctcagacgccaacatctacatgcggatatggaagcctggacagtttttgacggtgcagtcttgctatatggtgtgagaaatggctgtaggaaacaacactcaacgaagttattccatcatcccgtgttttatatttgttgagcttgtcatcatggctgggacagtgctgcttgcctactacttcgaatgcactgacacttttcaggtgcatatccaaggattcttctgtcaggacggagacttaatgaagccttacccagggacagaggaagaaagcttcatcacccctctggtgctctattgtgtgctggctgccaccccaactgctattatttttattggtgagatatccatgtatttcataaaatcaacaagagaatccctgatt

SEQ ID NO: 16037 - DNA, 1086 bp, Homo sapiens
  ENST00000494890
aattctctaggttgcaaattgggaggattaggaacaagtaagagagatccatgcaggatggacaagaaaaaaaagttttataccaaaaattgtatttcatggcattagggcagtctactggggtaaggcactatgcagtactaggcaattagaattctattcactagctatgtgcacaagcggctcctgacctggtcattttggctgtaaaactattcatgcctggacagtttttgacggtgcagtcttgctatatggtgtgagaaatggctgtaggaaacaacactcaacgaagttattccatcatcccgtgttttatatttgttgaggaggaagcaaccctcaaagtgagatgtttaatttattgctggaagctgtagtctccgaagattttcagctctctaatgtgtgaatgaagagcttggccggtggagcagcaacaaaggagataaattagttcttctgtagcttaccctgacacaaacataaatagaagtctaaaaatctgggagaggaaagatggtttattctttttcttgttgtattgttgttcttattttgcatggaaattctcttagaactgtcttagaaataggcaggcaaaagggaagggaagtaggacacagaagacattgagtgggaaggaggtgaatctcaaagtggctctcatgattctcatgtatttcattcaccaaacacttattgtttacctatattattccaggtactataacaaggatatcacaaaacttggtaaaaaatgtcaacttgaccaatgaatatcttttcactgtttttttaattatgaaagaatttaatcacagaaaataactgacatccctgcacctaccatcaagacaaaatcttaaagttttgtcatatttgcttcaaatatttttgtcaaggaaaataaaatgttacagatatggccaaaatcctattgtcctgaagccagaagtcattatatgtatgaagtttggggcttcttttccctacatgtttcccatgcatggtttatattttcctacatatgtatatattcataaatattttaggaaaattttacataaatgacactatgctgaa

SEQ ID NO: 16038 - DNA, 2318 bp, Homo sapiens
  ENST00000395056
aattctctaggttgcaaattgggaggattaggaacaagtaagagagatccatgcaggatggacaagaaaaaaaagttttataccaaaaattgtatttcatggcattagggcagtctactggggtaaggcactatgcagtactaggcaattagaattctattcactagctatgtgcacaagcggctcctgacctggtcattttggctgtaaaactattcatgcctggacagtttttgacggtgcagtcttgctatatggtgtgagaaatggctgtaggaaacaacactcaacgaagttattccatcatcccgtgttttatatttgttgagcttgtcatcatggctgggacagtgctgcttgcctactacttcgaatgcactgacacttttcaggtgcatatccaaggattcttctgtcaggacggagacttaatgaagccttacccagggacagaggaagaaagcttcatcacccctctggtgctctattgtgtgctggctgccaccccaactgctattatttttattggtgagatatccatgtatttcataaaatcaacaagagaatccctgattgctcaggagaaaacaattctgaccggagaatgctgttacctgaaccccttacttcgaaggatcataagattcacaggggtgtttgcatttggactttttgctactgacatttttgtaaacgccggacaagtggtcactgggcacttaacgccatacttcctgactgtgtgcaagccaaactacaccagtgcagactgccaagcgcaccaccagtttataaacaatgggaacatttgtactggggacctggaagtgatagaaaaggctcggagatcctttccctccaaacacgctgctctgagcatttactccgccttatatgccacgatgtatattacaagcacaatcaagacgaagagcagtcgactggccaagccggtgctgtgcctcggaactctctgcacagccttcctgacaggcctcaaccgggtctctgagtatcggaaccactgctcggacgtgattgctggtttcatcctgggcactgcagtggccctgtttctgggaatgtgtgtggttcataactttaaaggaacgcaaggatctccttccaaacccaagcctgaggatccccgtggagtacccctaatggctttcccaaggatagaaagccctctggaaaccttaagtgcacagaatcactctgcgtccatgaccgaagttacctgagacgactgatgtgtcacaagctgttttttaaaatcatcttccaattctatacttcaaaacacacagttgctcaatgtcaaactgtgatgacaaatattacgtttatctagttagaagctaatgttttgtacattttttgtatgaggaagtgatgtagcttgccctgattttttttttttttttttggtcagctttaatatatttatgccagaattttaaaaccaacaaaattttcttgttcaagcgtgcattgaagaaccacatttattcaatggttgacgttgttttgtgatatttgtacacaaattttcttttctcagttttataaacacagaatataacaattcactttaaacttttattaccacagttgctgcctcctccagaatttttgaattttaataaaaggcaaacttttgagctgcaggaaggacaatgttggttaataataaatctcaaagtcaattgtagaaaaaaaattgtcttcaaaaagaatgttgcactctgatctcttaacaaattgttacgttcaaagtttaaagtgatatattaacaaagtcacctagttatacaaacaattgtcagagaattctggatttggagggtattggggttatatgattctttcttagataatggcctctactaaataactcaagatctttctggaatgtcttctggcaggcaggtgccactgtcagcttttctccaaaaagcagccaacatcagcctcccctgtcaactcaacagttttgtatctcatattatatggactttatatgaaaatgaatattttacagtttgcacagtattattttacagaaaaggaatcagagaatctacaacatagggccccagaacaacagtttcactttgtggcttttaattattctagaattttaactgcatctcatttttctagcatggtgagaactaatatgtaactcctttgattgaaggagctcttttgtccgtacctatcagaatgttttcttgacacttccatgttggctcttctcagctttttttgtacatattttttttttctaaagagaagaaaaagttatcacaaaa

SEQ ID NO: 16039 - DNA, 748 bp, Homo sapiens
  ENST00000463206
ggagggagtgtgctctgaggggcaagggctgctccgaagccctgctaatgtctctgtgtggccatgctgtattttcagcttgtcatcatggctgggacagtgctgcttgcctactacttcgaatgcactgacacttttcaggtgcatatccaaggattcttctgtcaggacggagacttaatgaagccttacccagggacagaggaagaaagcttcatcacccctctggtgctctattgtgtgctggctgccaccccaactgctattatttttattggtgagatatccatgtatttcataaaatcaacaagagaatccctgattgctcaggagaaaacaattctgaccggagaatgctgttacctgaaccccttacttcgaaggatcataagattcacaggggtgtttgcatttggactttttgctactgacatttttgtaaacgccggacaagtggtcactgggcacttaacgccatacttcctgactgtgtgcaagccaaactacaccagtgcagactgccaagcgcaccaccagtttataaacaatgggaacatttgtactggggacctggaagtgatagaaaaggctcggagatcctttccctccaaacacgctgctctgagcatttactccgccttatatgccacgatgtatattacaagcacaatcaagacgaagagcagtcgactggccaagccggtgctgtgcctcggaactctctgcacagccttcctgacaggcctca

SEQ ID NO: 16040 - DNA, 2495 bp, Homo sapiens; identical to SEQ ID NO: 16035
  ENST00000611695

SEQ ID NO: 16041 - DNA, 472 bp, Homo sapiens; identical to SEQ ID NO: 16036
  ENST00000633861

SEQ ID NO: 16042 - DNA, 1086 bp, Homo sapiens; identical to SEQ ID NO: 16037
  ENST00000631622

SEQ ID NO: 16043 - DNA, 2318 bp, Homo sapiens; identical to SEQ ID NO: 16038
  ENST00000614834

SEQ ID NO: 16044 - DNA, 748 bp, Homo sapiens; identical to SEQ ID NO: 16039
  ENST00000632580

SEQ ID NO: 16045 - DNA, 5369 bp, Homo sapiens
  ENST00000370185
gagctgtcattcctgggtagcaacaagctgtcagttaatgcctacctcagcctacttttcagtatgggatccaagatctcatttcgtggaggtaggggttggttttcttgctatgggtcagcgcgctggagcagggcttctgatccttagcattctttaatagcattcctagagtgacctaggaggctccccaggaggagactaggtggcttagctcctcagcctaactactgcagaaaccaggagtgcgtcctccttttcggattcttgacgtcaagctccgacagccttggagcgtcgcaagggcggtagagagctgagggagggtgacagggaggggaagccattgcagcaacagcttggaggagggagctggacgtcgtctctcgccagaaaaacggggagcaggagccagactaggggaggaagaggactggcccgctcagggaatagctgggttgctgcaaaaaggggcggggagaaggcgggggcgctgcatgcagcgcgctggctccagcggtggccgcggggaatgtgacatcagcggcgccgggcgcttggggctggaggaggcagctcgcctcagctgcgctgtgcacacctcgcccgggggaggacgcagacccgggcaggcggcagggatgtcggcgaaggagaggccaaagggcaaagtgatcaaggacagcgtcaccctcctgccctgcttttatttcgtcgagttgcctatattggcatcatcggtggttagcctctatttcctcgaactcacagatgtcttcaaacctgtgcactctggatttagctgctatgaccggagtcttagcatgccgtacattgaaccaacccaggaggcaattccattcctcatgttgcttagcttggcttttgctggacctgcaattacgattatggtaggagaaggaattctctactgttgcctctccaaaagaagaaatggggtcggactagagcccaacattaatgctggaggctgcaacttcaattccttcctcagacgagctgtcagattcgttggtgttcatgtatttggattatgctctacagctctcattacagatatcatacagctgtccacaggatatcaagcaccttactttctgactgtgtgcaaaccaaactatacctctctgaatgtatcttgcaaagaaaattcctacattgtggaagatatttgctcaggatctgacctcacagttatcaacagtggcagaaagtccttcccttctcaacatgcaacccttgctgcctttgcagctgtgtatgtttcgatgtacttcaattccacattaacggattcctctaagcttctgaaacctctcttggtcttcacatttatcatctgtggaataatctgcgggctaacacggataactcagtataagaaccacccagttgatgtctattgtggctttttaataggaggaggaattgcactgtacttgggcttgtatgctgtggggaatttcctgcccagtgatgagagtatgtttcagcacagagacgccctcaggtctctgacagacctcaatcaagatcccaaccgacttttatctgctaaaaatggtagcagcagtgatggaattgctcatacagaaggcatcctcaaccgaaaccacagagatgctagctctctgacaaatctcaaaagagcaaatgctgatgtggaaatcattactccacggagccccatggggaaggagaacatggttaccttcagcaataccttgccgcgagccaataccccatctgtagaagaccctgtcagaagaaatgcgagcattcatgcctctatggattccgctcgatcaaagcagctcctcacccagtggaagaataagaatgaaagtcgaaagttgtccttgcaagttatagagcctgagcctgggcagtcaccacccagatccatagaaatgaggtcaagctcagagccatcgagggtaggggtgaatggagaccaccatggtcctggcaatcagtacctcaaaatccagcctggcgctgtccccggatgtaacaacagcatgcctggagggccaagagtgtccattcagtcccgtcctgggtcctcacagttggtgcacatccctgaggagactcaggaaaacataagcacctcccccaaaagcagctctgctcgggccaagtggttaaaagctgctgaaaagactgtggcctgtaacagaagcaacagccagccccgaatcatgcaagtcatagccatgtccaagcagcagggtgtcctccaaagcagccccaagaacactgaaggcagcacggtctcctgcactggctccatccgctataaaaccttgacagaccatgagcccagtgggatagtgagggttgaggctcacccagagaacaacaggcccatcatacagatcccgtccactgaaggtgaaggcagtggctcctggaagtggaaagcccctgaaaagggcagccttcgccaaacttacgagctcaacgatctcaacagggactcagaaagctgtgagtctctgaaagacagctttggttctggagatcgcaagagaagcaacattgatagcaatgagcatcaccaccacggaattaccaccatccgcgtcaccccagtagagggcagcgaaattggctcagagacgctgtccatttcttcttcccgcgactccaccctgcggagaaagggcaatatcattctaatccctgaaagaagcaacagccccgaaaacactagaaatatcttctacaaaggaacctcccccacacgggcttataaggattgagtgatgtccattccatcattagggctactcgcaaaagaccatatgttgattctacctgtgttctgttccagcgaattgggaagtctcaccaagctagattgtctaccatcagcccagaactctgtaacttttcagaactgctatactcaaacttgcagatctcacatcaaggagagggaaaagcacaatgcaagaacctaactaacgtgatgatatgaagagttttcttaagacctgtcgtcaaacttaaaaggttttgcagagggcagtatcaaaagaaagtggttttcttcaaatgtatactattttacttcctgaatgtgccaactttggggatttttctttatagtgagctgtgggaacccagaacacacacgttttccctacagcagaggccatgcagtattatatattcattttgcagaatctgcacctacagctcaatacgggtggtgctgattattatagtacatataccatgtaaactctcaaactctatttagctgtgaaatagtggtgtgcaattccttgttaaagaaatgctactttattaagaagatgctggctgctttgtgttagaataggacaccccgcagcttctctgtagtggctctgtcacagtcaaaaaatgaaaaggtttttgtgcgtttcttcaaaattctgctttcttcaacatcaaaaattgtgtagaaatattttcagtgaaagggaataactagtacttttctgcatagtttttcttctgcttactttttatttaagtataggtactgctaatgaatctgttttcttagtgagtaaatttgcataattttataaatattattttagagaatcttttgaaattgttgtgatcatattttgctttctatggcttctccttaacttattgattaattttttgaagttatagatatgttctcctattttaaaagcaaaaataacaattgacattccttgagcaaaatatactgctgtgaatttgcaaacaagaaatctgagccaaaacttgacattgtgggttacattgccagaaatgttggtcaagtttgcccttagatgtctacaactagctggcataggttgccatcttaacaagtaatctaaaagtcccattcggttctacattattaactttttttttctatatcctgatgaccagtaaattagagccacactggttaagtttgactcgtctctaaaacgtttttgttaattggacaccaagaggaagaatctgaaaaaaaaatgcatgttggtaagtaaaagtatctcacggtacaaattaagaatgactttcttcaaaatatctgaataggtgcagttttagtttaacatgcaaacaaccattgttgctacctatcctgaatcaagccttgagcctaaatcaaagcaaaccaataccattgataagaagaagataaaaacaaaatattttggagtgttttccaacttaaagtatgaagacatactcagttcttggaacttagtattaaaccttttttatgccatttcataagaattccgatatatacttgatgattgccaaggggatgaaaggaaacaacagagatggttgatctgatcttagctcactttccaataacagaaggagttgtttacagatgaatagtatcacatcattatcaatttccacatgaaaaaggtggagctttctagaaaaaccaacctctaaggcattaggaatttagctgaaaccagcagaattgaaaactctggcaataaaacatggactcaaccatatcccttctggcaatttccttctcagagaggggagtgggaataaaatgttgccttccccacttctcaccaccaccgccatcatgacgctcatactggcttttgcctgtttgtagaggaaaaggtgggctggttttagtactctgaaggacaaaaacaagcaaacaaaaacccctgctgcagcatttcaggtgcagtatgatatttcctaatctttcctatttcttaacaaaagattttaaagtacttctctagtcattgaagtttttttttctttacataaatattgatatattctttttctactcaaagtgccaaaggctacagtttttaatgacttaacaaattgtaccacattgttaaggacatataatgatagacactagaactcagacctctgcatgtatatttgataacatgtcttttgtaaaacaaaaattacaaaaaaatttgtttacattccactggtaccttaatttaaaataaatcagactaaaaggtggtatctcttcttagtgttctatttatcttatttgctaatgggagcacttcttcctttgttaggctgtgctttactgataaaaccaagtattgaataaagagagttaattatctttttaaagtaaataaaattatgaaaatatatatagtatatataaagtactgtgtttaaaaaaatgttatgcaatgttttccaaactgataaagtttgtaaagtgctataaatgtattttgttaagtacagataaaagctattgtgtgagtatattgtgctaaaatcatagaaataaagattagatttcttcatcaaaattggaa

SEQ ID NO: 16046 - DNA, 4505 bp, Homo sapiens
  ENST00000370184
cttaagtatctgtttagaagtttaggaattttctatactgtcttcttgaaatcaacttagagaaaatgaacacaatagattttaagatcttaattcactaatgtttaatgaatatgtttgatgctgacacaaccaccaacttggtaacaatttctttcattttgcctataggtgttcatgtatttggattatgctctacagctctcattacagatatcatacagctgtccacaggatatcaagcaccttactttctgactgtgtgcaaaccaaactatacctctctgaatgtatcttgcaaagaaaattcctacattgtggaagatatttgctcaggatctgacctcacagttatcaacagtggcagaaagtccttcccttctcaacatgcaacccttgctgcctttgcagctgtgtatgtttcgatgtacttcaattccacattaacggattcctctaagcttctgaaacctctcttggtcttcacatttatcatctgtggaataatctgcgggctaacacggataactcagtataagaaccacccagttgatgtctattgtggctttttaataggaggaggaattgcactgtacttgggcttgtatgctgtggggaatttcctgcccagtgatgagagtatgtttcagcacagagacgccctcaggtctctgacagacctcaatcaagatcccaaccgacttttatctgctaaaaatggtagcagcagtgatggaattgctcatacagaaggcatcctcaaccgaaaccacagagatgctagctctctgacaaatctcaaaagagcaaatgctgatgtggaaatcattactccacggagccccatggggaaggagaacatggttaccttcagcaataccttgccgcgagccaataccccatctgtagaagaccctgtcagaagaaatgcgagcattcatgcctctatggattccgctcgatcaaagcagctcctcacccagtggaagaataagaatgaaagtcgaaagttgtccttgcaagttatagagcctgagcctgggcagtcaccacccagatccatagaaatgaggtcaagctcagagccatcgagggtaggggtgaatggagaccaccatggtcctggcaatcagtacctcaaaatccagcctggcgctgtccccggatgtaacaacagcatgcctggagggccaagagtgtccattcagtcccgtcctgggtcctcacagttggtgcacatccctgaggagactcaggaaaacataagcacctcccccaaaagcagctctgctcgggccaagtggttaaaagctgctgaaaagactgtggcctgtaacagaagcaacagccagccccgaatcatgcaagtcatagccatgtccaagcagcagggtgtcctccaaagcagccccaagaacactgaaggcagcacggtctcctgcactggctccatccgctataaaaccttgacagaccatgagcccagtgggatagtgagggttgaggctcacccagagaacaacaggcccatcatacagatcccgtccactgaaggtgaaggcagtggctcctggaagtggaaagcccctgaaaagggcagccttcgccaaacttacgagctcaacgatctcaacagggactcagaaagctgtgagtctctgaaagacagctttggttctggagatcgcaagagaagcaacattgatagcaatgagcatcaccaccacggaattaccaccatccgcgtcaccccagtagagggcagcgaaattggctcagagacgctgtccatttcttcttcccgcgactccaccctgcggagaaagggcaatatcattctaatccctgaaagaagcaacagccccgaaaacactagaaatatcttctacaaaggaacctcccccacacgggcttataaggattgagtgatgtccattccatcattagggctactcgcaaaagaccatatgttgattctacctgtgttctgttccagcgaattgggaagtctcaccaagctagattgtctaccatcagcccagaactctgtaacttttcagaactgctatactcaaacttgcagatctcacatcaaggagagggaaaagcacaatgcaagaacctaactaacgtgatgatatgaagagttttcttaagacctgtcgtcaaacttaaaaggttttgcagagggcagtatcaaaagaaagtggttttcttcaaatgtatactattttacttcctgaatgtgccaactttggggatttttctttatagtgagctgtgggaacccagaacacacacgttttccctacagcagaggccatgcagtattatatattcattttgcagaatctgcacctacagctcaatacgggtggtgctgattattatagtacatataccatgtaaactctcaaactctatttagctgtgaaatagtggtgtgcaattccttgttaaagaaatgctactttattaagaagatgctggctgctttgtgttagaataggacaccccgcagcttctctgtagtggctctgtcacagtcaaaaaatgaaaaggtttttgtgcgtttcttcaaaattctgctttcttcaacatcaaaaattgtgtagaaatattttcagtgaaagggaataactagtacttttctgcatagtttttcttctgcttactttttatttaagtataggtactgctaatgaatctgttttcttagtgagtaaatttgcataattttataaatattattttagagaatcttttgaaattgttgtgatcatattttgctttctatggcttctccttaacttattgattaattttttgaagttatagatatgttctcctattttaaaagcaaaaataacaattgacattccttgagcaaaatatactgctgtgaatttgcaaacaagaaatctgagccaaaacttgacattgtgggttacattgccagaaatgttggtcaagtttgcccttagatgtctacaactagctggcataggttgccatcttaacaagtaatctaaaagtcccattcggttctacattattaactttttttttctatatcctgatgaccagtaaattagagccacactggttaagtttgactcgtctctaaaacgtttttgttaattggacaccaagaggaagaatctgaaaaaaaaatgcatgttggtaagtaaaagtatctcacggtacaaattaagaatgactttcttcaaaatatctgaataggtgcagttttagtttaacatgcaaacaaccattgttgctacctatcctgaatcaagccttgagcctaaatcaaagcaaaccaataccattgataagaagaagataaaaacaaaatattttggagtgttttccaacttaaagtatgaagacatactcagttcttggaacttagtattaaaccttttttatgccatttcataagaattccgatatatacttgatgattgccaaggggatgaaaggaaacaacagagatggttgatctgatcttagctcactttccaataacagaaggagttgtttacagatgaatagtatcacatcattatcaatttccacatgaaaaaggtggagctttctagaaaaaccaacctctaaggcattaggaatttagctgaaaccagcagaattgaaaactctggcaataaaacatggactcaaccatatcccttctggcaatttccttctcagagaggggagtgggaataaaatgttgccttccccacttctcaccaccaccgccatcatgacgctcatactggcttttgcctgtttgtagaggaaaaggtgggctggttttagtactctgaaggacaaaaacaagcaaacaaaaacccctgctgcagcatttcaggtgcagtatgatatttcctaatctttcctatttcttaacaaaagattttaaagtacttctctagtcattgaagtttttttttctttacataaatattgatatattctttttctactcaaagtgccaaaggctacagtttttaatgacttaacaaattgtaccacattgttaaggacatataatgatagacactagaactcagacctctgcatgtatatttgataacatgtcttttgtaaaacaaaaattacaaaaaaatttgtttacattccactggtaccttaatttaaaataaatcagactaaaaggtggtatctcttcttagtgttctatttatcttatttgctaatgggagcacttcttcctttgttaggctgtgctttactgataaaaccaagtattgaataaagagagttaattatctttttaaagtaaataaaattatgaaaatatatatagtatatataaagtactgtgtttaaaaaaatgttatgcaatgttttccaaactgataaagtttgtaaagtgctataaatgtattttgttaagtacagataaaagctattgtgtgagtatattgtgctaaaatcatagaaataaagattagatttcttcatcaaaattggaa

SEQ ID NO: 16047 - DNA, 4846 bp, Homo sapiens
  ENST00000457765
gaagccattgcagcaacagcttggaggagggagctggacgtcgtctctcgccagaaaaacggggagcaggagccagactaggggaggaagaggactggcccgctcagggaatagctgggttgctgcaaaaaggggcggggagaaggcgggggcgctgcatgcagcgcgctggctccagcggtggccgcggggaatgtgacatcagcggcgccgggcgcttggggctggaggaggcagctcgcctcagctgcgctgtgcacacctcgcccgggggaggacgcagacccgggcaggcggcagggatgtcggcgaaggagaggccaaagggcaaagtgatcaaggacagcgtcaccctcctgccctgcttttatttcgtcgagttgcctatattggcatcatcggtggttagcctctatttcctcgaactcacagatgtcttcaaacctgtgcactctggatttagctgctatgaccggagtcttagcatgccgtacattgaaccaacccaggaggcaattccattcctcatgttgcttagcttggcttttgctggacctgcaattacgattatggtaggagaaggaattctctactgttgcctctccaaaagaagaaatggggtcggactagagcccaacattaatgctggaggctgcaacttcaattccttcctcagacgagctgtcagattcgttggtgttcatgtatttggattatgctctacagctctcattacagatatcatacagctgtccacaggatatcaagcaccttactttctgactgtgtgcaaaccaaactatacctctctgaatgtatcttgcaaagaaaattcctacattgtggaagatatttgctcaggatctgacctcacagttatcaacagtggcagaaagtccttcccttctcaacatgcaacccttgctgcctttgcagctgtgtatgtttcgggcttgtatgctgtggggaatttcctgcccagtgatgagagtatgtttcagcacagagacgccctcaggtctctgacagacctcaatcaagatcccaaccgacttttatctgctaaaaatggtagcagcagtgatggaattgctcatacagaaggcatcctcaaccgaaaccacagagatgctagctctctgacaaatctcaaaagagcaaatgctgatgtggaaatcattactccacggagccccatggggaaggagaacatggttaccttcagcaataccttgccgcgagccaataccccatctgtagaagaccctgtcagaagaaatgcgagcattcatgcctctatggattccgctcgatcaaagcagctcctcacccagtggaagaataagaatgaaagtcgaaagttgtccttgcaagttatagagcctgagcctgggcagtcaccacccagatccatagaaatgaggtcaagctcagagccatcgagggtaggggtgaatggagaccaccatggtcctggcaatcagtacctcaaaatccagcctggcgctgtccccggatgtaacaacagcatgcctggagggccaagagtgtccattcagtcccgtcctgggtcctcacagttggtgcacatccctgaggagactcaggaaaacataagcacctcccccaaaagcagctctgctcgggccaagtggttaaaagctgctgaaaagactgtggcctgtaacagaagcaacagccagccccgaatcatgcaagtcatagccatgtccaagcagcagggtgtcctccaaagcagccccaagaacactgaaggcagcacggtctcctgcactggctccatccgctataaaaccttgacagaccatgagcccagtgggatagtgagggttgaggctcacccagagaacaacaggcccatcatacagatcccgtccactgaaggtgaaggcagtggctcctggaagtggaaagcccctgaaaagggcagccttcgccaaacttacgagctcaacgatctcaacagggactcagaaagctgtgagtctctgaaagacagctttggttctggagatcgcaagagaagcaacattgatagcaatgagcatcaccaccacggaattaccaccatccgcgtcaccccagtagagggcagcgaaattggctcagagacgctgtccatttcttcttcccgcgactccaccctgcggagaaagggcaatatcattctaatccctgaaagaagcaacagccccgaaaacactagaaatatcttctacaaaggaacctcccccacacgggcttataaggattgagtgatgtccattccatcattagggctactcgcaaaagaccatatgttgattctacctgtgttctgttccagcgaattgggaagtctcaccaagctagattgtctaccatcagcccagaactctgtaacttttcagaactgctatactcaaacttgcagatctcacatcaaggagagggaaaagcacaatgcaagaacctaactaacgtgatgatatgaagagttttcttaagacctgtcgtcaaacttaaaaggttttgcagagggcagtatcaaaagaaagtggttttcttcaaatgtatactattttacttcctgaatgtgccaactttggggatttttctttatagtgagctgtgggaacccagaacacacacgttttccctacagcagaggccatgcagtattatatattcattttgcagaatctgcacctacagctcaatacgggtggtgctgattattatagtacatataccatgtaaactctcaaactctatttagctgtgaaatagtggtgtgcaattccttgttaaagaaatgctactttattaagaagatgctggctgctttgtgttagaataggacaccccgcagcttctctgtagtggctctgtcacagtcaaaaaatgaaaaggtttttgtgcgtttcttcaaaattctgctttcttcaacatcaaaaattgtgtagaaatattttcagtgaaagggaataactagtacttttctgcatagtttttcttctgcttactttttatttaagtataggtactgctaatgaatctgttttcttagtgagtaaatttgcataattttataaatattattttagagaatcttttgaaattgttgtgatcatattttgctttctatggcttctccttaacttattgattaattttttgaagttatagatatgttctcctattttaaaagcaaaaataacaattgacattccttgagcaaaatatactgctgtgaatttgcaaacaagaaatctgagccaaaacttgacattgtgggttacattgccagaaatgttggtcaagtttgcccttagatgtctacaactagctggcataggttgccatcttaacaagtaatctaaaagtcccattcggttctacattattaactttttttttctatatcctgatgaccagtaaattagagccacactggttaagtttgactcgtctctaaaacgtttttgttaattggacaccaagaggaagaatctgaaaaaaaaatgcatgttggtaagtaaaagtatctcacggtacaaattaagaatgactttcttcaaaatatctgaataggtgcagttttagtttaacatgcaaacaaccattgttgctacctatcctgaatcaagccttgagcctaaatcaaagcaaaccaataccattgataagaagaagataaaaacaaaatattttggagtgttttccaacttaaagtatgaagacatactcagttcttggaacttagtattaaaccttttttatgccatttcataagaattccgatatatacttgatgattgccaaggggatgaaaggaaacaacagagatggttgatctgatcttagctcactttccaataacagaaggagttgtttacagatgaatagtatcacatcattatcaatttccacatgaaaaaggtggagctttctagaaaaaccaacctctaaggcattaggaatttagctgaaaccagcagaattgaaaactctggcaataaaacatggactcaaccatatcccttctggcaatttccttctcagagaggggagtgggaataaaatgttgccttccccacttctcaccaccaccgccatcatgacgctcatactggcttttgcctgtttgtagaggaaaaggtgggctggttttagtactctgaaggacaaaaacaagcaaacaaaaacccctgctgcagcatttcaggtgcagtatgatatttcctaatctttcctatttcttaacaaaagattttaaagtacttctctagtcattgaagtttttttttctttacataaatattgatatattctttttctactcaaagtgccaaaggctacagtttttaatgacttaacaaattgtaccacattgttaaggacatataatgatagacactagaactcagacctctgcatgtatatttgataacatgtcttttgtaaaacaaaaattacaaaaaaatttgtttacattccactggtaccttaatttaaaataaatcagactaaaaggtggtatctcttcttagtgttctatttatcttatttgctaatgggagcacttcttcctttgttaggctgtgctttactgataaaaccaagtattgaataaagagagttaattatctttttaaagtaaataaaattatgaaaatatatatagtatatataaagtactgtgtttaaaaaaatgttatgcaatgttttccaaactgataaagtttgtaaagtgctataaatgtattttgttaagtacagataaaagctattgtgtgagtatattgtgctaaaatcatagaaataaagattagatttcttcatc

SEQ ID NO: 16048 - DNA, 3706 bp, Homo sapiens
  ENST00000457734
atgcgcagtggcgcgagcgcagcggctacgcgggcgcggagaggtagccgcagagtggacctgcaggtacttggatctccagtgggagctgccctctcgaaggcaggacagcggtggcggcagatataaagacctgaagatagtcttttctgtccaaagatggaaaacagtactactaccatttctcgggaggagcttgaagaactacaagaggcatttaataaaatagatattgacaatagtgggtatgtcagtgactatgaacttcaagacctgtttaaggaagcaagccttcctctgcctggctacaaggtgcgcgagattgtggagaaaattctatcagttgctgacagcaacaaagatggcaaaatcagttttgaagagtttgtgtcactaatgcaagaattaaaaagcaaagatatcagcaaaacattccgaaaaataattaacaagagggaagggattactgctattggaggaacttcaactatttccagtgagggcacacagcattcttattcagaggaagaaaaagtggcttttgttaactggataaacaaagccctggagaatgaccctgactgtaagcatcttatacccatgaatcccaatgatgatagtcttttcaagtcacttgcagatggcatccttctttgcaaaatgatcaacttatctgaaccagatacaattgatgaaagagccatcaataagaaaaagctcacgccattcactatttctgaaaatttaaacctagctctgaattctgcctcagccattggttgtacagtggtcaacattggtgcatcagatctcaaagaaggaaaacctcacttggtcttgggacttctctggcagatcatcaaagttggcctttttgctgatattgagatttccaggaatgaagctctgattgcattgttaaatgaaggtgaggaactagaggagctgatgaagctttctcccgaggaattactgctgcgatgggtgaactaccatctgaccaatgcaggatggcataccatcagcaacttcagccaagacattaaggactcgagagcctattttcatctgcttaatcagattgcccctaaaggtggggaagatggacctgccattgccattgacctttcaggaattaatgagacaaatgacctgaagcgtgctggactcatgcttcaagaagcagataaactgggctgcaaacagtttgttactcctgcagatgtggtttcaggcaatcctaaacttaatttagcttttgtagctaatttgtttaacacatacccgtgcctgcacaagccgaataataatgacatcgatatgaatttactggaaggagagagcaaggaagagagaacatttcggaactggatgaattccttgggagtcaacccatacattaatcatttgtacagtgaccttgcagatgctttagtgatctttcagctctatgagatgatccgagtgccagtcaactggagccatgtcaacaaacctccttatcctgcccttggagggaacatgaagaagattgaaaactgtaactatgcagtggaacttgggaagaacaaggccaaattctccttggttggcattgctgggcaggacctaaatgaagggaattcaacacttaccctggcattggtatggcagctgatgagaaggtacacattgaatgtgttatcggatcttggagagggtgaaaaagtaaatgatgaaattataattaaatgggtcaatcagactcttaaaagtgcaaacaaaaagacttctatttccagcttcaaggataaatctataagcacaagtttacctgtcctagatttaatagatgccattgcaccaaatgcagttcgtcaagaaatgatcaggagagaaaacttatctgatgaggacaagctgaacaatgctaaatacgccatttcagttgctcgaaagatcggtgcccggatatatgcattacctgatgacctcgtagaagtgaaaccaaagatggttatgacggtgtttgcatgcttaatgggaaaaggactgaacagaataaaataatcatttcatatgattttctgccacattaaacatattgtatgcctcacagtttacaggattctgaaatgtagtgggtgtaaaaccagagattatttgtatgctcaaaatagttatatattcattaatgaattcaatatcctgttcatactagttagagctggtcagcctttttgggtaacacagttaatttaccaactgatacagataatagaatatattcataatcaagctgatacttcatgattaaattatttttgttgcttaaaagtcgtattagacaagactaaatcattcttttttatggttcaaaaaagatgaatacaaacgtttttgcaggttctgctgtgaaatgtggtttgatttttttggtgtgttaattttgatcataaatgcattcatactcataatccagtttaatccttttatttgcttcctccaactatttaaagtggtccaaaaacacttttctgtaagtttctatactgtctaaaaccttatggtgaccagaattgtttattaatatcaaacttttttatatatgagaactaattcttgaataaaccccaaagttcactctcttgtttaagtagcagcagctttttacttaaaatttaattttaactacattgatactttacacatcctagtttggtaacacagctttaactatgtcatgcaacatatatatgttggtaggatgttattagagagatatgtgtgcatatatatttttttgcacctgaatcacccagcttttcataagtggtatgtttaattggtcattcagccaaccatcagtattttccccccacaacatgtgtaacacttttcagtctgtggatatctgatacattaagatttctttttataagtattcattttgaatgtgcatatagttatttgaccccttccaaatacttgtagccaaacattggctagaacatcccaagatatgctgacactgtcctgttagcttcatattatacttgctagtttaggtctctatagaagccctatataatttagaatatgcccactgaatatctttaatagaaagtaacataaagctagtattcaatgtagagtattttcatatgtttttcacagcccgttacaaattggcaatgtttggttaatgtttgtattacttggaaatcgctacagcttggactatttttttctaaatttttagcattagtccatttctgctgctaacaattgaatccagaaatctactttctccatcttccactgttagtgccagtgagcaatactgttgtgcaacaaaaatgtcactttatctcagtgtgaatgagtagtctaaattccctttctaccattgatttaaatatatatattggtaagagagactgcccatgtgtttagaatagaattttttaaatgaaatgatcaacaggtggaatttgaaatatattcttctacaaaagagatttctttcccttttatattttgatgattgttttcttaagattaagatatgttcttgctcttttataagattatttaaattatgtttccctctgattttttttcaccattgtatttactaagttattggatttacatgaaatctggcactttagggtgttctttttctcacagagtatatttaataaaaatgctgtgtatatagaaa

SEQ ID NO: 16049 - DNA, 608 bp, Homo sapiens
  ENST00000483373
gcgggcgcggagaggtagccgcagagtggacctgcaggtacttggatctccagtgggagctgccctctcgaaggcaggacagcggtggcggcagagacagagtctccctgtgttgcccaggctggtcttgaactcctggcctcaagcaatccacctgccttggcctcccaaagtgctgcaattacagggaaggccagcgttggattgtgtaggttgcaaaatgcagtacctcagacttgcaactctgaaaagcactgtttgaaatctctgtaaagagtgaaaaacttcaagttttaaccaatgagtgttttagaggttaaagtttaaactctgacttggaagcacgctgggtaggactcctctgctcactcagactcaagttggatcatcagaatctctcttgtgttgctgtgaatgatttgcattgaaattcccagctagaactggaggaaagaggattacaaaccaggagatataaagacctgaagatagtcttttctgtccaaagatggaaaacagtactactaccatttctcgggaggagcttgaagaactacaagaggcatttaataaaatagatattgacaatagtgggtatgtcagtgact

SEQ ID NO: 16050 - DNA, 580 bp, Homo sapiens
  ENST00000475296
gggcgcggagaggtagccgcagagtggacctgcaggtacttggatctccagtgggagctgccctctcgaaggcaggacagcggtggcggcagagacagagtctccctgtgttgcccaggctggtcttgaactcctggcctcaagcaatccacctgccttggcctcccaaagtgctgcaattacagatataaagacctgaagatagtcttttctgtccaaagatggaaaacagtactactaccatttctcgggaggagcttgaagaactacaagaggcatttaataaaatagatattgacaatagtgggtatgtcagtgactatgaacttcaagacctgtttaaggaagcaagccttcctctgcctggctacaaggtgcgcgagattgtggagaaaattctatcagttgctgacagcaacaaagatggcaaaatcagttttgaagagtttgtgtcactaatgcaagaattaaaaagcaaagatatcagcaaaacattccgaaaaataattaacaagagggaagggattactgctattggaggaacttcaactatttccagtgagggcacacagcattctta

SEQ ID NO: 16051 - DNA, 574 bp, Homo sapiens
  ENST00000495744
agccgcagagtggacctgcaggtacttggatctccagtgggagctgccctctcgaaggcaggacagcggtggcggcagggaaggccagcgttggattgtgtaggttgcaaaatgcagtacctcagacttgcaactctgaaaagcactgtttgaaatctctgtaaagagtgaaaaacttcaagttttaaccaatgagtgttttagaggttaaagtttaaactctgacttggaagcacgctgggtaggactcctctgctcactcagactcaagttggatcatcagaatctctcttgtgttgctgtgaatgatttgcattgaaattcccagctagaactggaggaaagaggattacaaaccaggagatataaagacctgaagatagtcttttctgtccaaagatggaaaacagtactactaccatttctcgggaggagcttgaagaactacaagaggcatttaataaaatagatattgacaatagtgggtatgtcagtgactatgaacttcaagacctgtttaaggaagcaagccttcctctgcctggctacaaggtgcgcgagattgtggagaaaa

SEQ ID NO: 16052 - DNA, 1038 bp, Homo sapiens
  ENST00000476044
agagtggacctgcaggtacttggatctccagtgggagctgccctctcgaaggcaggacagcggtggcggcagatattgacaatagtgggtatgtcagtgactatgaacttcaagacctgtttaaggaagcaagccttcctctgcctggctacaaggtgcgcgagattgtggagaaaattctatcagttgctgacagcaacaaagatggcaaaatcagttttgaagagtttgtgtcactaatgcaagaattaaaaagcaaagatatcagcaaaacattccgaaaaataattaacaagagggaagggattactgctattggaggaacttcaactatttccagtgagggcacacagcattcttattcagaggaagaaaaagtggcttttgttaactggataaacaaagccctggagaatgaccctgactgtaagcatcttatacccatgaatcccaatgatgatagtcttttcaagtcacttgcagatggcatccttctttgcaaaatgatcaacttatctgaaccagatacaattgatgaaagagccatcaataagaaaaagctcacgccattcactatttctgaaaatttaaacctagctctgaattctgcctcagccattggttgtacagtggtcaacattggtgcatcagatctcaaagaaggaaaacctcacttggtcttgggacttctctggcagatcatcaaagttggcctttttgctgatattgagatttccaggaatgaagctctgattgcattgttaaatgaaggtgaggaactagaggagctgatgaagctttctcccgaggaattactgctgcgatgggtgaactaccatctgaccaatgcaggatggcataccatcagcaacttcagccaagacattaaggactcgagagcctattttcatctgcttaatcagattgcccctaaaggtggggaagatggacctgccattgccattgacctttcaggaattaatgagacaaatgacctgaagcgtgctggactcatgcttcaagaagcagataaactgg

SEQ ID NO: 16053 - DNA, 567 bp, Homo sapiens
  ENST00000461644
agtggacctgcaggtacttggatctccagtgggagctgccctctcgaaggcaggacagcggtggcggcagccacggtgttggatacacttgtatgaggcttcagctgtgctgcataaatttcttgaagaacctgtgagccagaagcaaaatttcaggacagggggcacacactgaacttgaagaaacattttccaagatgctaaaagtatggcttctactcatttttcccaaaaactgaagtaaaatgctaaaaagaatccatgtcatctgccagatttccaaaggctgtttttgagttcttctctaagatgttttcctccataaatgtgtacagcattaaagaagcccctgcagcatcttggagataatataaagacctgaagatagtcttttctgtccaaagatggaaaacagtactactaccatttctcgggaggagcttgaagaactacaagaggcatttaataaaatagatattgacaatagtgggtatgtcagtgactatgaacttcaagacctgtttaaggaagcaagccttcctctgcctggctacaaggtgcgcgaga

SEQ ID NO: 16054 - DNA, 564 bp, Homo sapiens
  ENST00000464320
acttggatctccagtgggagctgccctctcgaaggcaggacagcggtggcggcagccacggtgttggatacacttgtatgaggcttcagctgtgctgcataaatttcttgaagaacctgtgagccagaagcaaaatttcaggacagggggcacacactgaacttgaaatataaagacctgaagatagtcttttctgtccaaagatggaaaacagtactactaccatttctcgggaggagcttgaagaactacaagaggcatttaataaaatagatattgacaatagtgggtatgtcagtgactatgaacttcaagacctgtttaaggaagcaagccttcctctgcctggctacaaggtgcgcgagattgtggagaaaattctatcagttgctgacagcaacaaagatggcaaaatcagttttgaagagtttgtgtcactaatgcaagaattaaaaagcaaagatatcagcaaaacattccgaaaaataattaacaagagggaagggattactgctattggaggaacttcaactatttccagtgagggcacacagcattcttatt

SEQ ID NO: 16055 - DNA, 3755 bp, Homo sapiens
  ENST00000337777
atcaagattaatatctgtagtaataggcagaacacttcagtgtggaattgcttcttttctttggtcaaacactaactttggcagaggatagacacagcttaggaagactgaattttaagtcttctgaattgtttttctggacttccaaatctcaagtgataagaccagcagaagcagatataaagacctgaagatagtcttttctgtccaaagatggaaaacagtactactaccatttctcgggaggagcttgaagaactacaagaggcatttaataaaatagatattgacaatagtgggtatgtcagtgactatgaacttcaagacctgtttaaggaagcaagccttcctctgcctggctacaaggtgcgcgagattgtggagaaaattctatcagttgctgacagcaacaaagatggcaaaatcagttttgaagagtttgtgtcactaatgcaagaattaaaaagcaaagatatcagcaaaacattccgaaaaataattaacaagagggaagggattactgctattggaggaacttcaactatttccagtgagggcacacagcattcttattcagaggaagaaaaagtggcttttgttaactggataaacaaagccctggagaatgaccctgactgtaagcatcttatacccatgaatcccaatgatgatagtcttttcaagtcacttgcagatggcatccttctttgcaaaatgatcaacttatctgaaccagatacaattgatgaaagagccatcaataagaaaaagctcacgccattcactatttctgaaaatttaaacctagctctgaattctgcctcagccattggttgtacagtggtcaacattggtgcatcagatctcaaagaaggaaaacctcacttggtcttgggacttctctggcagatcatcaaagttggcctttttgctgatattgagatttccaggaatgaagctctgattgcattgttaaatgaaggtgaggaactagaggagctgatgaagctttctcccgaggaattactgctgcgatgggtgaactaccatctgaccaatgcaggatggcataccatcagcaacttcagccaagacattaaggactcgagagcctattttcatctgcttaatcagattgcccctaaaggtggggaagatggacctgccattgccattgacctttcaggaattaatgagacaaatgacctgaagcgtgctggactcatgcttcaagaagcagataaactgggctgcaaacagtttgttactcctgcagatgtggtttcaggcaatcctaaacttaatttagcttttgtagctaatttgtttaacacatacccgtgcctgcacaagccgaataataatgacatcgatatgaatttactggaaggagagagcaaggaagagagaacatttcggaactggatgaattccttgggagtcaacccatacattaatcatttgtacagtgaccttgcagatgctttagtgatctttcagctctatgagatgatccgagtgccagtcaactggagccatgtcaacaaacctccttatcctgcccttggagggaacatgaagaagattgaaaactgtaactatgcagtggaacttgggaagaacaaggccaaattctccttggttggcattgctgggcaggacctaaatgaagggaattcaacacttaccctggcattggtatggcagctgatgagaaggtacacattgaatgtgttatcggatcttggagagggtgaaaaagtaaatgatgaaattataattaaatgggtcaatcagactcttaaaagtgcaaacaaaaagacttctatttccagcttcaaggataaatctataagcacaagtttacctgtcctagatttaatagatgccattgcaccaaatgcagttcgtcaagaaatgatcaggagagaaaacttatctgatgaggacaagctgaacaatgctaaatacgccatttcagttgctcgaaagatcggtgcccggatatatgcattacctgatgacctcgtagaagtgaaaccaaagatggttatgacggtgtttgcatgcttaatgggaaaaggactgaacagaataaaataatcatttcatatgattttctgccacattaaacatattgtatgcctcacagtttacaggattctgaaatgtagtgggtgtaaaaccagagattatttgtatgctcaaaatagttatatattcattaatgaattcaatatcctgttcatactagttagagctggtcagcctttttgggtaacacagttaatttaccaactgatacagataatagaatatattcataatcaagctgatacttcatgattaaattatttttgttgcttaaaagtcgtattagacaagactaaatcattcttttttatggttcaaaaaagatgaatacaaacgtttttgcaggttctgctgtgaaatgtggtttgatttttttggtgtgttaattttgatcataaatgcattcatactcataatccagtttaatccttttatttgcttcctccaactatttaaagtggtccaaaaacacttttctgtaagtttctatactgtctaaaaccttatggtgaccagaattgtttattaatatcaaacttttttatatatgagaactaattcttgaataaaccccaaagttcactctcttgtttaagtagcagcagctttttacttaaaatttaattttaactacattgatactttacacatcctagtttggtaacacagctttaactatgtcatgcaacatatatatgttggtaggatgttattagagagatatgtgtgcatatatatttttttgcacctgaatcacccagcttttcataagtggtatgtttaattggtcattcagccaaccatcagtattttccccccacaacatgtgtaacacttttcagtctgtggatatctgatacattaagatttctttttataagtattcattttgaatgtgcatatagttatttgaccccttccaaatacttgtagccaaacattggctagaacatcccaagatatgctgacactgtcctgttagcttcatattatacttgctagtttaggtctctatagaagccctatataatttagaatatgcccactgaatatctttaatagaaagtaacataaagctagtattcaatgtagagtattttcatatgtttttcacagcccgttacaaattggcaatgtttggttaatgtttgtattacttggaaatcgctacagcttggactatttttttctaaatttttagcattagtccatttctgctgctaacaattgaatccagaaatctactttctccatcttccactgttagtgccagtgagcaatactgttgtgcaacaaaaatgtcactttatctcagtgtgaatgagtagtctaaattccctttctaccattgatttaaatatatatattggtaagagagactgcccatgtgtttagaatagaattttttaaatgaaatgatcaacaggtggaatttgaaatatattcttctacaaaagagatttctttcccttttatattttgatgattgttttcttaagattaagatatgttcttgctcttttataagattatttaaattatgtttccctctgattttttttcaccattgtatttactaagttattggatttacatgaaatctggcactttagggtgttctttttctcacagagtatatttaataaaaatgctgtgtatat

SEQ ID NO: 16056 - DNA, 635 bp, Homo sapiens
  ENST00000497199
aataggcagaacacttcagtgtggaattgcttcttttctttggtcaaacactaactttggcagaggatagacacagcttaggaagactgaattttaagtcttctgaattgtttttctggacttccaaatctcaagtgataagaccagcagaagcagggaaggccagcgttggattgtgtaggttgcaaaatgcagtacctcagacttgcaactctgaaaagcactgtttgaaatctctgtaaagagtgaaaaacttcaagttttaaccaatgagtgttttagaggttaaagtttaaactctgacttggaagcacgctgggtaggactcctctgctcactcagactcaagttggatcatcagaatctctcttgtgttgctgtgaatgatttgcattgaaattcccagctagaactggaggaaagaggattacaaaccaggagatataaagacctgaagatagtcttttctgtccaaagatggaaaacagtactactaccatttctcgggaggagcttgaagaactacaagaggcatttaataaaatagatattgacaatagtgggtatgtcagtgactatgaacttcaagacctgtttaaggaagcaagccttcctctgcctggctacaaggtgcg

SEQ ID NO: 16057 - DNA, 2258 bp, Homo sapiens
  ENST00000497002
aattctccataggaacactatcaagtctttttccataaaagtcagataaaagaaagatcacatttcttgatattctttgaagcaactttatttttattgtcatgcttcatcctgcccgaatactgccaagtctttctcaggcacctggaatctgctcctcagcctctgttgtcctgggtctaatgtagagcaaaaggctgagaggaagctcttctattctccatcatcggtcttcagtggctacctgggaaacaccccttggcttagtcggcagattctctccgatataaagacctgaagatagtcttttctgtccaaagatggaaaacagtactactaccatttctcgggaggagcttgaagaactacaagaggcatttaataaaatagatattgacaatagtgggtatgtcagtgactatgaacttcaagacctgtttaaggaagcaagccttcctctgcctggctacaaggtgcgcgagattgtggagaaaattctatcagttgctgacagcaacaaagatggcaaaatcagttttgaagagtttgtgtcactaatgcaagaattaaaaagcaaagatatcagcaaaacattccgaaaaataattaacaagagggaagggattactgctattggaggaacttcaactatttccagtgagggcacacagcattcttattcagaggaagaaaaagtggcttttgttaactggataaacaaagccctggagaatgaccctgactgtaagcatcttatacccatgaatcccaatgatgatagtcttttcaagtcacttgcagatggcatccttctttgcaaaatgatcaacttatctgaaccagatacaattgatgaaagagccatcaataagaaaaagctcacgccattcactatttctgaaaatttaaacctagctctgaattctgcctcagccattggttgtacagtggtcaacattggtgcatcagatctcaaagaaggaaaacctcacttggtcttgggacttctctggcagatcatcaaagttggcctttttgctgatattgagatttccaggaatgaagctctgattgcattgttaaatgaaggtgaggaactagaggagctgatgaagctttctcccgaggaattactgctgcgatgggtgaactaccatctgaccaatgcaggatggcataccatcagcaacttcagccaagacattaaggactcgagagcctattttcatctgcttaatcagattgcccctaaaggtggggaagatggacctgccattgccattgacctttcaggaattaatgagacaaatgacctgaagcgtgctggactcatgcttcaagaagcagataaactgggctgcaaacagtttgttactcctgcagatgtggtttcaggcaatcctaaacttaatttagcttttgtagctaatttgtttaacacatacccgtgcctgcacaagccgaataataatgacatcgatatgaatttactggaaggagagagcaaggaagagagaacatttcggaactggatgaattccttgggagtcaacccatacattaatcatttgtacagtgaccttgcagatgctttagtgatctttcagctctatgagatgatccgagtgccagtcaactggagccatgtcaacaaacctccttatcctgcccttggagggaacatgaagaagattgaaaactgtaactatgcagtggaacttgggaagaacaaggccaaattctccttggttggcattgctgggcaggacctaaatgaagggaattcaacacttaccctggcattggtatggcagctgatgagaaggtacacattgaatgtgttatcggatcttggagagggtgaaaaagtaaatgatgaaattataattaaatgggtcaatcagactcttaaaagtgcaaacaaaaagacttctatttccagcttcaaggataaatctataagcacaagtttacctgtcctagatttaatagatgccattgcaccaaatgcagttcgtcaagaaatgatcaggagagaaaacttatctgatgaggacaagctgaacaatgctaaatacgccatttcagttgctcgaaagatcggtgcccggatatatgcattacctgatgacctcgtagaagtgaaaccaaagatggttatgacggtgtttgcatgcttaatgggaaaaggactgaacagaataaaataatcatttcatatgattttctgccacattaaacatattgtatgcctcaca

SEQ ID NO: 16058 - DNA, 403 bp, Homo sapiens
  ENST00000460104
gtacttcctctgtaccttatattgcttagttaaatgtttccaaaggcttcatgctttttttataatattgctttttctagatataaagacctgaagatagtcttttctgtccaaagatggaaaacagtactactaccatttctcgggaggagcttgaagaactacaagaggcatttaataaaatagatattgacaatagtgggtatgtcagtgactatgaacttcaagacctgtttaaggaagcaagccttcctctgcctggctacaaggtgcgcgagattgtggagaaaattctatcagttgctgacagcaacaaagatggcaaaatcagttttgaagagtttgtgtcactaatgcaagaattaaaaagcaaagatatcagcaaaacattccgaaaaataat

SEQ ID NO: 16059 - DNA, 749 bp, Homo sapiens
  ENST00000483507
ctgaagcgtgctggactcatgcttcaagaagcagataaactgggctgcaaacagtttgttactcctgcagatgtggtttcaggcaatcctaaacttaatttagcttttgtagctaatttgtttaacacatacccgtgcctgcacaagccgaataataatgacatcgatatgaatttactggaaggagagagcaaggaagagagaacatttcggaactggatgaattccttgggagtcaacccatacattaatcatttgtacagtgaccttgcagatgctttagtgatctttcagctctatgagatgatccgagtgccagtcaactggagccatgtcaacaaacctccttatcctgcccttggagggaacatgaagaaggtgaatgaaataatggccatggatatattgttattgttctgatatgaaacaaagaatttagagtttcatgaagttatacgtgctctgtccccacaattctgattcagaccaaaatgtgttaagcttaatagcctttttacaagtttgctttaataaatttgaagatgaaggcaatccctctagtcagacactttatataactattttcatctttatcaagtcatagtacttaatgttctttgagatgtcctgtaaatgtattctttttttacaattggtataacgttctgaatgtttattggttatccactcatttattcaacagatatttatcaattacctaatacctatacagtgttatgcaggatgta

SEQ ID NO: 16060 - DNA, 2233 bp, Homo sapiens
  ENST00000342435
gagtcccagttcctctccttaaccaccggacaaacgtctctggagtctctccaatgagcaagaaagcaagtcgggggtaggggaggggcctcacaccagggggtgggcgcagtccctcctccagctccttcaccctccagtagtctcgtgggtccccgagcgccagcgcgggaaccgggaaaaggaaaccgtgttgtgtacgtaagattcaggaaacgaaaccaggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggacatatgagtttttgcatttattaatgaaacttcctttgaaaaactgctttgaattatgatctctgattcattgtccattttactaccaaatattaactaaggccttattaatttttatataaattatatcttgtcctattaaatctagttacaatttatttcatgcataagagctaatgttattttgcaaatgccatatattcaaaaaagctcaaagataattttctttactattatgttcaaataatattcaatatgcatattatctttaaaaagttaaatgtttttttaatcttcaagaaatcatgctacacttaacttctcctagaagctaatctataccataatattttcatattcacaagatattaaattaccaattttcaaattattgttagtaaagaacaaaatgattctctcccaaagaaagacacattttaaatactccttcactctaaaactctggtattataacttttgaaagttaatatttctacatgaaatgtttagctcttacactctatccttcctagaaaatggtaattgagattactcagatattaattaaatacaatatcatatatatattcacagagtataaacctaaataatgatctattagattcaaatatttgaaataaaaacttgatttttttgta

SEQ ID NO: 16061 - DNA, 1384 bp, Homo sapiens
  ENST00000493432
gccccggctctctggaccttgtctcgctcgggagcggaaacagcggcagccagagcataaaatacacaagaggatttttatggaatggctccttgttacaaggaccacataaacccattttgaattattcaaccattgctgaacttcttgaaactgttttaatcatggacaaacaaaactcacagatgaatgcttctcacccggaaacaaacttgccagttgggtatcctcctcagtatccaccgacagcattccaagatagatcagatactgattcatcagcaaattgaacttctggaagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggacatatgagtttttgcatttattaatgaaacttcctttgaaaaactgctttgaattatgatctctgattcattgtccattttactaccaaatattaactaaggccttattaatttttatataaattatatcttgtcctattaaatctagttacaatttatttcatgcataagagctaatgttattttgcaaatgccatatattcaaaaaagctcaaagataattttctttactattatgttcaaataatattcaatatgcatattatctttaaaaagttaaatgtttttttaatcttcaagaaatcatgctacacttaacttctcctagaagctaatctataccataatattttcatattcacaagatattaaattaccaattttcaaattattgttagtaaagaacaaaatgattctctcccaaagaaagacacattttaaatactccttcactctaaaactctggtattataacttttgaaagttaatatttctacatgaaatgtttagctcttacactctatccttcctagaaaatggtaattgagattactcagatattaattaaatacaatatcatatatatattcacagagtataaacctaaataatgatctattagattcaaatatttgaaataaaaacttgatttttttgt

SEQ ID NO: 16062 - DNA, 701 bp, Homo sapiens
  ENST00000463777
agtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaagatagatcagatactgattcatcagcaaattgaacttctggaagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggacatatgagtttttgcatttattaatgaaacttccttt

SEQ ID NO: 16063 - DNA, 1443 bp, Homo sapiens
  ENST00000487389
cttcaccctccagtagtctcgtgggtccccgagcgccagcgcgggaaccgggaaaaggaaaccgtgttgtgtacgtaagattcaggaaacgaaaccaggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggacatatgagtttttgcatttatt

SEQ ID NO: 16064 - DNA, 983 bp, Homo sapiens
  ENST00000468985
agtctagaggcgcagaagaggaagccatcgcctggccccggctctctggaccttgtctcgctcgggagcggaaacagcggcagccagaggaccacataaacccattttgaattattcaaccattgctgaacttcttgaaactgttttaatcatggacaaacaaaactcacagatgaatgcttctcacccggaaacaaacttgccagttgggtatcctcctcagtatccaccgacagcattccaagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcct

SEQ ID NO: 16065 - DNA, 996 bp, Homo sapiens
  ENST00000448787
aaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaagg

SEQ ID NO: 16066 - DNA, 581 bp, Homo sapiens
  ENST00000488253
catcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaagatagatcagatactgattcatcagcaaattgaacttctggaagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaat

SEQ ID NO: 16067 - DNA, 984 bp, Homo sapiens
  ENST00000489775
ggcgcagaagaggaagccatcgcctggccccggctctctggaccttgtctcgctcgggagcggaaacagcggcagccagaggaccacataaacccattttgaattattcaaccattgctgaacttcttgaaactgttttaatcatggacaaacaaaactcacagatgaatgcttctcacccggaaacaaacttgccagttgggtatcctcctcagtatccaccgacagcattccaagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggaggtctgtgatcaattaccagggcactttgtaaaatagttcagcaagaatttctgccctgtcattgaacctttcatcgaacctaggcattatgattattacatttacatatattattttgcctttgtagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagcca

SEQ ID NO: 16068 - DNA, 514 bp, Homo sapiens
  ENST00000483300
ctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttt

SEQ ID NO: 16069 - DNA, 629 bp, Homo sapiens
  ENST00000484560
aaattgttaaatatttcaggaaaactttctgaaatataatttctccgtacaatgaaacagtttttttcatatatctataaatagatacaggagcctccagttatctaatgagggttacatatggtgcataattttaataccatatttgtttcatcttacttcaaatttgaaagtacttttgctataagtttcctaaaagtatttaatacttttttttttcaatttagattaaatctcttgatgaacagtgtgtggttggcaaaatttccaagcactggactggaattttgagagaggcatttacagacgctgataactttggaatccagttccctttagaccttgatgttaaaatgaaagctgtaatgattgtaggcatatgtggaaaaaatttagtgaaacaaggaaactttaccatgactcatagtaattaaattaaaccatctaatataggagtatgaagtacaataagagtgtacattcactcaagtgtgtagacctaactaccaaattacaggaaataattggatataccagtgattctgaaattgccttcacattagaaccacctagggactttaaaaactccaaggactagtccatacctcagttcaactaaatcagaaact

SEQ ID NO: 16070 - DNA, 870 bp, Homo sapiens
  ENST00000478267
gaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgtaagtctgttcttattaatcttgattatagatgctttctctaggttcattctgaaatgattcagtaaagtgtatatttcaaaatgacattttaaaatttata

SEQ ID NO: 16071 - DNA, 340 bp, Homo sapiens
  ENST00000470496
tttgtagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagaatgatgatatcaagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttc

SEQ ID NO: 16072 - DNA, 862 bp, Homo sapiens
  ENST00000462666
gcagctgtgcccggcagtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacag

SEQ ID NO: 16073 - DNA, 701 bp, Homo sapiens
  ENST00000486631
aggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagactcacagatgaatgcttctcacccggaaacaaacttgccagttgggtatcctcctcagtatccaccgacagcattccaagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaac

SEQ ID NO: 16074 - DNA, 1198 bp, Homo sapiens
  ENST00000472349
gttcctctccttaaccaccggacaaacgtctctggagtctctccaatgagcaagaaagcaagtcgggggtaggggaggggcctcacaccagggggtgggcgcagtccctcctccagctccttcaccctccagtagtctcgtgggtccccgagcgccagcgcgggaaccgggaaaaggaaaccgtgttgtgtacgtaagattcaggaaacgaaaccaggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagcataaaatacacaagaggatttttatggaatggctccttgttacaagaactgttttaatcatggacaaacaaaactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctc

SEQ ID NO: 16075 - DNA, 817 bp, Homo sapiens
  ENST00000494568
gttgcgcagcagctgtgcccggcagtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggaggtctgtgatcaattaccagggcactttgtaaaatagttcagcaagaatttctgccctgtcattgaacctttcatcgaacctaggcattatgattattacatttacatatattattt

SEQ ID NO: 16076 - DNA, 480 bp, Homo sapiens
  ENST00000490745
ctcttcccaaaaggctttagaatgtgttcaccatcatgagctgaccaacaatttctaaattcctactcagaaacacagcaaggggaatgcagtcaagcacaaagggcttaaatgaccagataaggctgggctggatgaataaagaggaatatcctatgaatgtgactgtgtagttttagagtatcccgattcaactgttatatttgacttgtggccttgtagacagtgtgttaatgtcagatcttctttttcagaactgttttaatcatggacaaacaaaactcacagatgaatgcttctcacccggaaacaaacttgccagttgggtatcctcctcagtatccaccgacagcattccaagatagatcagatactgattcatcagcaaattgaacttctggaaggtatgtattcattgttttaatcctgtttctataaagagtagaagtttatgcagataaaggcacattgacctccaca

SEQ ID NO: 16077 - DNA, 1257 bp, Homo sapiens
  ENST00000469266
cagtagtctcgtgggtccccgagcgccagcgcgggaaccgggaaaaggaaaccgtgttgtgtacgtaagattcaggaaacgaaaccaggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcaggtaatttcaaagacacaaaatactcataaaaaacagaactgtgcttccagcttgcttaaccagattagcaaatgaataattcaccaaagtctgaaatagcaaaactgtattttctgctaacagattactctaattcttctaggtctggttcaattttaaagcaaaatacaaatgccttagaaaattgtattttctgttatcttaaatacaatctatgataatggccaatagcaaacatttaattagcactgtttcctgcctttgttgtatgcctgatacatgtattaactcatttaatccttattgaaagtctgtgatgtataggtgctacatttttcaaaagaagaaactgaggtccagagaggttatatagctcactctggggtgagaacctaaagagtcaagactgtttttttaatcccgaaactttggtactgagcgaagtgctctttagtctcaatactgaataattgccttataatttggaagaaaatttaaataaagtttattgttgagtttcaataagtggccccaaacaaggggttaatattttatgtataatatgactcacctttttattgtaactaataaaactgcatttttatgatgctgcttttgttctttggaagacctaattttataaatgccattaataaaggagtaaaaagtcc

SEQ ID NO: 16078 - DNA, 415 bp, Homo sapiens
  ENST00000477974
tctagaggcgcagaagaggaagccatcgcctggccccggctctctggaccttgtctcgctcgggagcggaaacagcggcagccagagcataaaatacacaagaggatttttatggaatggctccttgttacaaggtactttgcatttataatcagccacagtcacctcagtttcatcccgtatcttacaagtatgatgtgctgtatactcaaagcctcaccacctgcttgccccacccatttgcttaaatgtatcaattttttctaagcttaacttttaccaaaactggagttcaacagatgaatatttttccttcttagatgttaactaaacatttttaaaggtacaaaatttatgtacaaacataacccaaatgacatggaagttacttgatttgtgacttacctctgtaatg

SEQ ID NO: 16079 - DNA, 3303 bp, Homo sapiens
  ENST00000354952
cgagacggggaagccgcgcgcggggaaggagggtccaggcgtgccggacccgcccccagaacccgcgcctagccctcccttccgcgcgcttactttgtttataacttgaaaaatcctctccgtctcccttccctgcctcctttcctttccctttcctctgccagtacaactagacccggcgtctggcgtccccggtgcccagcattctgcggggcaggcggattaattggaattcttcaaaatgtcaggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagttggacaacatacatgttcttcagcattttgagcctctggaaatgatgacatgttttgaaactaataatagatatgatattaaaaacaactcagaccagatggtttacattgtaaccgaagacacagatgactttaccaggaatgcctatcggacactaaggcccttcgtcctccgggtcactgattgtatgggccgagaaatcatgacaatgcagagacccttcagatgcacctgctgttgcttctgttgcccctctgccagacaagagctggaggtgcagtgtcctcctggtgtcaccattggctttgttgcggaacattggaacctgtgcagggcggtgtacagcatccaaaatgagaagaaagaaaatgtgatgagagttcgtgggccatgctcaacctatggctgtggttcagattctgtttttgaggtcaaatcccttgatggcatatccaacatcggcagtattatccggaagtggaatggtttgttatcagcaatggcagatgctgaccattttgacattcacttcccactagacctggatgtgaagatgaaagccatgatttttggagcttgcttcctcattgacttcatgtattttgaaagatctccaccacaacgttcaagatagagagacacagcaagccatcaactatggttaattttgaaaaatggaaaagttggattgggcttacagtcagcactcagttatttgcaagtgtatttctttgctttgtagagtatttttattgggtgttaactttgacagctgagagtgggcttgcaagaacacaatctaaaagtgtgtttcaattgagtatctctctagtagaataggagttcatcctgaaaagctgtgactcattaacccagtaaacatatacaaagtaagcttaaaacactataaacatgagataagggaaaatgaatccagagttctcatattaataggtagtgaaacaataaggctttttagagcagactttgttggcataaaataacctggcttctatccctaaccctttcctacctttcctctccgtcaacatgtcctcatactgaagacaaacttgtttcaatgatagtcttcatttttaaaaacaaaaaggcaggcagacagaaataatgatgttttcttgcactaagaaggtactacttgtacacatatatcaaaacctcattctgcaaagtttttgaaggtttcaatgggaaatttgattttattacaaaataaaacattttttaatgttaaagtttatatattccatgcttgttttctcattcactggcatggatgatcaggagctgcctatatatgaaggcagaatcagactatcaggaaaggagctggccagggccacagccagtcaagatctctgagcaacttagagacattggtgtcattatatgaagcttgcatttaatacatttatacataatacatttgtacatttaattcataacgtctcttggtcacagatgccttatatataaaataagttgccagatctctaagattgcctagtacacctttgtatctcatttgatgtgatacccagaagagatcattgttttttgtttttgtttttgtttttttcaagaagatccttcgtgatcaccatgctgttctcatggtaagaactggagttatgtttttaaatttggaaatatgacattttatgtagcactttataaaaagtgaaagcgacaaattccaccgctgcttaatactgctttgcttctttttattgacatgatagataaatatgtatctacacagagtaataataataaaacacagtaaacattctatttctctatggtctacagcatgccagtaaataatatgtaggaccaataataaattatcaattacacatttttgtgttaactaattaaaagcatagtgtataagtgagtacactctaattaacttgcttctgttgcactttagttttctacctgcatatggactgcattttttttttttaacacagtcagtatgtagaatgggatgtattcttctgctgctgcttattaaataaagaaagcctgagtgttcttagatggggttattctgagatgagggtcttagcctacagttctttttgaaatgaaaggtgctttgttttttaattatattcatcttttcagggtaaatttgtttttctgagtttctcgtaatgctcatttttacatgctgctactagcttttttttttaaaaaaagtaaaagttgctgctttctaaaatattaattgccttatatttgaaagtgccattgcaatcgtaagtagactatgtatttcctataatgatgtctgatatttaaataggaaatcagacaaacaatattcagaaagtttaagcatataaactttttatttttaacttgcctaaatccctgtattccaaaacctgctgcatcataataaatatatctatatatatttagcataagacgtgatatttttaatttcttttttaaaaaattatatttgtctcttagagttaaaattttctttatataatattgtcatatgtcatagttttaatacaattcacatgatttctatgtttcttaatgatattttgttgtgtaaaattgatcggattgattaaaaaacaaattctctggaatttgtgcgttcatgctttttcgtattctttatggcttttaaataaatatacaatggttaatagt

SEQ ID NO: 16080 - DNA, 2839 bp, Homo sapiens
  ENST00000433593
ataacttgaaaaatcctctccgtctcccttccctgcctcctttcctttccctttcctctgccagtacaactagacccggcgtctggcgtccccggtgcccagcattctgcggggcaggcggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagctggaggtgcagtgtcctcctggtgtcaccattggctttgttgcggaacattggaacctgtgcagggcggtgtacagcatccaaaatgagaagaaagaaaatgtgatgagagttcgtgggccatgctcaacctatggctgtggttcagattctgtttttgaggtcaaatcccttgatggcatatccaacatcggcagtattatccggaagtggaatggtttgttatcagcaatggcagatgctgaccattttgacattcacttcccactagacctggatgtgaagatgaaagccatgatttttggagcttgcttcctcattgacttcatgtattttgaaagatctccaccacaacgttcaagatagagagacacagcaagccatcaactatggttaattttgaaaaatggaaaagttggattgggcttacagtcagcactcagttatttgcaagtgtatttctttgctttgtagagtatttttattgggtgttaactttgacagctgagagtgggcttgcaagaacacaatctaaaagtgtgtttcaattgagtatctctctagtagaataggagttcatcctgaaaagctgtgactcattaacccagtaaacatatacaaagtaagcttaaaacactataaacatgagataagggaaaatgaatccagagttctcatattaataggtagtgaaacaataaggctttttagagcagactttgttggcataaaataacctggcttctatccctaaccctttcctacctttcctctccgtcaacatgtcctcatactgaagacaaacttgtttcaatgatagtcttcatttttaaaaacaaaaaggcaggcagacagaaataatgatgttttcttgcactaagaaggtactacttgtacacatatatcaaaacctcattctgcaaagtttttgaaggtttcaatgggaaatttgattttattacaaaataaaacattttttaatgttaaagtttatatattccatgcttgttttctcattcactggcatggatgatcaggagctgcctatatatgaaggcagaatcagactatcaggaaaggagctggccagggccacagccagtcaagatctctgagcaacttagagacattggtgtcattatatgaagcttgcatttaatacatttatacataatacatttgtacatttaattcataacgtctcttggtcacagatgccttatatataaaataagttgccagatctctaagattgcctagtacacctttgtatctcatttgatgtgatacccagaagagatcattgttttttgtttttgtttttgtttttttcaagaagatccttcgtgatcaccatgctgttctcatggtaagaactggagttatgtttttaaatttggaaatatgacattttatgtagcactttataaaaagtgaaagcgacaaattccaccgctgcttaatactgctttgcttctttttattgacatgatagataaatatgtatctacacagagtaataataataaaacacagtaaacattctatttctctatggtctacagcatgccagtaaataatatgtaggaccaataataaattatcaattacacatttttgtgttaactaattaaaagcatagtgtataagtgagtacactctaattaacttgcttctgttgcactttagttttctacctgcatatggactgcattttttttttttaacacagtcagtatgtagaatgggatgtattcttctgctgctgcttattaaataaagaaagcctgagtgttcttagatggggttattctgagatgagggtcttagcctacagttctttttgaaatgaaaggtgctttgttttttaattatattcatcttttcagggtaaatttgtttttctgagtttctcgtaatgctcatttttacatgctgctactagcttttttttttaaaaaaagtaaaagttgctgctttctaaaatattaattgccttatatttgaaagtgccattgcaatcgtaagtagactatgtatttcctataatgatgtctgatatttaaataggaaatcagacaaacaatattcagaaagtttaagcatataaactttttatttttaacttgcctaaatccctgtattccaaaacctgctgcatcataataaatatatctatatatatttagcataagacgtgatatttttaatttcttttttaaaaaattatatttgtctcttagagttaaaattttctttatataatattgtcatatgtcatagttttaatacaattcacatgatttctatgtttcttaatgatattttgttgtgtaaaattgatcggattgattaaaaaacaaattctctgg

SEQ ID NO: 16081 - DNA, 1442 bp, Homo sapiens
  ENST00000446574
ggccgcggtgcctgcgggcaggcgcggaggttgcgcggcgtcctgcgctagcagttcccggacactgcgctcgcgtcgcatcctcaggtggttgcagaagttccgtggtgtcgggcgcgcgtctgcactgcagacgcagagggtttgggagcgagcagtttcctgcccagggatgggggtcctggctgcacttcacgggggcggccctttcgtttcgctctgcgtgacaggtctcgcttgattgggtttctcatgggtctctggcgtttctacggcgcggctctcacggactcaggccaggccactcgcaggattaattggaattcttcaaaatgtcaggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagttggacaacatacatgttcttcagcattttgagcctctggaaatgatgacatgttttgaaactaataatagatatgatattaaaaacaactcagaccagatggtttacattgtaaccgaagacacagatgactttaccaggaatgcctatcggacactaaggcccttcgtcctccgggtcactgattgtatgggccgagaaatcatgacaatgcagagacccttcagatgcacctgctgttgcttctgttgcccctctgccagacaagagctggaggtgcagtgtcctcctggtgtcaccattggctttgttgcggaacattggaacctgtgcagggcggtgtacagcatccaaaatgagaagaaagaaaatgtgatgagagttcgtgggccatgctcaacctatggctgtggttcagattctgtttttgaggtcaaatcccttgatggcatatccaacatcggcagtattatccggaagtggaatggtttgttatcagcaatggcagatgctgaccattttgacattcacttcccactagacctggatgtgaagatgaaagccatgatttttggagcttgcttcctcattgacttcatgtattttgaaagatctccaccacaacgttcaagatagagagacacagcaagccatcaactatggttaattttgaaaaatggaaaagttggattgggcttacagtcagcactcagttatttgcaagtgtatttctttgctttgtagagtatttttatt

SEQ ID NO: 16082 - DNA, 1375 bp, Homo sapiens
  ENST00000493382
aggcgtgccggacccgcccccagaacccgcgcctagccctcccttccgcgcgcttactttgtttataacttgaaaaatcctctccgtctcccttccctgcctcctttcctttccctttcctctgccagtacaactagacccggcgtctggcgtccccggtgcccagcattctgcggggcaggcggtctcgcttgattgggtttctcatgggtctctggcgtttctacggcgcggctctcacggactcaggccaggccactcgcagcttggagacacatagggcaccgtacaacaaactccagctccagaggattaattggaattcttcaaaatgtcaggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagttggacaacatacatgttcttcagcattttgagcctctggaaatgatgacatgttttgaaactaataatagatatgatattaaaaacaactcagaccagatggtttacattgtaaccgaagacacagatgactttaccaggaatgcctatcggacactaaggcccttcgtcctccgggtcactgattgtatgggccgagaaatcatgacaatgcagagacccttcagatgcacctgctgttgcttctgttgcccctctgccagacaagagctggaggtgcagtgtcctcctggtgtcaccattggctttgttgcggaacattggaacctgtgcagggcggtgtacagcatccaaaatgagaagaaagaaaatgtgatgagagttcgtgggccatgctcaacctatggctgtggttcagattctgtttttgaggtcaaatcccttgatggcatatccaacatcggcagtattatccggaagtggaatggtttgttatcagcaatggcagatgctgaccattttgacattcacttcccactagacctggatgtgaagatgaaagccatgatttttggagcttgcttcctcattgacttcatgtattttgaaagatctccaccacaacgttcaagatagagagacacagcaagccatcaactatggttaattttgaaaaatggaaaagttgga

SEQ ID NO: 16083 - DNA, 807 bp, Homo sapiens
  ENST00000475019
gattaattggaattcttcaaaatgtcaggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagttggacaacatacatgttcttcagcattttgagcctctggaaactggaggtgcagtgtcctcctggtgtcaccattggctttgttgcggaacattggaacctgtgcagggcggtgtacagcatccaaaatgagaagaaagaaaatgtgatgagagttcgtgggccatgctcaacctatggctgtggttcagattctgtttttgaggtgaaactatgtaaaaatagtgtttctgatatttttcctactcatattaacagaccatggaaagatctggttgtagacatttttttttaatgtgaatgaataacatagtgttaggaaagagttaattaaccagttgacatcaaaagattttaaagttattgtgagtagattgaggttttccaaaatgaaagctttttttatgacttcagtacttgataaaaataaaa

SEQ ID NO: 16084 - DNA, 1054 bp, Homo sapiens
  ENST00000460350
cccagaacccgcgcctagccctcccttccgcgcgcttactttgtttataacttgaaaaatcctctccgtctcccttccctgcctcctttcctttccctttcctctgccagtacaactagacccggcgtctggcgtccccggtgcccagcattctgcggggcaggcggtctcgcttgattgggtttctcatgggtctctggcgtttctacggcgcggctctcacggactcaggccaggccactcgcaggattaattggaattcttcaaaatgtcaggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagttggacaacatacatgttcttcagcattttgagcctctggaaatgatgacatgttttgaaactaataatagatatgatattaaaaacaactcagaccagatggtttacattgtaaccgaagacacagatgactttaccaggaatgcctatcggacactaaggcccttcgtcctccgggtcactgattgtatgggccgagaaatcatgacaatgcagagacccttcagatgcacctgctgttgcttctgttgcccctctgccagacaagagctggaggtgcagtgtcctcctggtgtcaccattggctttgttgcggaacattggaacctgtgcagggcggtgtacagcatccaaaatgagaagaaagaaaatgtgatgagagttcgtgggccatgctcaacctatggctgtggttcagattctgtttttgag

SEQ ID NO: 16085 - DNA, 609 bp, Homo sapiens
  ENST00000460885
ctcccttccgcgcgcttactttgtttataacttgaaaaatcctctccgtctcccttccctgcctcctttcctttccctttcctctgccagtacaactagacccggcgtctggcgtccccggtgcccagcattctgcggggcaggcggattaattggaattcttcaaaatgtcaggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagctggaggtgcagtgtcctcctggtgtcaccattggctttgttgcggaacattggaacctgtgcagggcggtgtacagcatccaaaatg

SEQ ID NO: 16086 - DNA, 814 bp, Homo sapiens
  ENST00000476202
gtttataacttgaaaaatcctctccgtctcccttccctgcctcctttcctttccctttcctctgccagtacaactagacccggcgtctggcgtccccggtgcccagcattctgcggggcaggcgcttggagacacatagggcaccgtacaacaaactccagctccagaggattaattggaattcttcaaaatgtcaggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagttggacaacatacatgttcttcagcattttgagcctctggaaatgatgacatgttttgaaactaataatagatatgatattaaaaacaactcagaccagatggtttacattgtaaccgaagacacagatgactttaccaggaatgcctatcggacactaaggcccttcgtcctccgggtcactgattgtatgggccgagaaatcatgacaatgcagagacccttcagatgcacctgctgttgcttctgttgcccctctgccagacaagag

SEQ ID NO: 16087 - DNA, 683 bp, Homo sapiens
  ENST00000481701
gtgtttctcttaagcttgttacattgttttcctcataactgtactatctaacgttaaactttaacatttcttgactttttttaaatctcattctactacaatataaactgcagcacagtaggtggcagagtgtctgtctgcttcattgctgtactctcaacatctgtattagtgcctcgtacataataggtgctcaataagtatttttttaattaatgaagggacaaatgtaaggattaattggaattcttcaaaatgtcaggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagttggacaacatacatgttcttcagcattttgagcctctggaaatgatgacatgttttgaaactaataatagata

SEQ ID NO: 16088 - DNA, 593 bp, Homo sapiens
  ENST00000498625
aacatttcttgactttttttaaatctcattctactacaatataaactgcagcacagtaggtggcagagtgtctgtctgcttcattgctgtactctcaacatctgtattagtgcctcgtacataataggtgctcaataagtatttttttaattaatgaagggacaaatgtaaggtaactggaggttaaaaaaattacagaaatccttacctgtgttactgagtagcaatactatttattatgtatgtattttaaaggcattaacattttttatttttcaggattaattggaattcttcaaaatgtcaggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataac

SEQ ID NO: 16089 - DNA, 3033 bp, Homo sapiens
  ENST00000383083
cgagacggggaagccgcgcgcggggaaggagggtccaggcgtgccggacccgcccccagaacccgcgcctagccctcccttccgcgcgcttactttgtttataacttgaaaaatcctctccgtctcccttccctgcctcctttcctttccctttcctctgccagtacaactagacccggcgtctggcgtccccggtgcccagcattctgcggggcaggcggattaattggaattcttcaaaatgtcaggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagctggaggtgcagtgtcctcctggtgtcaccattggctttgttgcggaacattggaacctgtgcagggcggtgtacagcatccaaaatgagaagaaagaaaatgtgatgagagttcgtgggccatgctcaacctatggctgtggttcagattctgtttttgaggtcaaatcccttgatggcatatccaacatcggcagtattatccggaagtggaatggtttgttatcagcaatggcagatgctgaccattttgacattcacttcccactagacctggatgtgaagatgaaagccatgatttttggagcttgcttcctcattgacttcatgtattttgaaagatctccaccacaacgttcaagatagagagacacagcaagccatcaactatggttaattttgaaaaatggaaaagttggattgggcttacagtcagcactcagttatttgcaagtgtatttctttgctttgtagagtatttttattgggtgttaactttgacagctgagagtgggcttgcaagaacacaatctaaaagtgtgtttcaattgagtatctctctagtagaataggagttcatcctgaaaagctgtgactcattaacccagtaaacatatacaaagtaagcttaaaacactataaacatgagataagggaaaatgaatccagagttctcatattaataggtagtgaaacaataaggctttttagagcagactttgttggcataaaataacctggcttctatccctaaccctttcctacctttcctctccgtcaacatgtcctcatactgaagacaaacttgtttcaatgatagtcttcatttttaaaaacaaaaaggcaggcagacagaaataatgatgttttcttgcactaagaaggtactacttgtacacatatatcaaaacctcattctgcaaagtttttgaaggtttcaatgggaaatttgattttattacaaaataaaacattttttaatgttaaagtttatatattccatgcttgttttctcattcactggcatggatgatcaggagctgcctatatatgaaggcagaatcagactatcaggaaaggagctggccagggccacagccagtcaagatctctgagcaacttagagacattggtgtcattatatgaagcttgcatttaatacatttatacataatacatttgtacatttaattcataacgtctcttggtcacagatgccttatatataaaataagttgccagatctctaagattgcctagtacacctttgtatctcatttgatgtgatacccagaagagatcattgttttttgtttttgtttttgtttttttcaagaagatccttcgtgatcaccatgctgttctcatggtaagaactggagttatgtttttaaatttggaaatatgacattttatgtagcactttataaaaagtgaaagcgacaaattccaccgctgcttaatactgctttgcttctttttattgacatgatagataaatatgtatctacacagagtaataataataaaacacagtaaacattctatttctctatggtctacagcatgccagtaaataatatgtaggaccaataataaattatcaattacacatttttgtgttaactaattaaaagcatagtgtataagtgagtacactctaattaacttgcttctgttgcactttagttttctacctgcatatggactgcattttttttttttaacacagtcagtatgtagaatgggatgtattcttctgctgctgcttattaaataaagaaagcctgagtgttcttagatggggttattctgagatgagggtcttagcctacagttctttttgaaatgaaaggtgctttgttttttaattatattcatcttttcagggtaaatttgtttttctgagtttctcgtaatgctcatttttacatgctgctactagcttttttttttaaaaaaagtaaaagttgctgctttctaaaatattaattgccttatatttgaaagtgccattgcaatcgtaagtagactatgtatttcctataatgatgtctgatatttaaataggaaatcagacaaacaatattcagaaagtttaagcatataaactttttatttttaacttgcctaaatccctgtattccaaaacctgctgcatcataataaatatatctatatatatttagcataagacgtgatatttttaatttcttttttaaaaaattatatttgtctcttagagttaaaattttctttatataatattgtcatatgtcatagttttaatacaattcacatgatttctatgtttcttaatgatattttgttgtgtaaaattgatcggattgattaaaaaacaaattctctggaatttgtgcgttcatgctttttcgtattctttatggcttttaaataaatatacaatggttaatagt

SEQ ID NO: 16090 - DNA, 1731 bp, Homo sapiens
  ENST00000354050
agaccccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttgaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccag

SEQ ID NO: 16091 - DNA, 1530 bp, Homo sapiens
  ENST00000372420
atgtagagggggccaagaaggaagcaggaccagtggatgtgaggcgtggtcgaagaacaacagaaagggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacc

SEQ ID NO: 16092 - DNA, 1743 bp, Homo sapiens
  ENST00000372431
ccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacc

SEQ ID NO: 16093 - DNA, 2255 bp, Homo sapiens
  ENST00000477313
agtccctcgccgagccgcgtggtgcactgaagccggcgtggggaggagagccgatgaaggagaacgctaacatgggggctccaggcagaatctctaatgggagagatttaggacctgagggagccgggagacccgggagcccacggtctggtcggccacctcctctcctccccgggcgcgaggcctaggagaccgcaagccaccctccaagaatgcgcgtgcagtcgttgccgtggcaacgtgcaagcctgcatgggcccaccgctaaaggaaaggggaggttgttgggggtgtgggggctggtcccctggaggtccaaactcatcacgcggcggtagcacgagggaactgggaacgtcccctcccccgtgtcccaaatcctctgggagccagaacgcaagtcgcatcgcctctctgagcctcagtttccacatctgccatatggaggcaagattattggttccaagttccccgaagagttatctggagggtaacgatccaggctagttcccacttatggttggacgtccaaggaatgggtttaagcggctcagataactcctgcgaccccaccccacccccaggcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccacc

SEQ ID NO: 16094 - DNA, 1420 bp, Homo sapiens
  ENST00000420868
gccagaccccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtaccc

SEQ ID NO: 16095 - DNA, 6252 bp, Homo sapiens
  ENST00000315392
agctccccgcctgctcccggaggccgcagcctccagctccgctcgcgctctcgccgctcctgccggctcgcccggccccgcgctccgccgtctcctcgccgcccgcccctccgccagccccggggaccgcgcggccgcagcctgagccagggccccctccctcgtcaggaccggggcagcaagcaggccgggggcaggtccgggcacccaccatgcgaggcgagctctggctcctggtgctggtgctcagggaggctgcccgggcgctgagcccccagcccggagcaggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtctttgtggttcagtgggaccacgtttatctccaaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagaatctcggcgaaggagcatctttgaatatcaccgcatagagctggaccccagcaaggtcaccagcatgtcggccgtggagttcaccccattgccgacctgcctgcagcataggagctgtgacgcctgcatgtcctcagacctgaccttcaactgcagctggtgccatgtcctccagagatgctccagtggctttgaccgctatcgccaggagtggatggactatggctgtgcacaggaggcagagggcaggatgtgcgaggacttccaggatgaggaccacgactcagcctcccctgacacttccttcagcccctatgatggagacctcaccactacctcctcctccctcttcatcgacagcctcaccacagaagatgacaccaagttgaatccctatgcaggaggagacggccttcagaacaacctgtcccccaagacaaagggcactcctgtgcacctgggcaccatcgtgggcatcgtgctggcagtcctcctcgtggcggccatcatcctggctggaatttacatcaatggccaccccacatccaatgctgcgctcttcttcatcgagcgtagacctcaccactggccagccatgaagtttcgcagccaccctgaccattccacctatgcggaggtggagccctcgggccatgagaaggagggcttcatggaggctgagcagtgctgagaacaccaagtctcccctttgaagactttgaggccacagaaaagacagttaaagcaaagaagagaagtgacttttcctggcctctcccagcatgccctgggctgagatgagatggtggtttatggctccagagctgctgctcgcttcgtcagcacaccccgaatattgaagagggggccaaaaaacaaccacatggattttttataggaacaacaacctaatctcatcctgttttgatgcaagggttctcttctgtgtcttgtaaccatgaaacagcagaagaactaacataactaactccatttttgtttaaggggcctttacctattcctgcacctaggctaggataactttagagcactgacataaaacgcaaaaacaggaatcatgccgtttgcaaaactaactctgggattaaaggggaagcatgtaaacagctaactgtttttgttaaagatttataggaatgaggaggtttggctattgtcacatgacagactgttagccaaggacaaagaagttctgcaaacctcccctggacccttgctggtgtccagatgtctgcggttgtcagccccttcctttcccccgacctaaacataaaagacaaggcaaagcccgcataattttaagacggttctttaggacattagtccaccatcttcttggtttgctggctctccgaaataaagtccctttccttgctccaactccttgtctctcaacgtattggctatgacgcagcaagcagaatgaatttggactcagttacaggctgtcaatggtctgctctgtagcagtctcagagcctccccgacccactacctggagatagccagatagccagatgccctgctcctggccacctttaaagcccctgcatatgacacaggttaactaaagtcaagattggggctgctgcattccaggttccctagactcacaagctggtccttggccaggtgcagtggctcacgcctgtaatcccagcactttgggaggctgaggcaggcggatcacctgaagtcagaagtttgagaccagcctggccaacataattaaaatgtctctactaaaaatacaaaaaattagctgggtgtggtgacgcttgcctgtatcccagctactcaggaagctgagacacgagaatcacttgaacctgggaggcagaggttgcagtgagctcagatagtgccactgcactccagcctgggtgacagagcgagactccgtctcaaaaaaaaaaaaagaaagcagatcctcatggctatagagttggcattttagccccagcttctgtagctctgaaagcctaaagaaggtattctctccatctgttaaacacagtatagtggctctcagcccttggggcatgttatcatgggagggaagtcaaataagaggagagaaaagaactcaagggggaaactgcatttttaggctttgctctcttaccttgccctttctactcagaaccaataacttctgcatcaaaacatgttacagcctgcatcaagggctttaccccaacctgcagcccagccttccctgggtgagcttgctatgcgcagccacatttaccatgtggggctccctattctgatggcctgttcggtgccgggtttactcactgccctgttctgatgtcagtgcctgtacatacctccaaaggcaggacttgcctgataaatatttttcctcctctgaactggattttataggcattaaagacaagtcgggtggctagagggctccttgagacatacctagcagggaactgcaggtggattctgttgagaggcaaagcacctgagtggttgggacacaggcagctggcatgggagggactttttttgagacagggtctcactgtgtcgcccagggcaaggatgcccaaagacaccaggttggagaggcacctgccaactacttgctttccctggagcctgcatgtgcctgtggggtggggaggcgtaggggtctacggctgcctgagatgggtgtgcacagtgtgtgaagtacctacctccttgccttgctggactgtcagccagtcgcagggccggccacaagacccatgtctccatctggtcatactccatagctaccaagttaacctgctctaaactttggagaactggatctgtccaataaacgcttatttggccaagcctgatggctcgtgcctgtactcccagcactttgggaggctgaggtgggagggttgcttgagcccaggggtttgagaccagcttgggcaacaacaacaaaaatgccaggtgtggtggggtgcacctgtagtcccagctactagggaggctgagccaggaggatcacttgagcccgggaggttgaggctgcagtggggggtcataatcatgccactgtactccagcctgggtgacagagtgagaccctgtctccgaaaaaaaaaaaaaaaaaaagaacggaaaaagaaatgcttacattgtcagggatcctgtagacaatcattaactctatgagatgcttggttctatttttttgggagactttgtccaagtgttttggcttaagaaatccataggcctctcttggtgacacatctctagtactttttgtcataaacaaacaggccatctgccgccaaatacatccactccccatgccactgacatcctatgggtcagccaggcttgctttgactgaggccgaggcatctggaactttctctgcctgcaggggctagcagcagaggcttcaccgcatcaccaccccttcctccactcctgacattctttcccttcagggatccaaaatggttggccgagctcccagtgggaaaacgtgtgctagagttggggagtgagatgagtggtgctgtccatggaatcaggccacagcaggaactgccccactggccatttgagacacacacaggtggtaaatgctctgctggtgggctgtgcttccctcattcagagagctctgttacagcccactgtgtcctttagaagcttgaaaggaacccaactctttgctgcactgtcctttttcttcctcaaattcagaccctccttccaccggcacccccctactccaccctcagctcttccttgcctggtttatcaagcagagctgaggccccacgtttccaactctgattgtcacttgcatcttcacaaaggataaaccacggagcaactggaaaaccatcagccaagcgttcggatgagtctggttattggtccacccccgaccagattcccttacacttaactcacttctttctttggcaatgaccctcatgacatgtataaatgggtatgactaagaagaggctgtgatctaacatttatttgctgccattttttactctggggagaagcagccccaactcatcactgggaaagaactccccctgcaaaccagctaaatttgataatttaaaccccctgcccctaaaacttctcacagagctggggagttggtggcaactttccaagtcaaggtcttgcttagaaagtccttcactacatggccaggtgcagtggctcacgcctgtagtcccaggtacttgggagcctgaggcaggaggattgcttgagctcaggagttcaaggctgcagagagctatgatcatcccactgcatttgtttaaaaataaatttttaaaatttgtgtgttttatcaggggtctcctgtacagtgtatctgtgtatgtttgtgtgtgtgtttgtatacagccttgtttaatgttttgagcaataagatatgcacacacaggtattttgttgctaaagagattggacaaggttgtagctgtgctcaggcttcagcttggtttgttaaattgagagataaacaatgacaagagctgccagccaaccacactattcaaaaagcaaagtgttcaccactaaagctaaccattcatctggttgcaggcaaggctaaggctctctctcctctagttcctggaacagactcacagattggcatgaagcactgatcaggggctgcactcagactccctggccaagcaaacctacaccagaagagtcagtgtcacagatatgatgcggccaatctctgtctccaaaaacctacctgaacttaatggtagaattcaaagatctggggactgagggcacccagccttctaaaacacaatgtattcatgtgtttagtgtaaactctctgcatggattctcagtgttaataataaaaggaagcattcttttacaactcctgctgtgtgcaaaagaaagtgcaaaggatttggagtggcattccgaagatcaccacacataccttggttctgatggctgctgaactccgacttcttcgctgagacatgactgtgggaacagcctccagctatctgctcatcagaggtgctttcctcaacctcctgcaccacctccaagagaaacagcctaaaaagaaaccccagctgtttacttatattggtctgtaaatccctggaagtaaaccccatgcatttttatctactgtctgaggacatacaataaatctgagaaagtctatgctgtca

SEQ ID NO: 16096 - DNA, 2659 bp, Homo sapiens
  ENST00000394318
gcggccgcagcctgagccagggccccctccctcgtcaggaccggggcagcaagcaggccgggggcaggtccgggcacccaccatgcgaggcgagctctggctcctggtgctggtgctcagggaggctgcccgggcgctgagcccccagcccggagcaggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtctttgtggttcagtgggaccacgtttatctccaaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagaatctcggcgaaggagcatctttgaatatcaccgcatagagctggaccccagcaaggtcaccagcatgtcggccgtggagttcaccccattgccgacctgcctgcagcataggagctgtgacgcctgcatgtcctcagacctgaccttcaactgcagctggtgccatgtcctccagaggtccctcaacaaccaggatgaaaacacgtatgtgaattgcctggattctcagcagtgtcacggcagctcagagtcaaggcgaccttgaggatcactggagctcatgcagtcctgctagcccctacacctactcacatgggcagatgtggccttggtcctggggagctgggtgggaaggaaggcagggatgccacaaataccttcatcttccggggaagtagagggaatgggagtgcctgactacctcagcctggggaccttggctcctcttctcactatcagcagagagctgttactgaacagtgaaaggggaaggcttctttgtcaatcccatcataactctgtccttttggtcctcctgcagatgctccagtggctttgaccgctatcgccaggagtggatggactatggctgtgcacaggaggcagagggcaggatgtgcgaggacttccaggatgaggaccacgactcagcctcccctgacacttccttcagcccctatgatggagacctcaccactacctcctcctccctcttcatcgacagcctcaccacagaagatgacaccaagttgaatccctatgcaggaggagacggccttcagaacaacctgtcccccaagacaaagggcactcctgtgcacctgggcaccatcgtgggcatcgtgctggcagtcctcctcgtggcggccatcatcctggctggaatttacatcaatggccaccccacatccaatgctgcgctcttcttcatcgagcgtagacctcaccactggccagccatgaagtttcgcagccaccctgaccattccacctatgcggaggtggagccctcgggccatgagaaggagggcttcatggaggctgagcagtgctgagaacaccaagtctcccctttgaagactttgaggccacagaaaagacagttaaagcaaagaagagaagtgacttttcctggcctctcccagcatgccctgggctgagatgagatggtggtttatggctccagagctgctgctcgcttcgtcagcacaccccgaatattgaagagggggccaaaaaacaaccacatggattttttataggaacaacaacctaatctcatcctgttttgatgcaagggttctcttctgtgtcttgtaaccatgaaacagcagaagaactaacataactaactccatttttgtttaaggggcctttacctattcctgcacctaggctaggataactttagagcactgacataaaacgcaaaaacaggaatcatgccgtttgcaaaactaactctgggattaaaggggaagcatgtaaacagctaactgtttttgttaaagatttataggaatgaggaggtttggctattgtcacatgacagactgttagccaaggacaaagaagttctgcaaacctcccctggacccttgctggtgtccagatgtctgcggttgtcagccccttcctttcccccgacctaaacataaaagacaaggcaaagcccgcataattttaagacggttctttaggacattagtccaccatcttcttggtttgctggctctccgaaataaagtccctttccttgctccaa

SEQ ID NO: 16097 - DNA, 2859 bp, Homo sapiens
  ENST00000578390
gcggccgcagcctgagccagggccccctccctcgtcaggaccggggcagcaagcaggccgggggcaggtccgggcacccaccatgcgaggcgagctctggctcctggtgctggtgctcagggaggctgcccgggcgctgagcccccagcccggagcaggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtctttgtggttcagtgggaccacgtttatctccaaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagaatctcggcgaaggagcatctttgaatatcaccgcatagagctggaccccagcaaggtcaccagcatgtcggccgtggagttcaccccattgccgacctgcctgcagcataggagctgtgacgcctgcatgtcctcagacctgaccttcaactgcagctggtgccatgtcctccagagtagagatgaggtttcaccgtgttagccaggacagtctcgatctcctgacctcatgatccgcccgcctcggcctcccaaagtactgggattacaggcgtgagccaccacgcccagccgcaagaagcatttttacaaagcattcagcatccttcgcatgagactcacagagcctcagaaagaatatgtaggatagaccccaggtccctcaacaaccaggatgaaaacacgtatgtgaattgcctggattctcagcagtgtcacggcagctcagagtcaaggcgaccttgaggatcactggagctcatgcagtcctgctagcccctacacctactcacatgggcagatgtggccttggtcctggggagctgggtgggaaggaaggcagggatgccacaaataccttcatcttccggggaagtagagggaatgggagtgcctgactacctcagcctggggaccttggctcctcttctcactatcagcagagagctgttactgaacagtgaaaggggaaggcttctttgtcaatcccatcataactctgtccttttggtcctcctgcagatgctccagtggctttgaccgctatcgccaggagtggatggactatggctgtgcacaggaggcagagggcaggatgtgcgaggacttccaggatgaggaccacgactcagcctcccctgacacttccttcagcccctatgatggagacctcaccactacctcctcctccctcttcatcgacagcctcaccacagaagatgacaccaagttgaatccctatgcaggaggagacggccttcagaacaacctgtcccccaagacaaagggcactcctgtgcacctgggcaccatcgtgggcatcgtgctggcagtcctcctcgtggcggccatcatcctggctggaatttacatcaatggccaccccacatccaatgctgcgctcttcttcatcgagcgtagacctcaccactggccagccatgaagtttcgcagccaccctgaccattccacctatgcggaggtggagccctcgggccatgagaaggagggcttcatggaggctgagcagtgctgagaacaccaagtctcccctttgaagactttgaggccacagaaaagacagttaaagcaaagaagagaagtgacttttcctggcctctcccagcatgccctgggctgagatgagatggtggtttatggctccagagctgctgctcgcttcgtcagcacaccccgaatattgaagagggggccaaaaaacaaccacatggattttttataggaacaacaacctaatctcatcctgttttgatgcaagggttctcttctgtgtcttgtaaccatgaaacagcagaagaactaacataactaactccatttttgtttaaggggcctttacctattcctgcacctaggctaggataactttagagcactgacataaaacgcaaaaacaggaatcatgccgtttgcaaaactaactctgggattaaaggggaagcatgtaaacagctaactgtttttgttaaagatttataggaatgaggaggtttggctattgtcacatgacagactgttagccaaggacaaagaagttctgcaaacctcccctggacccttgctggtgtccagatgtctgcggttgtcagccccttcctttcccccgacctaaacataaaagacaaggcaaagcccgcataattttaagacggttctttaggacattagtccaccatcttcttggtttgctggctctccgaaataaagtccctttccttgctccaa

SEQ ID NO: 16098 - DNA, 2605 bp, Homo sapiens
  ENST00000578517
agctggaggtagctgcctatctgattctgtttgagagtccgccaagttgggatttaaattagacatcaagaagaatttacagaccggccttgccttgttccacggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtctttgtggttcagtgggaccacgtttatctccaaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagaatctcggcgaaggagcatctttgaatatcaccgcatagagctggaccccagcaaggtcaccagcatgtcggccgtggagttcaccccattgccgacctgcctgcagcataggagctgtgacgcctgcatgtcctcagacctgaccttcaactgcagctggtgccatgtcctccagaggtccctcaacaaccaggatgaaaacacgtatgtgaattgcctggattctcagcagtgtcacggcagctcagagtcaaggcgaccttgaggatcactggagctcatgcagtcctgctagcccctacacctactcacatgggcagatgtggccttggtcctggggagctgggtgggaaggaaggcagggatgccacaaataccttcatcttccggggaagtagagggaatgggagtgcctgactacctcagcctggggaccttggctcctcttctcactatcagcagagagctgttactgaacagtgaaaggggaaggcttctttgtcaatcccatcataactctgtccttttggtcctcctgcagatgctccagtggctttgaccgctatcgccaggagtggatggactatggctgtgcacaggaggcagagggcaggatgtgcgaggacttccaggatgaggaccacgactcagcctcccctgacacttccttcagcccctatgatggagacctcaccactacctcctcctccctcttcatcgacagcctcaccacagaagatgacaccaagttgaatccctatgcaggaggagacggccttcagaacaacctgtcccccaagacaaagggcactcctgtgcacctgggcaccatcgtgggcatcgtgctggcagtcctcctcgtggcggccatcatcctggctggaatttacatcaatggccaccccacatccaatgctgcgctcttcttcatcgagcgtagacctcaccactggccagccatgaagtttcgcagccaccctgaccattccacctatgcggaggtggagccctcgggccatgagaaggagggcttcatggaggctgagcagtgctgagaacaccaagtctcccctttgaagactttgaggccacagaaaagacagttaaagcaaagaagagaagtgacttttcctggcctctcccagcatgccctgggctgagatgagatggtggtttatggctccagagctgctgctcgcttcgtcagcacaccccgaatattgaagagggggccaaaaaacaaccacatggattttttataggaacaacaacctaatctcatcctgttttgatgcaagggttctcttctgtgtcttgtaaccatgaaacagcagaagaactaacataactaactccatttttgtttaaggggcctttacctattcctgcacctaggctaggataactttagagcactgacataaaacgcaaaaacaggaatcatgccgtttgcaaaactaactctgggattaaaggggaagcatgtaaacagctaactgtttttgttaaagatttataggaatgaggaggtttggctattgtcacatgacagactgttagccaaggacaaagaagttctgcaaacctcccctggacccttgctggtgtccagatgtctgcggttgtcagccccttcctttcccccgacctaaacataaaagacaaggcaaagcccgcataattttaagacggttctttaggacattagtccaccatcttcttggtttgctggctctccgaaataaagtccctttccttgctccaa

SEQ ID NO: 16099 - DNA, 2602 bp, Homo sapiens
  ENST00000493200
ctcaagcaaaacctcctggcttgtacatcaccatagcaggccccaggaatgcgagggaccctgtgtcagggcagggaccccatcatccaagacagttggcagggagagtgcaagacctgcctggtttctacaaccttccaaaggaggcagctcccgaaagaaggttttcagaacgcagggccttgggagacaggaagccagtcagactcctcgcacaaaccacagggggcaagcagtgctcctccaagaacctggccccaccagggtgctcaagggaacgaggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtctttgtggttcagtgggaccacgtttatctccaaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagaatctcggcgaaggagcatctttgaatatcaccgcatagagctggaccccagcaaggtcaccagcatgtcggccgtggagttcaccccattgccgacctgcctgcagcataggagctgtgacgcctgcatgtcctcagacctgaccttcaactgcagctggtgccatgtcctccagaggtccctcaacaaccaggatgaaaacacgtatgtgaattgcctggattctcagcagtgtcacggcagctcagagtcaaggcgaccttgaggatcactggagctcatgcagtcctgctagcccctacacctactcacatgggcagatgtggccttggtcctggggagctgggtgggaaggaaggcagggatgccacaaataccttcatcttccggggaagtagagggaatgggagtgcctgactacctcagcctggggaccttggctcctcttctcactatcagcagagagctgttactgaacagtgaaaggggaaggcttctttgtcaatcccatcataactctgtccttttggtcctcctgcagatgctccagtggctttgaccgctatcgccaggagtggatggactatggctgtgcacaggaggcagagggcaggatgtgcgaggacttccaggatgaggaccacgactcagcctcccctgacacttccttcagcccctatgatggagacctcaccactacctcctcctccctcttcatcgacagcctcaccacagaagatgacaccaagttgaatccctatgcaggaggagacggccttcagaacaacctgtcccccaagacaaagggcactcctgtgcacctgggcaccatcgtgggcatcgtgctggcagtcctcctcgtggcggccatcatcctggctggaatttacatcaatggccaccccacatccaatgctgcgctcttcttcatcgagcgtagacctcaccactggccagccatgaagtttcgcagccaccctgaccattccacctatgcggaggtggagccctcgggccatgagaaggagggcttcatggaggctgagcagtgctgagaacaccaagtctcccctttgaagactttgaggccacagaaaagacagttaaagcaaagaagagaagtgacttttcctggcctctcccagcatgccctgggctgagatgagatggtggtttatggctccagagctgctgctcgcttcgtcagcacaccccgaatattgaagagggggccaaaaaacaaccacatggattttttataggaacaacaacctaatctcatcctgttttgatgcaagggttctcttctgtgtcttgtaaccatgaaacagcagaagaactaacataactaactccatttttgtttaaggggcctttacctattcctgcacctaggctaggataactttagagcactgacataaaacgcaaaaacaggaatcatgccgtttgcaaaactaactctgggattaaaggggaagcatgtaaacagctaactgtttttgttaaagatttataggaatgaggaggtttggctattgtcacatgacagactgttagccaaggacaaagaagttctgcaaacctcccctggacccttgctggtgtccagatgtctgcggttgtcagccccttcctttcccccgacctaaacataaaagacaaggcaaagcccgcataattttaagacggttctttaggacattagtccaccatcttcttggtttgctggctctccgaaataaagtccctttccttgctcc

SEQ ID NO: 16100 - DNA, 2726 bp, Homo sapiens
  ENST00000461225
aagacagaccacgaggtaccccagatggaggaatgtgcaaagacgccggggctggagctggaatccgtcccgagacttctcaccttgacctcgaggaaggcaggaggtcggagacagggggtgggcaggctggggaaagaggaaacccgcaggacaagagggttgtggctcgtcacgtggccacttgagggcagcaagtagctgcagctggaggtagctgcctatctgattctgtttgagagtccgccaagttgggatttaaattagacatcaagaagaatttacagaccggccttgccttgttccacggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtctttgtggttcagtgggaccacgtttatctccaaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagaatctcggcgaaggagcatctttgaatatcaccgcatagagctggaccccagcaaggtcaccagcatgtcggccgtggagttcaccccattgccgagtccctcaacaaccaggatgaaaacacgtatgtgaattgcctggattctcagcagtgtcacggcagctcagagtcaaggcgaccttgaggatcactggagctcatgcagtcctgctagcccctacacctactcacatgggcagatgtggccttggtcctggggagctgggtgggaaggaaggcagggatgccacaaataccttcatcttccggggaagtagagggaatgggagtgcctgactacctcagcctggggaccttggctcctcttctcactatcagcagagagctgttactgaacagtgaaaggggaaggcttctttgtcaatcccatcataactctgtccttttggtcctcctgcagatgctccagtggctttgaccgctatcgccaggagtggatggactatggctgtgcacaggaggcagagggcaggatgtgcgaggacttccaggatgaggaccacgactcagcctcccctgacacttccttcagcccctatgatggagacctcaccactacctcctcctccctcttcatcgacagcctcaccacagaagatgacaccaagttgaatccctatgcaggaggagacggccttcagaacaacctgtcccccaagacaaagggcactcctgtgcacctgggcaccatcgtgggcatcgtgctggcagtcctcctcgtggcggccatcatcctggctggaatttacatcaatggccaccccacatccaatgctgcgctcttcttcatcgagcgtagacctcaccactggccagccatgaagtttcgcagccaccctgaccattccacctatgcggaggtggagccctcgggccatgagaaggagggcttcatggaggctgagcagtgctgagaacaccaagtctcccctttgaagactttgaggccacagaaaagacagttaaagcaaagaagagaagtgacttttcctggcctctcccagcatgccctgggctgagatgagatggtggtttatggctccagagctgctgctcgcttcgtcagcacaccccgaatattgaagagggggccaaaaaacaaccacatggattttttataggaacaacaacctaatctcatcctgttttgatgcaagggttctcttctgtgtcttgtaaccatgaaacagcagaagaactaacataactaactccatttttgtttaaggggcctttacctattcctgcacctaggctaggataactttagagcactgacataaaacgcaaaaacaggaatcatgccgtttgcaaaactaactctgggattaaaggggaagcatgtaaacagctaactgtttttgttaaagatttataggaatgaggaggtttggctattgtcacatgacagactgttagccaaggacaaagaagttctgcaaacctcccctggacccttgctggtgtccagatgtctgcggttgtcagccccttcctttcccccgacctaaacataaaagacaaggcaaagcccgcataattttaagacggttctttaggacattagtccaccatcttcttggtttgctggctctccgaaataaagtccctttccttgctcc

SEQ ID NO: 16101 - DNA, 2082 bp, Homo sapiens
  ENST00000444911
ctcctggaaaatttctccaatggcgctcagcgttcgcacccttcctctccgcggttttctagtccctaggccccagcccactagaagccaggatgccccctcaccccgtctcccactctccagcgccccagctccttgccgtcacaagaacgaagaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtctttgtggttcagtgggaccacgtttatctccaaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagaatctcggcgaaggagcatctttgaatatcaccgcatagagctggaccccagcaaggtcaccagcatgtcggccgtggagttcaccccattgccgacctgcctgcagcataggagctgtgacgcctgcatgtcctcagacctgaccttcaactgcagctggtgccatgtcctccagagatgctccagtggctttgaccgctatcgccaggagtggatggactatggctgtgcacaggaggcagagggcaggatgtgcgaggacttccaggatgaggaccacgactcagcctcccctgacacttccttcagcccctatgatggagacctcaccactacctcctcctccctcttcatcgacagcctcaccacagaagatgacaccaagttgaatccctatgcaggaggagacggccttcagaacaacctgtcccccaagacaaagggcactcctgtgcacctgggcaccatcgtgggcatcgtgctggcagtcctcctcgtggcggccatcatcctggctggaatttacatcaatggccaccccacatccaatgctgcgctcttcttcatcgagcgtagacctcaccactggccagccatgaagtttcgcagccaccctgaccattccacctatgcggaggtggagccctcgggccatgagaaggagggcttcatggaggctgagcagtgctgagaacaccaagtctcccctttgaagactttgaggccacagaaaagacagttaaagcaaagaagagaagtgacttttcctggcctctcccagcatgccctgggctgagatgagatggtggtttatggctccagagctgctgctcgcttcgtcagcacaccccgaatattgaagagggggccaaaaaacaaccacatggattttttataggaacaacaacctaatctcatcctgttttgatgcaagggttctcttctgtgtcttgtaaccatgaaacagcagaagaactaacataactaactccatttttgtttaaggggcctttacctattcctgcacctaggctaggataactttagagcactgacataaaacgcaaaaacaggaatcatgccgtttgcaaaactaactctgggattaaaggggaagcatgtaaacagctaactgtttttgttaaagatttataggaatgaggaggtttggctattgtcacatgacagactgttagccaaggacaaagaagttctgcaaacctcccctggacccttgctggtgtccagatgtctgcggttgtcagccccttcctttcccccgacctaaacataaaagacaaggcaaagcccgcataattttaagacggttctttaggacattagtccaccatcttcttggtttgctggctc

SEQ ID NO: 16102 - DNA, 654 bp, Homo sapiens
  ENST00000578277
gttattatccttgttcaaaagaaatgataatgaagacacagagaggttagataatttgcacaaggtcacacagctagtaagtggcagagcatagatttcaacccaggcagccagatttcagatcccaaactcttaaccctccgatgccctttgtgaattccttaatagcacttatgtagtggcacagatatcagagagaacttctcttatgatccttattagacatttggggcaacttttacatgattttggaaaactacccagatggtgtcaagaacatgaatgccttactcataatgattccaactcccacccaacctcttcctgtattggataagtggacccaaaggctctgtcggctttcatctctgagactttgttagaacccaagaccccatggttcgaccttccctgctcccctgcagcccctgtctgccctaatgatctctccacaggccttcagaacaacctgtcccccaagacaaagggcactcctgtgcacctgggcaccatcgtgggcatcgtgctggcagtcctcctcgtggcggccatcatcctggctggaatttacatcaatggccaccccacatccaatgctgcgctcttcttcatcgagcgtagacctcaccactggccagccatgaagtttcgcag

SEQ ID NO: 16103 - DNA, 339 bp, Homo sapiens
  ENST00000582025
cttggctcctcttctcactatcagcagagagctgttactgaacagtgaaaggggaaggcttctttgtcaatcccatcataactctgtccttttggtcctcctgcagatgctccagtggctttgaccgctatcgccaggagtggatggactatggctgtgcacaggaggcagagggcaggatgtgcgaggacttccaggatgaggaccacgactcagcctcccctgacacttccttcagcccctatgatggagacctcaccactacctcctcctccctcttcatcgacagcctcaccacagaaggccttcagaacaacctgtcccccaagacaaagggca

SEQ ID NO: 16104 - DNA, 568 bp, Homo sapiens
  ENST00000579417
acgactcagcctcccctgacacttccttcagcccctatgatggagacctcaccactacctcctcctccctcttcatcgacagcctcaccacagaagatgacaccaagttgaatccctatgcaggaggagacggtgagtacagaactgcctgccctcagcgtcagacccagcgcctcttggacccaccccagaagagggtgcagcagtcgcctgggctatttttatgagtgcggagagggagcaacggcagcctgagcatcccagacctcctgctgggtggggaggcaggggggcttctgggcacaggtgccctagatcgaaggaacatgtctaccctagacatttctcatctcagccctgaacctcctgtggttcttctcctggctctctgtccttgaatattcactgcccagaaaggagtgggaggaggggaaggactgagccagggcaggtataggtggggcctgtggccatcccctctgatccccatgggctcatagtcagcaaggggtggagagcagcttctctttcctcactcaggctggcagaggacataaaattgtccgct

SEQ ID NO: 16105 - DNA, 547 bp, Homo sapiens
  ENST00000579279
caaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagaatctcggcgaaggagcatctttgaatatcaccgcatagagctggaccccagcaaggtcaccagcatgtcggccgtggagttcaccccattgccgacctgcctgcagcataggagctgtgacgcctgcatgtcctcagacctgaccttcaactgcagctggtgccatgtcctccagaggtccctcaacaaccaggatgaaaacacatgctccagtggctttgaccgctatcgccaggagtggatggactatggctgtgcacaggaggcagagggcaggatgtgcgaggacttccaggatgaggaccacgactcagcctcccctgacacttccttcagcccctatgatggagacctcaccactacct

SEQ ID NO: 16106 - DNA, 1039 bp, Homo sapiens
  ENST00000578808
gctgcagctggaggtagctgcctatctgattctgtttgagagtccgccaagttgggatttaaattagacatcaagaagaatttacagaccggccttgccttgttccacggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggtgtgggaagggaccggcagcactggcagtgcctgggagctcgtgggaaatgtggaatgtcggagtcctcagacctgcagaatcagaatccgattcccaggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtctttgtggttcagtgggaccacgtttatctccaaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagaatctcggcgaaggagcatctttgaatatcaccgcatagagctggaccccagcaaggtcaccagcatgtcggccgtggagttcaccccattgccg

SEQ ID NO: 16107 - DNA, 876 bp, Homo sapiens
  ENST00000441877
ccaggatgccccctcaccccgtctcccactctccagcgccccagctccttgccgtcacaagaacgaagtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtctttgtggttcagtgggaccacgtttatctccaaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagaatctcggcgaaggagcatctttgaatatcaccgcatagagctggaccccagcaaggtcaccagcatgtcggcc

SEQ ID NO: 16108 - DNA, 268 bp, Homo sapiens
  ENST00000444435
gcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccaggcttttcagcagagtctgcaaagcatctttggtgaaaagaaaagtcatgtgcaattagcagcatctgtttgcagaggcactcaaaacacacaggacagtgtatccg

SEQ ID NO: 16109 - DNA, 544 bp, Homo sapiens
  ENST00000577838
aagcaggctgggaggcggccatcggactcttcctttgtgcagatctctctgcacagagtgccacgcacggagctttgtttcttgatgggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtctttgtggttcagtgggaccacgtttatctccaaggctgggaagacaagggcagtttcaccttccaggcagctctgcaccatgacggccgcattgtctttgcctataaagag

SEQ ID NO: 16110 - DNA, 619 bp, Homo sapiens
  ENST00000415163
cagctccttgccgtcacaagaacgaagtaggtcaggggagggaagaggcatcttcgtgtcctgacctgattccttgccgtctattaaatatcctacattgcgggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatg

SEQ ID NO: 16111 - DNA, 565 bp, Homo sapiens
  ENST00000579190
ctttttgctttcgcaggcgagtgaggatggagtcctggcccctgccagtggctcagcctgtgtgtgtacccagggtagaatgcaatgcgagtgagggcgaggagctccgggctgacccttggaacacggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagct

SEQ ID NO: 16112 - DNA, 565 bp, Homo sapiens
  ENST00000580667
acttgagggcagcaagtagctgcagctggaggtagctgcctatctgattctgtttgagagtccgccaagttgggatttaaattagacatcaagaagaatttacagaccggccttgccttgttccacggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggaggggggtcagtggacgtcagagcatctcccttgcattagctga

SEQ ID NO: 16113 - DNA, 558 bp, Homo sapiens
  ENST00000577941
agctgcagctggaggtagctgcctatctgattctgtttgagagtccgccaagttgggatttaaattagacatcaagaagaatttacagaccggccttgccttgttccacggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtgatggagtctcgctctgtcgccaaggctggagtgcagtggcacaatcttggctcattgcaacctcctcctcctcctgggttcaagcgattcttctacctcagcctcctgagtaactgggattacaggaggacaaccacagctattatgtgtcccgtctctatggccccagcgagccccacagccgggaactgtgggtagatgtggccgaggccaaccggagccaagtgaagatccacacaatactctccaacacccaccggcaggcttcg

SEQ ID NO: 16114 - DNA, 528 bp, Homo sapiens
  ENST00000583285
acttgagggcagcaagtagctgcagctggaggtagctgcctatctgattctgtttgagagtccgccaagttgggatttaaattagacatcaagaagaatttacagaccggccttgccttgttccacgggtgattattatggcatcccactggactgcacactacttggggccatgagtgagtgaatcaatgaatgaacagcttgtgttccggaagctccttggcaacacatgcaggcggggaacgggtccagggaaaatggagctctctccagtggaaggcaggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggtgtgggaagggaccggcagcactggcagtgcctgggagctcgtgggaaatgtggaatgtcggagt

SEQ ID NO: 16115 - DNA, 2822 bp, Homo sapiens
  ENST00000377242
ggcgacggcagcgcctcctccgccaccaaactcctggggctccgcgggggcttggggccacctcctcctgagcccggaggaaccctctcccgataggttccagcgtgactccctcccactccacccttttcctttcttcttcctcttttttttttttttttttaaacacatttttttcctggcttcggacctcagactgctgcagccctaaccttcccagggctcagctctttggagctgcccattcctccggctgcgagaaaggacgcgcgccctgcgtcgggcgaagaaaagaagcaaaacttgtcgggagggtttcgtcatcaacctccttcccgcaaacctaaacctcctgccggggccatccctagacagaggaaagttcctgcagagccgaccagccctagtggatctggggcaggcagcggcgctggctgtggaattagatctgttttgaacccagtggagcgcatcgctggggctcggaagtcaccgtccgcgggcaccgggttggcgctgcccgagtggaaccgacagtttgcgagcctcggctgcaagtggcctctcctccccgcggttgttgttcagtgtcgggtgagggctgcgagtgtggcaagttgcaaagagagcctcagaggtccgaagagcgctgcgctcctactcgcgttcgcttcttcctcttctcggttccctactgtgaaatcgcagcgacatttacaaaggcctccgggtcctaccgagaccgatccgcagcgtttggcccggtcgtgcctattgcatcgggagcccccgagcaccggcgaaggactggcgggtggggtagggaggtggcggcggcggcatggcgaggttcccgaaggccgacctggccgctgcaggagttatgttactttgccacttcttcacggaccagtttcagttcgccgatgggaaacccggagaccaaatccttgattggcagtatggagttactcaggccttccctcacacagaggaggaggtggaagttgattcacacgcgtacagccacaggtggaaaagaaacttggactttctcaaggcggtagacacgaaccgagcaagcgtcggccaagactctcctgagcccagaagcttcacagacctgctgctggatgatgggcaggacaataacactcagatcgagagagtgaatctgtccttcgattttccattttatggccacttcctacgtgaaatcactgtggcaaccgggggtttcatatacactggagaagtcgtacatcgaatgctaacagccacacagtacatagcacctttaatggcaaatttcgatcccagtgtatccagaaattcaactgtcagatattttgataatggcacagcacttgtggtccagtgggaccatgtacatctccaggataattataacctgggaagcttcacattccaggcaaccctgctcatggatggacgaatcatctttggatacaaagaaattcctgtcttggtcacacagataagttcaaccaatcatccagtgaaagtcggactgtccgatgcatttgtcgttgtccacaggatccaacaaattcccaatgttcgaagaagaacaatttatgaataccaccgagtagagctacaaatgtcaaaaattaccaacatttcggctgtggagatgaccccattacccacatgcctccagtttaacagatgtggcccctgtgtatcttctcagattggcttcaactgcagttggtgtagtaaacttcaaagatgttccagtggatttgatcgtcatcggcaggactgggtggacagtggatgccctgaagagtcaaaagagaagatgtgtgagaatacagaaccagtggaaacttcttctcgaaccaccacaaccgtaggagcgacaaccacccagttcagggtcctaactaccaccagaagagcagtgacttctcagtttcccaccagcctccctacagaagatgataccaagatagcactacatctaaaagataatggagcttctacagatgacagtgcagctgagaagaaagggggaaccctccacgctggcctcatcattggaatcctcatcctggtcctcattgtagccacagccattcttgtgacagtctatatgtatcaccacccaacatcagcagccagcatcttctttattgagagacgcccaagcagatggcctgcgatgaagtttagaagaggctctggacatcctgcctatgctgaagttgaaccagttggagagaaagaaggctttattgtatcagagcagtgctaaaatttctaggacagaacaacaccagtactggtttacaggtgttaagactaaaattttgcctatacctttaagacaaacaaacaaacacacacacaaacaagctctaagctgctgtagcctgaagaagacaagatttctggacaagctcagcccaggaaacaaagggtaaacaaaaaactaaaacttatacaagataccatttacactgaacatagaattccctagtggaatgtcatctatagttcactcggaacatctcccgtggacttatctgaagtatgacaagattataatgcttttggcttaggtgcagggttgcaaagggatcagaaaaaaaaaatcataataaagctttagttcatgagggatcgacacctttggttcaaatgttctctgatgtctcaaagataactgttttccaaagcctgaaccctttcactcaaaagagcaatgatgaatgtctcaagattgctaagaaaaacagcccatgcaagagtgagaacaaacacaaaataagagattttctacattttcaaaa

SEQ ID NO: 16116 - DNA, 12468 bp, Homo sapiens
  ENST00000377252
ggcgacggcagcgcctcctccgccaccaaactcctggggctccgcgggggcttggggccacctcctcctgagcccggaggaaccctctcccgataggttccagcgtgactccctcccactccacccttttcctttcttcttcctcttttttttttttttttttaaacacatttttttcctggcttcggacctcagactgctgcagccctaaccttcccagggctcagctctttggagctgcccattcctccggctgcgagaaaggacgcgcgccctgcgtcgggcgaagaaaagaagcaaaacttgtcgggagggtttcgtcatcaacctccttcccgcaaacctaaacctcctgccggggccatccctagacagaggaaagttcctgcagagccgaccagccctagtggatctggggcaggcagcggcgctggctgtggaattagatctgttttgaacccagtggagcgcatcgctggggctcggaagtcaccgtccgcgggcaccgggttggcgctgcccgagtggaaccgacagtttgcgagcctcggctgcaagtggcctctcctccccgcggttgttgttcagtgtcgggtgagggctgcgagtgtggcaagttgcaaagagagcctcagaggtccgaagagcgctgcgctcctactcgcgttcgcttcttcctcttctcggttccctactgtgaaatcgcagcgacatttacaaaggcctccgggtcctaccgagaccgatccgcagcgtttggcccggtcgtgcctattgcatcgggagcccccgagcaccggcgaaggactggcgggtggggtagggaggtggcggcggcggcatggcgaggttcccgaaggccgacctggccgctgcaggagttatgttactttgccacttcttcacggaccagtttcagttcgccgatgggaaacccggagaccaaatccttgattggcagtatggagttactcaggccttccctcacacagaggaggaggtggaagttgattcacacgcgtacagccacaggtggaaaagaaacttggactttctcaaggcggtagacacgaaccgagcaagcgtcggccaagactctcctgagcccagaagcttcacagacctgctgctggatgatgggcaggacaataacactcagatcgaggaggatacagaccacaattactatatatctcgaatatatggtccatctgattctgccagccgggatttatgggtgaacatagaccaaatggaaaaagataaagtgaagattcatggaatattgtccaatactcatcggcaagctgcaagagtgaatctgtccttcgattttccattttatggccacttcctacgtgaaatcactgtggcaaccgggggtttcatatacactggagaagtcgtacatcgaatgctaacagccacacagtacatagcacctttaatggcaaatttcgatcccagtgtatccagaaattcaactgtcagatattttgataatggcacagcacttgtggtccagtgggaccatgtacatctccaggataattataacctgggaagcttcacattccaggcaaccctgctcatggatggacgaatcatctttggatacaaagaaattcctgtcttggtcacacagataagttcaaccaatcatccagtgaaagtcggactgtccgatgcatttgtcgttgtccacaggatccaacaaattcccaatgttcgaagaagaacaatttatgaataccaccgagtagagctacaaatgtcaaaaattaccaacatttcggctgtggagatgaccccattacccacatgcctccagtttaacagatgtggcccctgtgtatcttctcagattggcttcaactgcagttggtgtagtaaacttcaaagatgttccagtggatttgatcgtcatcggcaggactgggtggacagtggatgccctgaagagtcaaaagagaagatgtgtgagaatacagaaccagtggaaacttcttctcgaaccaccacaaccgtaggagcgacaaccacccagttcagggtcctaactaccaccagaagagcagtgacttctcagtttcccaccagcctccctacagaagatgataccaagatagcactacatctaaaagataatggagcttctacagatgacagtgcagctgagaagaaagggggaaccctccacgctggcctcatcattggaatcctcatcctggtcctcattgtagccacagccattcttgtgacagtctatatgtatcaccacccaacatcagcagccagcatcttctttattgagagacgcccaagcagatggcctgcgatgaagtttagaagaggctctggacatcctgcctatgctgaagttgaaccagttggagagaaagaaggctttattgtatcagagcagtgctaaaatttctaggacagaacaacaccagtactggtttacaggtgttaagactaaaattttgcctatacctttaagacaaacaaacaaacacacacacaaacaagctctaagctgctgtagcctgaagaagacaagatttctggacaagctcagcccaggaaacaaagggtaaacaaaaaactaaaacttatacaagataccatttacactgaacatagaattccctagtggaatgtcatctatagttcactcggaacatctcccgtggacttatctgaagtatgacaagattataatgcttttggcttaggtgcagggttgcaaagggatcagaaaaaaaaaatcataataaagctttagttcatgagggatcgacacctttggttcaaatgttctctgatgtctcaaagataactgttttccaaagcctgaaccctttcactcaaaagagcaatgatgaatgtctcaagattgctaagaaaaacagcccatgcaagagtgagaacaaacacaaaataagagattttctacattttcaaaacagatgtgtggcaaaaggatgttgtttttctggtctagatccatctgtaccaacaagttcatcactttacagaacgaatctttttatccgtacaggaggttcaaaccatgtctgcctcttcctttgtaatgaatgacctttctatgagctgtgacaaaatttccgaacaattaactaaggatttgggaagagggggtggcaaacggggctttctgttttcctgcctcagcatgaaaacatctgatttatgctttatggaagccttacctccaatccccaactgttaagtcccatgaaaccacagttgctctgggctgatggaaacaaaaggaaacagtatgaagagttccttaatcatttttgaaacaaaaatgttaagggattttaaacatatgattatttttaattttatgccttttcagtactaaacacccatttcattgctgattcctgtctaagaagccattcacgtcagcatggcgatagaaagaatgaaaaaaccctgctgaatcatacagtaattttctttaaagcacatagtagttacataaatatatatatataaatatatttttgtttataactaacacaaggcaggatcttgtgactctaagagtgcgttttgtcatcaaggcaaaacagatgcaagatgcatcactgcattacttccatagagttgtaaaataatccttaatattagaatatttttctgtcacttagcaaaagtggttcagttcattgccgcgcccatcatgttcttgactatttgatccactttttcgtttatgtcaaccccttccctctctggctaaataaagtggatgcagaaagctccttaaatggagatatcgattgccttggaatcacaatcctgattttgaaaattcctcatgaatgaagaaaggaatggcatcccttgagaaggaaagtggttaatatacatactgagctcctaaagtttaaattcaggtactgagtgtacaatttcaccaacattctaacccatgaaacttttacactctgtgccaagaaactgttggcttttgtaaggtacagtgctcaacatttgcagattcaggtctcaagaagcagagatgtctcataagcagcattttcccaacagtttagcatctgtacacatctgccttggtcatcagtccactcacagagtaccatactttatcatcacaagtgtctgacgtgaacgaatgccattttctattccatatattttgctttacaattttaagtatttgatgaagatggtaactttttcctaacttagttaactattaaaaaaaattttgaaaagcaaggtgattgaaggattgtgatgacaatctctttgcagcagctatgtatggtttatgtgaagtatccccacttattcttgtggagcaggtttggtgagacagcaataaccaaatgacatgccaatattactggtgcaactggtattctacaaatgcataaggaacacatagacgacttccttttaggataaaatgatgcttctttcactaccttttgtggtagctgtggcttccaatagcaactgtttgacagttatataaatcttgcatgtgtattcttagtttgtgtcccttaagtactacttaattctcaagtagtaatgttattcttatacccttcagcgttctattttgattcaaaacaattgattcaaaacaattttgaatcaattttctattttgattcaaaacaattgataattctgtaaaaaaacataaacactgaattcttcagtgaaccaaagcaacaaataatagagaaaacttcttgaaactggagtgtgggaaaacttcttaacagaactaagagttaaaggtagtgagaagtgtgtggtgtgtgaattctttagtggtaaggggaaatgtgggctaaatccttttctttcatgaaactctcattctattttatatttctggtttgttcttgttcccatgtgagaaaacatacagtttctgaaaattcaaaatggtcatcaatgctttggactttacataattatgtattagagaaggtgcaactgtacattacttaatatactatgaacataatagaataacaaaaaaagataacaaagagatgcaaacttctggataaatcagataaatggtgctacagaggaatttagttatttcagcttaattatttgtaaaaataataatcagtgactaggtaaagatactgaaactcaagaaaaatatcttgacccatttatgtctagtgttccattattggaacgctaagcttatgggagttatttagagcctactgctcaaggtcatcaccaaggtctggttgcaaaaattcaaaaaattgcaacctcaggcataaatggcttaagcccaagagatggcactgaccataaatggtggcttgtgtgtgaagggtttggacttcaagatatactaacacctagaaaactaaaagtgcaattgacccccaattactattttagtttgaggtatcaagggcatttgccaatctcttatatgtagcttctagagttgtgctgtccaatattatatccactagccaacgtggcttttgaaattaaaattaattaaaattaaattaaaaatgtaattcttcagtcacaccagccacatttcaaaggctcaatagccacgcctggcttgtggctaccatattggataacaagaaacacttccgtggttgaagaaaattttaatggacaatgctgtgtttcatttgaattcgttgtccttgaagaaaagggaagaagaggaaagaaacaagatttggtagctcttgggcatatccaagcatttttgattttagagaggccctatggagtaatgaaaaaaatacaagctgacacagctttaaatccccactgtgttatcttgggaaaatcacttcaacctccttgagtctcaatttgcaattttggaaaagaaaaacaatttttgtcctgtctttcttgcaagattattatgcaacctgattaaatgtacagatgtgcagactcttaaaaaccttatgttaatgtaacccatataaagtacgacttttggtcgagtaccagcacaaatttgcattcaaaggaagaatagttcatcagtgcaaaaagcgttcaaaggtaatcagttcatcacgtatcttgagaaaaagagaatgcattcaaaacacaaagcaaaattgcttcagtttcttttctgcccatctgaatatttcctttagtatttgtcccacatgacatccatcccatgtatttatccactctttcacaacattgcctatgaacatccttcaactggctcagttctttattgcatagagccacttagcttctctagtttcttatgatttcctattttacacttaacagcaaaaggaggcttccatttagaaggcactatctcaaacataaataatttcatatttattttatcactgtaacactaaggagctatggcattaaaatataaaactatttggaacttaatgtaaacctttgcacatgcagactatataaagggaataaaattattttaaattatgctaatatccagatacatattctaaggttagtatcatttatcagtttttcgcaacagattcttatgttacatcttcatgagggagtataaatttgatcacgtccctagtgtctattgcccacttgagaaaggttttgccaggatccacagatcgcttcaagatgctttcgtttatgataggaaattaatatttaaataagactaattgaaaactagattatctggttctaatttcttcctcctgtgaaatgttcttttggtttgtatttctttaggtattttccaagttactgctgcttttacttcacgacctccaaccccacttttgttatcagcgtcatatgccagagtcatggcagatccagcctggacaacatagtgagacccatctctatcaaatatacatatatatatatatatatacacacacacacacacacacacaaatatacatatatatcaaatatatatgtatatttgatagagatgatagcaattatgtgtgtgtgtgtgtgtgtgtgtgtgtgtgtgttagccaagtgtggtttctcatgcctgtagtcccagctactttggaggctgaagtgtaagagttgcttgagcccatgagttagaggctgctgtgagctatgatcatgccactgcactccagcctgggcaacagagcaaaaccccatctctaaataaaaaaaaagaatcgtgagacatcatgtaatccaacctcttaatgttacagataagtaaactgaggcccaaagagatatagtaatagtcccagtgtcagtaaactgggtcttgaacttaaatgtttgtttcagttctcattgccttcatctcttaattgtcggcacttaaggccaaccaagcagcttagacagcgcagtccactcaacggtaactttatttgctatattgacaatctgctctgttctgtaatatagaacattggatcaatctttatctttttgctgacttaaggaggctgctattgttgcaatatccagagatttcaagttctagccattgcggggtctttgtggtgttttcaatttctcctctctccacccctgcccccatctgtggccatctaagttagcaatacaatttattttggccatttaaaatttttctgcctttgttttatttcttcccaaatatatttgaaaatgaatgatctatatagctgattttctgaccacatatataattgcaatttttatttgctcttcaaactattacaacatttttgtccttataaggttttttgggcagataatgcgaggtctgtggtgttaccttttatatactcctattaccttatgtttgtgaagcattttacattttacagagcactttgattcatctccctatttgttcatttatttaactgttcagttcactgaaatatttattgaacacctactggaaccaagtgactgtgctagtaacttgtgatatacagtagtgagagtccaggcatgtaaccgatcattataatacaataacatccctaaaccagactttacaagtagataggatcaacaatactctatcaattttcaactccaattttctattctacttaaaatgggaactagaaactgtttgcctgaagaatgtgtctgaaacataatatatcactgcatgtctgtgctgtagacctgttaattttatctgtgagaaaaaaagttactcaaaattctccctgacctaagaatactttctagttcactgcagtcttactgaccagatgcaacagttgaagtttgatttctcgacccaatatttctattgggttttgaattattaatatcactgttttgaggtattcagaaacaccagtgtatcaaaaaagcatttgcactttaggtgtgtgtggtggttatgtcatttattagaccatcccagacataagacaatcagggaaatcagaaaactccagcctcaaatgtgtctataatttcctgttctaccattgtcatatcataacatggtattacttcttaaggttttgattaagttgatctagcctcaacttaaattgtaatacatctgcctaattattgtctggaataacttttcaaccatccaatgcccactgctctcacaatgattattgtagagaagtaaaatggtaattattcaagtaaagtcacataatttctggagtcagtttttcataacaagtttatggaatacatcatcattggcttcttcataatatatttattatgagtgaccaaattttgcctggaggagcaaaatgctcaaaacttgttattataggttaatttccagctcactgttgacactgaaagattctgtgttactttaaacccaggataaaaggctggaaaaaaaattaaatgtaagtcataaactagtactcagcttttcctagtttctaaggcttattaacatttgcaaattactcaataaatgtctttcataatggaataacataaaagcttttgatttggcagatagtgatattttatttattttcattctggttgaaaaaaatctcagtggcttctcttcattccacgagaattttgatttttaacagcagtctctctttttctcagcattgcaaatatatatgtatatatacattcatgaccaaagtatcgcttactgaccatgcagctgtaaaccttctgtgcctatcaaacaaatacatagcatgaaactaattttagaagtttcatgggggaattttaggggaaagtataaacctaagagtgagtgaatggagatgattcatggaaaaaaaaataaaaatctaaatgtgctattaggcagagttattaacttcttttagttgttgtttgagatggggttttgctcttgttacccaggctggagtgcaatggcgtgatctcgtctcactgcaacctccgcctcccaggttcaagcgattctcctgcctcagccgcccaagtagctgggattacaggcatatgccactacagccggctaattttgtatttttagtagagacggggtttctccatgctggtcaggctggtccccagctcccgacctcaggtgatccgcccacctccgcctcccaaagtgctggaattacaggcctgagccaccgtgcctggccgagttattaacttcttaagagcaatgtgctaataaatactcattgatgaccagctcaaatttaggtcattcagacatccagacactggggcacatattctgcaagcaatgctgagacccctgacatagagaaagcaaaggatatgcctatgattagtctaaaatgcagccatcaccccccatacctcttctatggcattcatcctaacatcatggaggcctttgtcctagagaattatgtgacttgccctagagaattagtgaatgaccaaaaagagactttccatttatcttcctttgacttaaaaggcatgaaaataaggcaaaaaaatcaataaaataattttcctgaggaaaggttaagagatggcactttcctttccgggcccagagctggatttctctgagatttgaccatctcaggactcagacagactccagtgctattttctggacatttgtggtgaagcctcagccaccatgttcaaggtggtttgaatgaaaacatactcagattgtcacatttatagcagggaaataaaaactcaaattaggcatcctgcagcaggctactctgaaaataacattaggcaacatcagagcttcacttgcaaagaaatgttaaaatcattttagggaaatcagtgaagtctctttagaaacagacatcttgtgtatggcgtaacccagtcttggggccctcacggagaagagggggaagtcttttcattgattggtcaaaacaaatctctcatttgcctgatttgaagcatttcaacagtgcctggagagtacattattttcaggggaaaaaaaggagagagtcttttttatatgccagctgggatcatgggaacttcgaatgccaggaatttactactgtttctggtaattctgtgtgtagtcatttgaaatgttgaagtgtgaaaagagaagaaattgggcacttcttgcggcgggggagggggggggggcggtggctttccagattttatgccagttgcaccagcatgcagaatatttgtaatgcatttcaaagtggatataatggcaccctttgtcagaatcacaaagctcactgcggcactgctacaagaggacactgaggaaaatctggccctatgaacctagtcaaccccaagcaaaaagaatgactatgtgtgtgagtgcagcacatggccagttcgtttctcactgttttggaaagccctgtgtgccaaaccaaggacgtgtctttcagggaaaggttaattttccgaagtttattaaaatagaacttggaaaaccaagcattttgaatttattccagtcctctgggcatcattcctatttcttctgccatgtcaaggagaaattccaagcctgcattctgtcatgctaaaataaccagcccatacttctcggtgaccttctgttgaacgtacctgagcctgcaaatgtaaaaatgattgtatctgaatctgcactaatggtgtctgagagcaaaaagagtgtgacctctattggaaacctttgttcaaattcaataattcagagatgctacatacttctgcaagcttcctgattatgttcactgtaatattaatgacctaagtttgaatgtatttccttacagtccattaatttgacatccatcttttacctggggattattacaattgcaataagtcattaatgttttcttcacacagcttcttaaaccaagtttctctgcagctctttcggttctgcttacagtgtgtgggaaatctgatttttttcccctagtaatagtttgataagaaatttagtgtattgactgcctcagtgacacaatttatctttaaaggtgtggaagctggtggggaccaaatgttacctgtgtttttgctgttgattgctattttcagaagcaaaccatgtttttcacttacagtaggagtcaacaaatttgggattttagaagggggaggagggagctatttgtgtaagactgctgtcatatttgactacatattaaaaacagtaaatgagcattttgttttaatttcttaaataccttgtctttcaacatacgttttgtttcctttcttccattagtgttcaaaaggttctacccattgtggaagaaattctgtgtgcagaattcagaggcacaaggctgatggcaagatagaaagttattttgcttctaaacccaccccgatgtggaaactgatactagctagagggagctgtagaaaacaaagatttcaggattgcacagtgtgtgggcaatgggatggagactttttcccctattcccagccacagtgcccaagcgttcaagtctcctggatcagacagatgggattttagctgctgctttaaatcctagtgctggaataagtcaaggtacttcagttcagctcttgcctctgtcactaatcttgctttatgaactcctttgattttctgaataagttccagaaggttctctattattctgtccttcttccaaactggaaatggctgtatctaattctcaggatattttggatgtgtgcctcaggtaatttatgtggaatgtgtaaagcaagatgtctccaattctgaatattccttccccttttcccaatcctccactcttggactacctttataacaacaccgagtacgcacagacctgaacccatgcccaagaagcacacacaatgactggagctgtcgggaattcctgtcagtggcattccctgagcactggctctgtacaactcaattataattttttaagaatcatacctctgtatagatcttttggactgtactgattaaactttgatattgtggagtaaattcagaagtgcaattttaaa

SEQ ID NO: 16117 - DNA, 1903 bp, Homo sapiens
  ENST00000377238
ttttggcaggtctgatttaagaaaaactgaaggtgtattttcacatagtatgtcagtggtagacttcgtaattagactaaatcgtgtatatttttgcaggaggatacagaccacaattactatatatctcgaatatatggtccatctgattctgccagccgggatttatgggtgaacatagaccaaatggaaaaagataaagtgaagattcatggaatattgtccaatactcatcggcaagctgcaagagtgaatctgtccttcgattttccattttatggccacttcctacgtgaaatcactgtggcaaccgggggtttcatatacactggagaagtcgtacatcgaatgctaacagccacacagtacatagcacctttaatggcaaatttcgatcccagtgtatccagaaattcaactgtcagatattttgataatggcacagcacttgtggtccagtgggaccatgtacatctccaggataattataacctgggaagcttcacattccaggcaaccctgctcatggatggacgaatcatctttggatacaaagaaattcctgtcttggtcacacagataagttcaaccaatcatccagtgaaagtcggactgtccgatgcatttgtcgttgtccacaggatccaacaaattcccaatgttcgaagaagaacaatttatgaataccaccgagtagagctacaaatgtcaaaaattaccaacatttcggctgtggagatgaccccattacccacatgcctccagtttaacagatgtggcccctgtgtatcttctcagattggcttcaactgcagttggtgtagtaaacttcaaagatgttccagtggatttgatcgtcatcggcaggactgggtggacagtggatgccctgaagagtcaaaagagaagatgtgtgagaatacagaaccagtggaaacttcttctcgaaccaccacaaccgtaggagcgacaaccacccagttcagggtcctaactaccaccagaagagcagtgacttctcagtttcccaccagcctccctacagaagatgataccaagatagcactacatctaaaagataatggagcttctacagatgacagtgcagctgagaagaaagggggaaccctccacgctggcctcatcattggaatcctcatcctggtcctcattgtagccacagccattcttgtgacagtctatatgtatcaccacccaacatcagcagccagcatcttctttattgagagacgcccaagcagatggcctgcgatgaagtttagaagaggctctggacatcctgcctatgctgaagttgaaccagttggagagaaagaaggctttattgtatcagagcagtgctaaaatttctaggacagaacaacaccagtactggtttacaggtgttaagactaaaattttgcctatacctttaagacaaacaaacaaacacacacacaaacaagctctaagctgctgtagcctgaagaagacaagatttctggacaagctcagcccaggaaacaaagggtaaacaaaaaactaaaacttatacaagataccatttacactgaacatagaattccctagtggaatgtcatctatagttcactcggaacatctcccgtggacttatctgaagtatgacaagattataatgcttttggcttaggtgcagggttgcaaagggatcagaaaaaaaaaatcataataaagctttagttcatgagggatcgacacctttggttcaaatgttctctgatgtctcaaagataactgttttccaaagcctgaaccctttcactcaaaagagcaatgatgaatgtctcaagattgctaagaaaaacagcccatgcaagagtgagaacaaacacaaaataagagattttctacattttcaaaa

SEQ ID NO: 16118 - DNA, 9066 bp, Homo sapiens
  ENST00000393409
atgccgctgccaccgcggagcctgcaggtgctcctgctgctgctgctgttgctgctgctgctgccgggcatgtgggctgaggcaggcttgcccagggcaggcgggggttcacagccccccttccgcaccttctcggccagcgactggggcctcacccacctagtggtgcatgagcagacaggcgaggtgtatgtgggcgcagtgaaccgcatctataagctgtcggggaacctgacactgctgcgggcccacgtcacgggccctgtggaggacaacgagaagtgctacccgccgcccagcgtgcagtcctgcccccacggcctgggcagtactgacaacgtcaacaagctgctgctgctggactatgccgctaaccgcctgctggcctgtggcagcgcctcccagggcatctgccagttcctgcgtctggacgatctcttcaaactgggtgagccacaccaccgtaaggagcactacctgtccagcgtgcaggaggcaggcagcatggcgggcgtgctcattgccgggccaccgggccagggccaggccaagctcttcgtgggcacacccatcgatggcaagtccgagtacttccccacactgtccagccgtcggctcatggccaacgaggaggatgccgacatgttcggcttcgtgtaccaggatgagtttgtgtcatcacagctcaagatcccttcggacacgctgtccaagttcccggcctttgacatctactatgtgtacagcttccgcagcgagcagtttgtctactacctcacgctgcagctagacacacagctgacctcgcctgatgccgccggcgagcacttcttcacgtccaagatcgtgcggctctgtgtggacgaccccaaattctactcgtacgttgagttccccattggctgcgagcaggcgggtgtggagtaccgcctggtgcaggatgcctacctgagccggcccggccgtgccctggcccaccagctgggcctggctgaggacgaggacgtgctgttcactgtgttcgcccagggccagaagaaccgcgtgaagccaccaaaggagtcagcactgtgcctgttcacgctcagggccatcaaggagaagattaaggagcgcatccagtcctgctaccgtggtgagggcaagctctccctgccgtggctgctcaacaaggagctgggctgcatcaactcgcccctgcagatcgatgacgacttctgcgggcaggacttcaaccagcccctggggggcacagtcaccattgaggggacgcccctgttcgtggacaaggatgatggcctgaccgccgtggctgcctatgactatcggggccgcactgtggtattcgccggcacgcgaagtggccgcatccgcaagatcctggtggacctctcaaaccccggtggccggcctgccctggcctacgagagcgtcgtggcccaggagggcagccccatcctgcgagacctcgtcctcagccccaaccaccagtacctctacgccatgaccgagaagcaggtgacgcgggtgcctgtggagagctgtgtgcagtacacgtcctgtgagctgtgtctggggtcacgggacccccactgtggctggtgtgtcctgcacagcatctgctcgcggcgggacgcctgtgagcgagcagacgagccccagcgctttgctgcggacctgctgcagtgtgtgcagctgactgtgcagccccgcaatgtgtctgtcaccatgtcccaggtcccacttgtgctgcaggcctggaacgtgcctgacctctcagctggcgtcaactgctccttcgaggacttcacggaatctgagagcgtcctggaggatggccggatccactgccgctcaccctccgcccgggaggtggcgcccatcacgcggggccagggagaccagcgggtggtgaaactctacctaaagtccaaggagacagggaagaagtttgcgtctgtggacttcgtcttctacaactgcagcgtccaccagtcctgcctgtcctgtgtcaacggctcctttccctgccactggtgcaaataccgccacgtgtgcacacacaacgtggctgactgcgccttcctggagggccgtgtcaacgtgtctgaggactgcccacagatcctgccctccacgcagatctacgtgccagtgggagtggtaaaacccatcaccctggccgcacggaacctgccacagccacagtcaggccagcgtggatatgagtgcctcttccacatcccgggcagcccggcccgtgtcaccgccctgcgcttcaacagctccagcctgcagtgccagaattcctcgtactcctacgaggggaacgatgtcagcgacctgccagtgaacctgtcagtcgtgtggaacggcaactttgtcattgacaacccacagaacatccaggcgcacctctacaagtgcccggccctgcgcgagagctgcggcctctgcctcaaggccgacccgcgcttcgagtgcggatggtgcgtggccgagcgccgctgctccctgcgacaccactgcgctgccgacacacctgcatcgtggatgcacgcgcgtcacggcagcagtcgctgcaccgaccccaagatcctcaagctgtcccccgagacgggcccgaggcagggcggcacgcggctcactatcacaggcgagaacctgggcctgcgattcgaagacgtgcgtctgggcgtgcgcgtgggcaaggtgctgtgcagccctgtggagagcgagtacatcagtgcggagcagatcgtctgtgagatcggggacgccagctccgtgcgtgcccatgacgccctggtggaggtgtgtgtgcgggactgctcaccacactaccgcgccctgtcacccaagcgcttcaccttcgtgacaccaaccttctaccgtgtgagcccctcccgtgggcctctgtcagggggcacctggattggcatcgagggaagccacctgaacgcaggcagtgatgtggctgtgtcggtcggtggccggccctgctccttctcctggaggaactcccgtgagatccggtgcctgacaccccccgggcagagccctggcagcgctcccatcatcatcaacatcaaccgcgcccagctcaccaaccctgaggtgaagtacaactacaccgaggaccccaccatcctgaggatcgaccccgagtggagcatcaacagcggtgggaccctcctgacggtcacaggcaccaacctggccactgtccgtgaaccccgaatccgggccaagtatggaggcattgagagggagaacggctgcctggtgtacaatgacaccaccatggtatgccgcgccccgtctgtggccaaccctgtgcgcagcccaccagagctgggggagcggccggatgagctgggcttcgtcatggacaacgtgcgctccctgcttgtgctcaactccacctccttcctctactaccctgaccccgtactggagccactcagccccactggcctgctggagctgaagcccagctccccactcatcctcaagggccggaacctcttgccacctgcacccggcaactcccgactcaactacacggtgctcatcggctccacaccctgtaccctcaccgtgtcggagacgcaactgctgtgcgaggcgcccaacctcactgggcagcacaaggtcacggtgcgggcaggtggcttcgagttctcgccagggacactgcaggtgtactcggacagcctgctgacgctgcctgccattgtgggcattggcggaggcgggggtctcctgctgctggtcatcgtggctgtgctcatcgcctacaagcgcaagtcacgagatgctgaccgcacactcaagcggctgcagctccagatggacaacctggagtcccgcgtggccctcgaatgcaaggaagcctttgcagagctgcagacagacatccacgagctgaccaatgacctggacggtgccggcatccccttccttgactaccggacatatgccatgcgggtgctctttcctgggatcgaggaccaccctgtgctcaaggagatggaggtgcaggccaatgtggagaagtcgctgacactgttcgggcagctgctgaccaagaagcacttcctgctgaccttcatccgcacgctggaggcacagcgcagcttctccatgcgcgaccgcgggaatgtggcctcgctcatcatgacggccctgcagggcgagatggaatacgccacaggcgtgctcaagcagctgctttccgacctcatcgagaagaacctggagagcaagaaccaccccaagctgctactgcgccggactgagtcggtggcagagaagatgctaactaactggttcaccttcctcttgtataagttcctcaaggagtgcgctggggagccgctgttcatgctgtactgcgccatcaagcagcagatggagaagggccccattgacgccatcacgggtgaggcacgctactccctgagtgaggacaagctcatccggcagcagattgactacaagacactgaccctgaactgtgtgaaccctgagaatgagaatgcacctgaggtgccggtgaaggggctggactgtgacacggtcacccaggccaaggagaagctgctggacgctgcctacaagggcgtgccctactcccagcggcccaaggccgcggacatggacctggagtggcgccagggccgcatggcgcgcatcatcctgcaggacgaggacgtcaccaccaagattgacaacgattggaagaggctgaacacactggctcactaccaggtgacagacgggtcctcggtggcactggtgcccaagcagacgtccgcctacaacatctccaactcctccaccttcaccaagtccctcagcagatacgagagcatgctgcgcacggccagcagccccgacagcctgcgctcgcgcacgcccatgatcacgcccgacctggagagcggcaccaagctgtggcacctggtgaagaaccacgaccacctggaccagcgtgagggtgaccgcggcagcaagatggtctcggagatctacttgacacggctactggccaccaagggcacactgcagaagtttgtggacgacctgtttgagaccatcttcagcacggcacaccggggctcagccctgccgctggccatcaagtacatgttcgacttcctggatgagcaggccgacaagcaccagatccacgatgctgacgtgcgccacacctggaagagcaactgcctgcccctgcgcttctgggtgaacgtgatcaagaacccacagtttgtgttcgacattcacaagaacagcatcacggacgcctgcttgtcggtggtggcccagaccttcatggactcctgctccacctctgagcacaagctgggcaaggactcaccctccaacaagctgctctacgccaaggacatccccaactacaagagctgggtggagaggtactatgcagacatcgccaagatgccagccatcagcgaccaggacatgagtgcgtatctggctgagcagtcccgcctgcacctgagccagttcaacagcatgagcgccttgcacgagatctactcctacatcaccaagtacaaggatgagatcctggcagccctggagaaggatgagcaggcgcggcggcagcggctgcggagcaagctggagcaggtggtggacacgatggccctgagcagctgagccccagctgtgatcatccagcatgatgcagcgtgaggacagctgagcagggaccgggacagccctcaccgcatgcgtgtggagtgtccggtggtgctcgggccgccgcagtgcagcgactgcccggccctccctcccctgcctcacccggtcgggtcccggctcttcctgtgtggaggtgatggtacctgccacaccacagctgcgcacacagctgcttgctcaggggccgggacagcactgggtgctcaggctggccaaggaccttcattgcctggcaagagctgcccagtggccttcatgggagaagggctgacctctgaggggctgaggggtgaggccagggccctccagggggaggggtagccagcttgggctgtccccttgagaccaggacaagaggctgggggtgtcagcattcccagctttccaagctgcccccaggcggcagagtctgagggtcccggggcccggttggcagctggagaaagaggcaaaaagcccgtagccgggcaagaggagctcaagtcggtctgggcccgttgccaccgactcccacctccagcacccatgcccgctgcaccgctgccatcctcagattcaccgcgtgctctgcgcggccgaggccggagcaccacatccacctcgccccagagaggctctgctccctcctatggaggggctgtgggccaggctgctcagactcctgggtggcttccagacggaccgggcagcccctctccgtcctcagggctgtgcctctgggagccactgggccaggggccccgggtcgcagagagcacgttcccgttatttattcccctccgcgtcctacacaggctgccctggcagctgtcttcaagggtaggctgagctccccaccctggagcccctgagggcggcccctgagcactcctctctctccactctctctgtccctgccccagcggcttccagtgtggcatctcagcagtgtcctggcccctccagagcagtgggacatctggggactgtttttgtgtttaggggaaaaaattctgctgcactctgcttgggccttgaggtctgtggcagggctcctctggcccgcagtggcctggatctatctgggccatgagtgacgggcagtgaccagagggactggaggccagcggtgtccacccttgccctcagcaagagagaatgcattcttaaaagaaagctgtacatgtatatatatgcatatatatatatgtggctctagcctcaggctccagccccagtggggtactgtacagttaactgaagaagaattttaaagacgatttgaacaagaaaatgaaggcagtgggaaagcaatgccaaatggttgtggagaaagtggccggagcctccctggagtggagcagccctgaagcctgtgccccccgacctgcgggccgctgttttggtttgacatgacaaggaaaggacttcctgctgaccctgagagcctctggggtgccgcggcaccacggggcatgcatgattgtgctagcgtttagtctgagttgatctttttaaaactgcaagtgttgaatactagaggttgttagacccttttttatgttttttaattaatcagtcacttgtaaaagcaaacaagcggtccatccccttttcaaggtcacttttttgatggtaccgaagatcccatggacattaagggacagctaactgtggccagactcagccccatgtccttggccaggcccaaggagaggactcggccccatggggtgtgccagtcttgcagtccgccccagctgagtagcgtgagccagatgacgccacagagacccgcctcttccctgaacgcgggtcggtgtggagtcagtgactgctgactcagggagctccttggccccgtgggcactgtgccagggctggggccttctgctgctgccacacccagctcaggcctgggccagcccctgcccccagcccactgagggggtgggcttactccctgggcagtcttgggggccagagctgaggccagtccatattacagtggctgggctgtttttttcagtagcccctagcattggctgggattcctgttcctgggtgcgcctccacctcccttctgatgtttcctggctatggtggggtgggaacctcagtttcccccaaagtcttccctggatgctggcttcaggttgaagtccctggttcttccagttcctcacgggttaggtaggggctcctgcatcaccttcagaatccagttccaacccccactctccttaggccttgtgctctgctctgccctgccaggctgcccttgtccatgtgagtagcatgggcgggtggtggggacggcagtggtgatgaagggggtgcaccacaggcctcatgaagcagttcccacatgggcgtgtggctggggcgtggccaccacagagcacatggctgtgtctaggcgcaagcactttagcagtatctgtttacatgcgcaaggatcaagccgactacctgtgctgtctactgggacagcagtctccgagctactccgtacctccctctgccaggtcgtggagttaggccccagtccctacttgtcactggttcccactgtgctcctaactgtgcagcacctgggagctctggcctggggctggaggccctggtaggagctgcagttggaggccgttctgtgcccagcagcggtgagcggctcccatgggccctgtgtctgcagggagccagggctgcggcacatgtgctgtgaaactggcacccacctggcgtgctgctgccgccacttgcttcctgcagcacctcctaccctgctccgtgtcctccctctccccgcgcctggctcaggagtgctggaaaagctcacgcctcggcctgggagcctggcctcttgatatacctcgagcttcccctgtgctccccagccccaggaccactggccccttggcctgaggggctgggggccccacgacctgcagcgtcgagtccgggagagagcccggagcggcgtgccatctcggctcggccttgctgagagcctccgccctggctttctccctgtctggattcagtggctcacgttggtgctacacagctagaatagatatatttagagagagagatatttttaagacaaagcccacaattagctgtcctttaacaccgcagaaccccctcccagaagaagagcgatccctcggacggtccgggcgggcaccctcagccgggctctttgcagaagcagcaccgctgactgtgggcccggccctcagatgtgtacatatacggctatttcctattttactgttcttcagatttagtacttgtaaataaacacacacattaaggagagattaaacatttttgctaaaagct

SEQ ID NO: 16119 - DNA, 4446 bp, Homo sapiens
  ENST00000503234
gtttcttgctgtgtgaccttgggccaatatctgcactgccctgaccttcagagactagctgccgtcctttcactctctgaggccaggcctgggaaccctcggacaggtgtctgactttgggaaaccctcaaaggcttcctgtcacattaatggctctccatccggatctgcaccccttttcctcctccttcgtggctaacttaatgaaaccaagtttgcaaatgaaacataatttcatagacagacatgttgttggaaggtctgggatggtcttaacagctgtctctctaattaccgcagatgctaacgaggtgcctggagcctctggttacaggagcagagctgctgtttgtttgccagggccgggtaggaggcagggctgccaaacctgcccctccattgaggtgtacacacacctgaaggcccttgggcaggcaggacctacagtggaccccatgcccaggctctgggcgggcctcgcctgtgtggccaactcacccagcccagacgtgaacgtttcccagggacagctctccattcactcaattcatccagcaagtgtctgtgatgccccatgcacaggctcagccagtgctagcagtagggtatagtgagcaggccaggcagctcccactccagaggggttgccaggggtgcacaggatccttcagagaacgacagatggcggggagactcagcgaggcagtggtcgggggtacgtgtgctgggcgctccccaggagcctttctgaagagggcacattgggttgggtccacaagggcccatgaagatgccaggggaaatttctggttgtagaggcagcagttgcaaaggccctgaggtgggacaggaggcggttctcatgctacagcgcggggagccggagggtgaggggtcaggtgcccgctgagggcccggggctgtgctgctggccctgtgctgtgtgcttgggtgctggtgaacctccctgggtgggcaagcctcctcaggtgggtatgtcagtatccatgacacaccatagttgtgtcccagagtaatatgggggcccagctgggtggtccctaggaggccagtggatcacagtcacacttggagttgcgtagtatggggtccgcttgtgccatgggcggtgggccatggggagctttgtcctgagcacctccagctggggagcaggcccctgggaggctggagctaggcggggatcctgctgagaccaggggagacttctgggtgaaataggcctcggccctccctgatgcaggtcccgcgtgccacgccatgttcctcgatacactactgcgcctcctggctcatgtgtaatttagggttttcatgtgatatttgtgggatggtgggtatgttttgtttcctgattttcttgcagtctctgctgggctttgggactaaggctgtacttgcctcccaaagagttgggaagtgctgctcatttctccttgccaggaacaccatggctggcactcgacgggtggaggggcaggttgggggtaggcccgggggtcctggctgcagcctcatgccgccacccccgcaggagtgcgctggggagccgctgttcatgctgtactgcgccatcaagcagcagatggagaagggccccattgacgccatcacgggtgaggcacgctactccctgagtgaggacaagctcatccggcagcagattgactacaagacactgaccctgaactgtgtgaaccctgagaatgagaatgcacctgaggtgccggtgaaggggctggactgtgacacggtcacccaggccaaggagaagctgctggacgctgcctacaagggcgtgccctactcccagcggcccaaggccgcggacatggacctggagtggcgccagggccgcatggcgcgcatcatcctgcaggacgaggacgtcaccaccaagattgacaacgattggaagaggctgaacacactggctcactaccaggtgacagacgggtcctcggtggcactggtgcccaagcagacgtccgcctacaacatctccaactcctccaccttcaccaagtccctcagcagatacgagagcatgctgcgcacggccagcagccccgacagcctgcgctcgcgcacgcccatgatcacgcccgacctggagagcggcaccaagctgtggcacctggtgaagaaccacgaccacctggaccagcgtgagggtgaccgcggcagcaagatggtctcggagatctacttgacacggctactggccaccaagggcacactgcagaagtttgtggacgacctgtttgagaccatcttcagcacggcacaccggggctcagccctgccgctggccatcaagtacatgttcgacttcctggatgagcaggccgacaagcaccagatccacgatgctgacgtgcgccacacctggaagagcaactgcctgcccctgcgcttctgggtgaacgtgatcaagaacccacagtttgtgttcgacattcacaagaacagcatcacggacgcctgcttgtcggtggtggcccagaccttcatggactcctgctccacctctgagcacaagctgggcaaggactcaccctccaacaagctgctctacgccaaggacatccccaactacaagagctgggtggagaggtactatgcagacatcgccaagatgccagccatcagcgaccaggacatgagtgcgtatctggctgagcagtcccgcctgcacctgagccagttcaacagcatgagcgccttgcacgagatctactcctacatcaccaagtacaaggatgagatcctggcagccctggagaaggatgagcaggcgcggcggcagcggctgcggagcaagctggagcaggtggtggacacgatggccctgagcagctgagccccagctgtgatcatccagcatgatgcagcgtgaggacagctgagcagggaccgggacagccctcaccgcatgcgtgtggagtgtccggtggtgctcgggccgccgcagtgcagcgactgcccggccctccctcccctgcctcacccggtcgggtcccggctcttcctgtgtggaggtgatggtacctgccacaccacagctgcgcacacagctgcttgctcaggggccgggacagcactgggtgctcaggctggccaaggaccttcattgcctggcaagagctgcccagtggccttcatgggagaagggctgacctctgaggggctgaggggtgaggccagggccctccagggggaggggtagccagcttgggctgtccccttgagaccaggacaagaggctgggggtgtcagcattcccagctttccaagctgcccccaggcggcagagtctgagggtcccggggcccggttggcagctggagaaagaggcaaaaagcccgtagccgggcaagaggagctcaagtcggtctgggcccgttgccaccgactcccacctccagcacccatgcccgctgcaccgctgccatcctcagattcaccgcgtgctctgcgcggccgaggccggagcaccacatccacctcgccccagagaggctctgctccctcctatggaggggctgtgggccaggctgctcagactcctgggtggcttccagacggaccgggcagcccctctccgtcctcagggctgtgcctctgggagccactgggccaggggccccgggtcgcagagagcacgttcccgttatttattcccctccgcgtcctacacaggctgccctggcagctgtcttcaagggtaggctgagctccccaccctggagcccctgagggcggcccctgagcactcctctctctccactctctctgtccctgccccagcggcttccagtgtggcatctcagcagtgtcctggcccctccagagcagtgggacatctggggactgtttttgtgtttaggggaaaaaattctgctgcactctgcttgggccttgaggtctgtggcagggctcctctggcccgcagtggcctggatctatctgggccatgagtgacgggcagtgaccagagggactggaggccagcggtgtccacccttgccctcagcaagagagaatgcattcttaaaagaaagctgtacatgtatatatatgcatatatatatatgtggctctagcctcaggctccagccccagtggggtactgtacagttaactgaagaagaattttaaagacgatttgaacaagaaaatgaaggcagtgggaaagcaatgccaaatggttgtggagaaagtggccggagcctccctggagtggagcagccctgaagcctgtgccccccgacctgcgggccgctgttttggtttgacatgacaaggaaaggacttcctgctgaccctgagagcctctggggtgccgcggcaccacggggcatgcatgattgtgctagcgtttagtctgagttgatctttttaaaactgcaagtgttgaatact

SEQ ID NO: 16120 - DNA, 410 bp, Homo sapiens
  ENST00000503363
cccccttaggctggggctgctgtggcagattgggagggctgtggcacattgcaggggactatggcaggttaagtgtgctgcagcaggggcggaggtatgtccctgccctgtgctggtgctgagagctgcaggcaggccccgtcccactacactgctgtgatggaggagggaaagagggccccagcggccccaccctccagctccctcctcccccagagtggcgccagggccgcatggcgcgcatcatcctgcaggacgaggacgtcaccaccaagattgacaacgattggaagaggctgaacacactggctcactaccaggtgacagacgggtcctcggtggcactggtgcccaagcagacgtccgcctacaacatctccaactcctccaccttcaccaagtccctcagc

SEQ ID NO: 16121 - DNA, 536 bp, Homo sapiens
  ENST00000505278
gaaatggcactggtgtggctgagtgtctgggctcttcacttcatttaagttaagcagccacgtgtggccagtgctgccaggcagcccagctaatggcagtccctgagcctgcccctgcgcttctgggtgaacgtgatcaagaacccacagtttgtgttcgacattcacaagaacagcatcacggacgcctgcttgtcggtggtggcccagaccttcatggactcctgctccacctctgagcacaagctgggcaaggactcaccctccaacaagctgctctacgccaaggacatccccaactacaagagctgggtggagaggtactatgcagacatcgccaagatgccagccatcagcgaccaggacatgagtgcgtatctggctgagcagtcccgcctgcacctgagccagttcaacagcatgagcgccttgcacgagatctactcctacatcaccaagtacaaggatgagatcctggcagccctggagaaggatgagcaggcgcggcggcagcggctgcggagcaagctggagca

SEQ ID NO: 16122 - DNA, 13786 bp, Homo sapiens
  ENST00000359827
gcgagccgcggcggcagcaggcagcccgggagctccggcggcggccgagccagcggcggccccgctccctgccccctgcaaactttgcgagcagcccgcccggggggccgggggcgcgcccgggaggcccggctcggcccgcggccgagctctccgccgccgcagcgccagccgccgcagccaccaccgccgcagccccgcgcctccccggggagcagccggcggctcccgcggccccccagccccggccccagggcactgcccggcgagtgtctcggcaagggtgggggctgccgcggcgcggccggccgcgggctgccggggggcggccgccgctacccagagaggcgcgcagaggcgccgagagcgctccccggcgggtcccccgcgcactcgccgcgcccgggcagcggcccgaccgggcgagcatgggcggcgcggagtgacgccgctgtgcccgcttggcatcaaggacattcagcccgcgggggtggggacgaaggggggcagcccggcgtcgccaccgcagcccccgagagccgccgccgctgctcgggctccggggctgggtggaggaaaggggtgttcggaatcgatccccattttccgacctttttgttggacattacgcccaccttggacgccgcaagagaagctgtcaagccccgcaggctctgattcggcgccctccgcgttcctcggctgctcccggcttccctgtgcctcggtggagtatttgcgttcggggctggggctggaggaggcagccacacgcgcgcacacgcacacgttcagaggagggcgagaggcagcggcataggctccatctgcagtgtcaatgcggcgctcccgctgaaggagggaaacgcggcgcgtccaggggagactgcattgctgagtcctggccctctgaggggacgactgtgcctgagtgctgctgtgccactgggacccgcctctgccatgaaagccatgccctggaactggacctgccttctctcccacctcctcatggtgggcatgggctcctccactttgctcacccggcagccagccccgctgtcccagaagcagcggtcatttgtcacattccgaggagagcccgccgagggtttcaatcacctggtggtggatgagaggacaggacacatttacttgggggccgtcaatcggatttacaagctctccagcgacctgaaggtcttggtgacgcatgagacagggccggacgaggacaaccccaagtgttacccaccccgcatcgtccagacctgcaatgagcccctgaccaccaccaacaatgtcaacaagatgctcctcatagactacaaggagaacaggctgattgcctgtgggagcctgtaccaaggcatctgcaagctgctgaggctggaggacctcttcaagctgggggagccttatcataagaaggagcactatctgtcaggtgtcaacgagagcggctcagtctttggagtgatcgtctcctacagcaacctggatgacaagctgttcattgccacggcagtggatgggaagcccgagtattttcccaccatctccagccggaaactgaccaagaactctgaggcggatggcatgttcgcgtacgtcttccatgatgagttcgtggcctcgatgattaagatcccttcggacaccttcaccatcatccctgactttgatatctactatgtctatggttttagcagtggcaactttgtctactttttgaccctccaacctgagatggtgtctccaccaggctccaccaccaaggagcaggtgtatacatccaagctcgtgaggctttgcaaggaggacacagccttcaactcctatgtagaggtgcccattggctgtgagcgcagtggggtggagtaccgcctgctgcaggctgcctacctgtccaaagcgggggccgtgcttggcaggacccttggagtccatccagatgatgacctgctcttcaccgtcttctccaagggccagaagcggaaaatgaaatccctggatgagtcggccctgtgcatcttcatcttgaagcagataaatgaccgcattaaggagcggctgcagtcttgttaccggggcgagggcacgctggacctggcctggctcaaggtgaaggacatcccctgcagcagtgcgctcttaaccattgacgataacttctgtggcctggacatgaatgctcccctgggagtgtccgacatggtgcgtggaattcccgtcttcacggaggacagggaccgcatgacgtctgtcatcgcatatgtctacaagaaccactctctggcctttgtgggcaccaaaagtggcaagctgaagaagatccgggtggatggacccaggggcaacgccctccagtatgagacggtgcaggtggtggaccccggcccagtcctccgggatatggccttctccaaggaccacgagcaactctacatcatgtcagagaggcagctcaccagagtccctgtggagtcctgtggtcagtatcagagctgcggcgagtgccttggctcaggcgacccccactgtggctggtgtgtgctgcacaacacttgcacccggaaggagcggtgtgagcggtccaaggagccccgcaggtttgcctcggagatgaagcagtgtgtccggctgacggtccatcccaacaatatctccgtctctcagtacaacgtgctgctggtcctggagacgtacaatgtcccggagctgtcagctggcgtcaactgcacctttgaggacctgtcagagatggatgggctggtcgtgggcaatcagatccagtgctactcccctgcagccaaggaggtgccccggatcatcacagagaatggggaccaccatgtcgtacagcttcagctcaaatcaaaggagaccggcatgaccttcgccagcaccagctttgtcttctacaattgcagcgtccacaattcgtgcctgtcctgcgtggagagtccataccgctgccactggtgtaaataccggcatgtctgcacccatgaccccaagacctgctccttccaggaaggccgagtgaagctgcccgaggactgcccccagctgctgcgagtggacaagatcctggtgcccgtggaggtgatcaagcctatcacgctgaaggccaagaacctcccccagccccagtctgggcagcgtggctacgaatgcatcctcaacattcagggcagcgagcagcgagtgcccgccctgcgcttcaacagctccagcgtacagtgccagaacacctcttattcctatgaagggatggagatcaacaacctgcccgtggagttgacagtcgtgtggaatgggcacttcaacattgacaacccagctcagaataaagttcacctctacaagtgtggagccatgcgtgagagctgcgggctgtgcctcaaggctgacccagacttcgcatgtggctggtgccagggcccaggccagtgcaccctgcgccagcactgccctgcccaggagagccagtggctggagctgtctggtgccaaaagcaagtgcacaaacccccgcatcacagagataatcccggtgacaggcccccgggaagggggcaccaaggtcactatccgaggggagaacctgggcctggaatttcgcgacatcgcctcccatgtcaaggttgctggcgtggagtgcagccctttagtggatggttacatccctgcagaacagatcgtgtgtgagatgggggaggccaagcccagccagcatgcaggcttcgtggagatctgcgtggctgtgtgtcggcctgaattcatggcccggtcctcacagctctattacttcatgacactgactctctcagatctgaagcccagccgggggcccatgtccggagggacccaagtgaccatcacaggcaccaacctgaatgccggaagcaacgtggtggtgatgtttggaaagcagccctgtctcttccacaggcgatctccatcctacattgtctgcaacaccacatcctcagatgaggtgctagagatgaaggtgtcggtgcaggtggacagggccaagatccaccaggacctggtctttcagtatgtggaagaccccaccatcgtgcggattgagccagaatggagcattgtcagtggaaacacacccatcgccgtatgggggacccacctggacctcatacagaacccccagatccgtgccaagcatggagggaaggagcacatcaatatctgtgaggttctgaacgctactgagatgacctgtcaggcgcccgccctcgctctgggtcctgaccaccagtcagacctgaccgagaggcccgaggagtttggcttcatcctggacaacgtccagtccctgctcatcctcaacaagaccaacttcacctactatcccaacccggtgtttgaggcctttggtccctcaggaatcctggagctcaagcctggcacgcccatcatcctaaagggcaagaacctgatcccgcctgtggctgggggcaacgtgaagctgaactacactgtgctggttggggagaagccgtgcaccgtgaccgtgtcagatgtccagctgctctgcgagtcccccaacctcatcggcaggcacaaagtgatggcccgtgtcggtggcatggagtactccccggggatggtgtacattgccccggacagcccgctcagcctgcccgccatcgtcagcatcgcagtggctggcggcctcctcatcattttcatcgtggccgtgctcattgcctataaacgcaagtcccgcgaaagtgacctcacgctgaagcggctgcagatgcagatggacaacctggagtcccgtgtggccctggagtgcaaggaagcctttgccgagctgcagacggacatccatgagctgaccagtgacctggatggagccgggattccgttcctggactatagaacttacaccatgcgggtgctgttcccaggaattgaagaccaccctgtcctccgggaccttgaggtcccgggctaccggcaggagcgtgtggagaaaggcctgaagctcttcgcccagctcatcaacaacaaggtgttcctgctgtccttcatccgcacgcttgagtcccagcgtagcttctccatgcgcgaccgtggcaacgtggcctcactcatcatgaccgtgctgcagagcaagctggagtacgccactgatgtgctgaagcagctgctggccgacctcattgacaagaacctggagagcaagaaccaccctaagctgctgctcaggaggactgagtcagtggctgagaagatgctgaccaattggtttactttcctcctctacaagttcctcaaggagtgtgctggggagcccctcttctccctgttctgtgccatcaagcagcagatggagaagggccccattgacgccatcacgggcgaggcccgctactccttgagcgaggacaagctcatccgccagcagattgactacaaaaccctggtcctgagctgtgtcagcccagacaatgccaacagccccgaggtcccagtaaagatcctcaactgtgacaccatcactcaggtcaaggagaagattctggatgccatcttcaagaatgtgccttgctcccaccggcccaaagctgcagatatggatctggagtggcgacaaggaagtggggcaaggatgatcttgcaggatgaagacatcaccaccaagattgagaatgattggaagcgactgaacacactggcccactaccaggtgccagatggttccgtggtggcattagtgtccaagcaggtgacagcctataacgcagtgaacaactccaccgtctccaggacctcagcaagtaaatatgaaaacatgatccggtacacgggcagccccgacagcctccgctcacggacacctatgatcactcctgacctggagagtggagtcaagatgtggcacctagtgaagaaccacgagcacggagaccagaaggagggggaccgggggagcaagatggtgtctgaaatctacctgacccgactcctggccactaagggcacactgcagaagtttgtggatgacctctttgagaccatcttcagcacggcacaccgtggctctgccctgcccctggccatcaagtacatgtttgacttcctggatgagcaggctgataaacatggcattcatgacccgcacgtccgccatacctggaagagcaattgcctgcccctgaggttttgggtcaacatgatcaagaacccgcagtttgtgtttgacatccataagaacagcatcacagacgcctgcctctctgtggtggctcagaccttcatggactcttgctccacgtcagagcaccggctgggcaaggactcgccctccaacaagctgctgtatgccaaggacatccccagctacaagaattgggtggagaggtattactcagacatagggaagatgccagccatcagcgaccaagacatgaacgcatacctggctgagcagtcccggatgcacatgaatgagttcaacaccatgagtgcactctcagagatcttctcctatgtgggcaaatacagcgaggagatccttggacctctggaccacgatgaccagtgtgggaagcagaaactggcctacaaactagaacaagtcataaccctcatgagcttagacagctgagaaccgtccttccagggccgccctggagggggacacaccaagccgtgcctcagtctagattatcatctttaccaagtgcaagttccgactggcatcagcagcatcccctgagcagcgctgtttctctctctttctctctgcctctttccgtttctccctccttcctggatctcttctcttccagttgctctgccaacacgattggaccaagccactgaccctcagttagtccaagaatggccaggcccatggcaagggagctgaccagaagatgtcagagaggcctctgtctcccaggtgctcctgaccctgtgcatgtcagcagcagggtgcaaataacgaatgaggagccagggacaggggacatttctgtgctgctacttcaccttccactttggcagcccctgctttggtctgagccttggcctagggaagaggcaaggaaggacttcagtattatctttactgggaagacatcacctggctctcccttcccacagttccatctccagtggttcagccagtggtctgatcgctttgcagctgtgagaagaaaggctacacctcctgcatgtggctggagcagggcatgtgtgggcagctgggaggtgctccttgaggctccttctcccccactgggctggtgtccagaggcttcctgtccttttccaggtctccagagggacctgcctgccctgcctgctcccccgccagtagaaagccaggcaggagaaagaatagcaattacattccaccatggagatgctcctgaccttttcatctgaatcctagtagcagaaatgtaacacagggggagaaaaggaaagagagttgcatctaccctggaagcagaatttgttttccatttaccctcaaattcaaatgagtcacaatcatagtcataggtctagtccactaccagagccctgagtgctgtcaagagaaagcatctatctccaccctcctttgtcaaccttcatcaagggtcaacgtgaaatgcagagtgcatctaggagattctacctccagccatctccatggctccatccccatcatccttcctgagaactccatagacggctggggccaacagcctagtccctgttccctctgcagaatccggtgccattgctatgcagatgactttgtcactgggctgtccagacctctttgggaatgatttcatcaacatctcagctgtctctcatcattctccttcctcatctcttcagcagtcatccttgaaagaaacagacttaagcaaagcctcacggagacagcccaaaatgccagccaacctcagcctccagcttgtcagatctgggagggacaaagagtcgagctgatgggcctggctggaattaagaagagggacatacaaatgaccttggccttggcatccatctccccatctgttcttacatctacagatgcacgattttagccaggcaggcaaatgtgtgcctagaaattgatactaggtaagcagaggctatggggagagatggtctaatggagggttctaggaacctttcatcctaaggagaccttaggtgctgtctggtgcagtctcccatcctaagcaggagtctctgttggcacctctgctctggagttgttcaccactatgggagacaaggagaaacatcttaggtgaggttgaggagaaggattcacagtcttgccttcactccccaaacatcagacatcattccttgtcacccactcagaatgagccccccttggggaagaaaccacaccatttccagcaaagtccatggagcatccggtacttttaagaacacttgcccctttggatatgaatatgtgcacatgtgtgtgagcacatgtatgtgtgtgtgtgtgtctgccccaggtgtaggcggaaagctcaaaaggatttcttgtcctttgtaggaggatttttgaagtgttccccttctctttccccttgctcatccattcatcctgcagcttcaggacatttcaacacttacttgctttctatgctgagagctggtgggtggaaggagagggcgcttgtccataggaaatcagggtggtcgcctgccgaggcctggaccttggaacagggcatcatgtgacatcgcagaggacagatggtggaaaagacatgagcaacctaatgggaagaggaaaatgggaaacaatgcattggaagaggaagaaaaaaaataaataaccaaaggttttggcaagtgcagtaccaggtggagaagcttgacttttctatccttgatcattttattccctcccaagaagtcagtcacaggacctggaaggccagaaagggtacatgtgggagacggtctgaggaagtacctcggtcactacaatatttttgcacatataaagggttggggaggaaagagacacaaacgtatttaacacagatttgctggatggaagctgcgtgtgtgaacgtgtgtatgagtgagtgcattttgattttttttttttttttttgcacagttaagagaaaaaatcaaacaagcagaaaaaaaaaagaaaaaagacttatcacggttctgctgaagcttttattttttactggatgatgattattgttattgttactttggcggtacaggactttattttattccatgtttttgttataagaaaaatttcaaacacctcagagaaatagaaaggttaggaagaaagaggagacaaggacagacaaattttctggctgtccccatttctcctgggggaggggtttggggctggtttgactttaattggtgggtgggttgtttctgccgctctgtttgctgcagtccccgtggcctgcttggggactgagaaatttgagccaggtatccagagccacagcccatcttgcttataaaaattatcttctgctgtttgttttccatttcttccgtttggattcttggtgcacgtgtgatatggtatttaaaagcaaagacaagcaacattgtcaaaaagctgtccttgccccccatcccccacccaaatcttttttccaaactcccccagggatcttccttaccccactggcagagcaaacatccaggggctgtccatgtggcttgcgggctcccagagaaaggaattgggccaactttgtcctgtgggatggaggccccttcacggcctccctcgaggcaaagttaatttgtagggtcaccattatgttgagtcatgagcagacagaaggagagaaaaggccatcttccttaccttcccctccaacttatcccgtaccctcccagggaaaatggtaccagactgagccatcaaaatcactgacaaagtttaggtgggaattttttttgcatgttggagagagaagggcttaaggtagcagggaagaagggggctttgtggggtcctaaattttaaggaataagtagaggaagacaagaaacagagtggtaggctggtcatttctcctggccacaagtccccccagatgcagcttttacccattctttgtccttccccataaggagagaccctgacatttcttggtagctgcaaatagtgccactaagtgaaggtggccatcatgccagttacttcctcaggaaaatattttcttgccttcttctttcagtatggttttaaatttgggaacagtggataacccaagtgtcccacaggccaaggtacattccaatggcagcatgatccctgcacccaaagccagcccctaaagcctaccccttgtgcacccgcagcctggtaagtgagcttggctgcttgtgaggagctacaagtgaaagagaagttattttaaataaatcccaaagtttgaggcagactgtccaggactgttcccaggaagaagcaggagttacccacaggaaaagtctctgacctggtcccctcaggcccagctacctgcgcccaccagcagtgaaggttgatgtactggcccagcatctccacctcccccatgcaaccaggtccctggtaccgtgtctcccgttgcatgtctggcttctgcctgtgctcctcctgccacgagcatcctccctgtccctcctcattccaccgtgtctctcctgcacacatagcctctgtcccagggcgatttatccacttgagtacaggagctgctcagacctctcagcccagccctctgtgactgccccagccccatcctaccccacccaaagctgccttcctggctgtaggagctccctcgtctagccaaggccctatgggtccccatccgaggatccacaagcaatgacttcccaaatgacctccactgcaagaagaatccttaccactgtttccagagccgtgaacgatgctgtgatgggcccaggtctcagcaccaccctctgtgacctaaaaagaaaagctcaatttccatctgtcttctttcccaggaccaaggggacacagtaatgtgaagtcaaatacttaaccgagcaaagggccagtattgttatcagtcaaggacaaacctcccacctcacagacagccaagcagtgagggaaagacagacagacataggtaggaaggtgctctgcaggcacaaggcccagagaagcccctctccgggaacttcccctgctccttccaggaacagtgagcccagtgagcagccccagccagctcttcaaggccttcaaggggtctttccatgactgagtcacctccaggagctcacctgacccccagagaagacctaccccaggcagctccgtgccctggcttctccccatgccccaaatccccccccgccatccctcctggtcctcgtctacatcaagggcctcttcccctcttcctgccagctctcaggacaggtgactgggaggccttgaaccctcagcctcttcctttaaaaaaaacaaaacaaaacaaaactgtgggccatttatttgggattttggagttgtttggtttttgtttgtatatcttaatagttcgaaagtaagaagggagccctgctatggatgttaagtccaaattactcggttagtgggagcaaaacctatgacttccaaggggatgaggagaggttcagaggacaggaggagcctcccccattgaaaaaaaaaaatgggtcaggacattccctggatgaggacaatgctaggggtggcatctcacatggctgctgctattcctggtgcttccccacacttttgacagatggagtccttctcctaccgcctcctgccacctcaccctacaggcattctctatgtaggaaacaagagccttattttatagagtggggagctgagacacagcctcaggtaacactgacacagctcccgaatgaggctgggacactctgcaaacctctcctcatggtgctaagggtggcatgctcttgacaggaaacctaaatgaccactcctctcatttggaaagtaatccactgcagtaaaagtttcagacatgcaagagagagtttttttttttttactacaaatttttgctcccccataaaattattttattagagggagtatccaagttttaaaagtatatagaattttttggttgtaagagaaatacatactcattaggatcccgattaaattccttgagtagactggtgcctaccagaaagcaaagcaaagttaaacaaaacgaaacaaaatccttcatatacaaaaagaactttctgtttgtattggcagaggtagtgaggtgattcaggtaggctgaaaatcctgggttgcgggagcctcactttattccattcccacccgctttgatgtctatgcttggctctctgggctgcccctggtactgccgaatcctacacatctcttatcagctttcctcaaactttaaggaggctctgtgagggatgggtcatgggaagacccaagctttccctccgccaggattgcaaaagcaagtagacttggtctatgcagctcttcttccagcaatttctttatttggaattagaacttcctttgttagtatctttgatcttttgactcaagcacattttggaagggctcccttacaaaagtagaatttaaaacagaggatacagttaaagagcaacccaaaggacgcttaagaaaccgagaccacttcaccaaacaggactaaggaacactttcgtgcacagaagtcagccgcaatccaggcacaggacgaagatgggatacacgtgctcatctgtctgtcctcctttcctctccctccccgacgttctagttagcttgttgacttgttaaaccttctgttcttaaaatgaaaagctagcttacctcaaagaatcttgtttccattcggaaaccaacgattttgtgttttagaatggacagccctcccctcaccactccctaccttggcctggtgtccttgagacatacggtctttgcttagtcgtgtgttggctgctttgagcaggaacaaggcctccaggccctgaggtgggaaggaaggattggatgccactgccctcctccccactttagcatgtaggggccagcccatctcttccagcagggtcctgctgagttaccatagcaaccagcaactccagggtaccacaacagacaatggctcagcgagccgacgtgtggggatgatgcaggggttttggcccagccagaggacccagagttgagcttcaaatgctagagaaggggagaaacaggatggaagggtggtttaaggaaccggcaggggtctttgagtcacatagagaagccgttgaaggaggtagggcaggttatctctgttccagtcacccccttccagccccatcccacttctgtttcaaactaaagctcccacctcgaacattgaccctttgttagaacaaagcaaagcatatctttagacaacagtgttaaaatgagcctcaaatgtatgtggatgagatctctaagaagagggtcttctggttttgatttttaaagaagagtatcctagtaaaatattaaaaaaaaattaaaaagtttttaaaaaggaaacctgtgctatttaaattggagcccagttgtaacttggtaaaggcaagcttctgtacctttgttataattaattgtatacctgtgtatgtaaatataaggcattcctattttgcagttcagaacaaaaaaaacttatttgtaatatagaataaagtttattaaaaaataataaaaatgc

SEQ ID NO: 16123 - DNA, 597 bp, Homo sapiens
  ENST00000496550
tcagtgttatatctcttttccatgtgcaggggaaatttaaagctgttagagacagatgaaatgggaaaaaatgatttaatgcatggacttacccaattttacccaagtagggtgggctgtataccatcctcccctgcctaggtctgtgaggcaggttttaaaagccatcctcagaactacgtgagtcgagctgtgtctggacgtatcctgcctctccagggcacactgcagaagtttgtggatgacctctttgagaccatcttcagcacggcacaccgtggctctgccctgcccctggccatcaagtacatgtttgacttcctggatgagcaggctgataaacatggcattcatgacccgcacgtccgccatacctggaagagcaattgcctgcccctgaggttttgggtcaacatgatcaagaacccgcagtttgtgtttgacatccataagaacagcatcacagacgcctgcctctctgtggtggctcagaccttcatggactcttgctccacgtcagagcaccggctgggcaaggactcgccctccaacaagctgctgtatgccaaggacatccccagctacaagaattgggtg

SEQ ID NO: 16124 - DNA, 3314 bp, Homo sapiens
  ENST00000423507
agtgtcaatgcggcgctcccgctgaaggagggaaacgcggcgcgtccagtaggggagactgcattgctgagtcctggccctctgaggggacgactgtgcctgagtgctgctgtgccactgggacccgcctctgccatgaaagccatgccctggaactggacctgccttctctcccacctcctcatggtgggcatgggctcctccactttgctcacccggcagccagccccgctgtcccagaagcagcggtcatttgtcacattccgaggagagcccgccgagggtttcaatcacctggtggtggatgagaggacaggacacatttacttgggggccgtcaatcggatttacaagctctccagcgacctgaaggtcttggtgacgcatgagacagggccggacgaggacaaccccaagtgttacccaccccgcatcgtccagacctgcaatgagcccctgaccaccaccaacaatgtcaacaagatgctcctcatagactacaaggagaacaggctgattgcctgtgggagcctgtaccaaggcatctgcaagctgctgaggctggaggacctcttcaagctgggggagccttatcataagaaggagcactatctgtcaggtgtcaacgagagcggctcagtctttggagtgatcgtctcctacagcaacctggatgacaagctgttcattgccacggcagtggatgggaagcccgagtattttcccaccatctccagccggaaactgaccaagaactctgaggcggatggcatgttcgcgtacgtcttccatgatgagttcgtggcctcgatgattaagatcccttcggacaccttcaccatcatccctgactttgatatctactatgtctatggttttagcagtggcaactttgtctactttttgaccctccaacctgagatggtgtctccaccaggctccaccaccaaggagcaggtgtatacatccaagctcgtgaggctttgcaaggaggacacagccttcaactcctatgtagaggtgcccattggctgtgagcgcagtggggtggagtaccgcctgctgcaggctgcctacctgtccaaagcgggggccgtgcttggcaggacccttggagtccatccagatgatgacctgctcttcaccgtcttctccaagggccagaagcggaaaatgaaatccctggatgagtcggccctgtgcatcttcatcttgaagcagataaatgaccgcattaaggagcggctgcagtcttgttaccggggcgagggcacgctggacctggcctggctcaaggtgaaggacatcccctgcagcagtgcgctcttaaccattgacgataacttctgtggcctggacatgaatgctcccctgggagtgtccgacatggtgcgtggaattcccgtcttcacggaggacagggaccgcatgacgtctgtcatcgcatatgtctacaagaaccactctctggcctttgtgggcaccaaaagtggcaagctgaagaagatgcctggtaccagcctctgccctacccttgagctacagacgggaccccgatcccacagagcaacagtgactctggaactcctgttctccagctgttcatcaaactgagaaaaacttcagagctgtgtaggcttatttagtgtgttgtcagccttggatattggaaaatggaaacagatgagacacatctacctccctgtgaccccagccatacatcatagctcatgtcctgccaccccaagtccttagggaaaaaagactttggagaatgtgtctctgcttagcttggctaggtagttggtctcttttctctgccccaagcgtcccatgggtaattttggacaatggagtgtaggcatgtttgactcttgtggtgttatcacttgtatatgtcagtgaaactaactgattctcccatcggaatatagttatctcttgggcctgatatatggtaggataaccttatgctcatctgtccacttctgcagccaagtcgcctggccagtgtgtgtgtgtgtgtgtgtgtgtgtgtgtgtgtgtgtgtgtgtgtatgcttatctgtgtttaaaggtgtgtgtgcatacacagggcagagaggatggagcccaccgtactgcagcatcatgtaattaactcagtgctcagaaccatcccagcctctgcgggaaagagaaaaggaagccaacagtgcctgatgagctgatcatatgtgcaaaagctctgttggcatctggtccaggagagcacccaaaaaaagttaattggtgttgtccagtctcctttccttaagactatggttacaacaaagcgtgagcagtgtctcctgcatggccactatccagcacaattccataattcccccatagagccggtggggaggaggaggtgagtggcgaaggaagtggaaacacttggtgtcatgtgctcctatcatttctactagcttactgggaaataaagtgtagtcaagagtgtatgaaggcaagatgtaaaattagcgactggtgctaatctggttacttgaaaacaagtgaaagtgctgtagatttgttctgttgctaagaaccaccacactaaacctcgtatagttcctggaggatacacaacagtgtaattctctttagggtgtgccacaggttcctggcctgtgggagggaatgaatcaggagggctcttgagaaccttcatctgtgtgcttgcactgaaagtgagtcccaaagctggagatttagtgagagcaggcaacccctctgtgtctcactgtccatattctggaggcagaggtttgtaacaggccatgtgcacctgcatagggatgggtaaagcaaggactttgaaagagttgaaaagcattataaacagttgttcagaaatacgtcccaggagttccatgtgaaactggctctgtgtgcattgaagcatggctgttgggaattctaactggtccaacactcctgcaaaacaatgtgtaaatatttaggaagaaacttgaaaatagtcaaatcctttgaactggtgacaattttttaaagaatcaattctaatttgtttcaagggtaataatcaccaagatacacatttcagcatttatttagtctatcaaaaattggaattgatatatacactcatttataggagaatggttaggtagatttggtatatttatgtagtcattgaaaacttagtttataaaggccaatcttgtaactgattcttgtgtgataacattcagtgaaaaagcatgagacaattagaaagcatgatacaatgaataaaataaaaactggaaagagaaccatcaaaatgct

SEQ ID NO: 16125 - DNA, 2004 bp, Homo sapiens
  ENST00000378539
atgagatgcagaccacatggagaccttaatgcatggagatcttgcccactagtagcgtggcccagcgttttgggacacagcccaatcagaccagtatttcccctctggagctggattgaggagggaacatggggactgaaaccttgaatgcttctgctttaattaccccgaaaagcaagtgccactgttagaaatggaaatcaggccagctgctggggcggcaagcagcaggaatgcaaatgtccatgacccctcagatccacacaaagccttctgaccttggaatttaagtaggggagactgcattgctgagtcctggccctctgaggggacgactgtgcctgagtgctgctgtgccactgggacccgcctctgccatgaaagccatgccctggaactggacctgccttctctcccacctcctcatggtgggcatgggctcctccactttgctcacccggcagccagccccgctgtcccagaagcagcggtcatttgtcacattccgaggagagcccgccgagggtttcaatcacctggtggtggatgagaggacaggacacatttacttgggggccgtcaatcggatttacaagctctccagcgacctgaaggtcttggtgacgcatgagacagggccggacgaggacaaccccaagtgttacccaccccgcatcgtccagacctgcaatgagcccctgaccaccaccaacaatgtcaacaagatgctcctcatagactacaaggagaacaggctgattgcctgtgggagcctgtaccaaggcatctgcaagctgctgaggctggaggacctcttcaagctgggggagccttatcataagaaggagcactatctgtcaggtgtcaacgagagcggctcagtctttggagtgatcgtctcctacagcaacctggatgacaagctgttcattgccacggcagtggatgggaagcccgagtattttcccaccatctccagccggaaactgaccaagaactctgaggcggatggcatgttcgcgtacgtcttccatgatgagttcgtggcctcgatgattaagatcccttcggacaccttcaccatcatccctgactttgatatctactatgtctatggttttagcagtggcaactttgtctactttttgaccctccaacctgagatggtgtctccaccaggctccaccaccaaggagcaggtgtatacatccaagctcgtgaggctttgcaaggaggacacagccttcaactcctatgtagaggtgcccattggctgtgagcgcagtggggtggagtaccgcctgctgcaggctgcctacctgtccaaagcgggggccgtgcttggcaggacccttggagtccatccagatgatgacctgctcttcaccgtcttctccaagggccagaagcggaaaatgaaatccctggatgagtcggccctgtgcatcttcatcttgaagcagataaatgaccgcattaaggagcggctgcagtcttgttaccggggcgagggcacgctggacctggcctggctcaaggtgaaggacatcccctgcagcagtgcgctcttaaccattgacgataacttctgtggcctggacatgaatgctcccctgggagtgtccgacatggtgcgtggaattcccgtcttcacggaggacagggaccgcatgacgtctgtcatcgcatatgtctacaagaaccactctctggcctttgtgggcaccaaaagtggcaagctgaagaagtccttcggcacaggtccacaagggggaatcacccaggagtggattggagtggagggagacccacctggggcgaacattgcttctcaggaacagatgctgtgtgtgtatcttcagtgctcaagtcacaaagcaatatcagatcagagagtccagcctctgctttgttgcttcctaaatgtacctgggaattcttcctaaaattactctggaaatttgaatccactttaactaaaaataaatattcatagcacagaaa

SEQ ID NO: 16126 - DNA, 13061 bp, Homo sapiens
  ENST00000321063
tgcgttcggggctggggctggaggaggcagccacacgcgcgcacacgcacacgttcagaggagggcgagaggcagcggcataggctccatctgcagtgtcaatgcggcgctcccgctgaaggagggaaacgcggcgcgtccagtaggggagactgcattgctgagtcctggccctctgaggggacgactgtgcctgagtgctgctgtgccactgggacccgcctctgccatgaaagccatgccctggaactggacctgccttctctcccacctcctcatggtgggcatgggctcctccactttgctcacccggcagccagccccgctgtcccagaagcagcggtcatttgtcacattccgaggagagcccgccgagggtttcaatcacctggtggtggatgagaggacaggacacatttacttgggggccgtcaatcggatttacaagctctccagcgacctgaaggtcttggtgacgcatgagacagggccggacgaggacaaccccaagtgttacccaccccgcatcgtccagacctgcaatgagcccctgaccaccaccaacaatgtcaacaagatgctcctcatagactacaaggagaacaggctgattgcctgtgggagcctgtaccaaggcatctgcaagctgctgaggctggaggacctcttcaagctgggggagccttatcataagaaggagcactatctgtcaggtgtcaacgagagcggctcagtctttggagtgatcgtctcctacagcaacctggatgacaagctgttcattgccacggcagtggatgggaagcccgagtattttcccaccatctccagccggaaactgaccaagaactctgaggcggatggcatgttcgcgtacgtcttccatgatgagttcgtggcctcgatgattaagatcccttcggacaccttcaccatcatccctgactttgatatctactatgtctatggttttagcagtggcaactttgtctactttttgaccctccaacctgagatggtgtctccaccaggctccaccaccaaggagcaggtgtatacatccaagctcgtgaggctttgcaaggaggacacagccttcaactcctatgtagaggtgcccattggctgtgagcgcagtggggtggagtaccgcctgctgcaggctgcctacctgtccaaagcgggggccgtgcttggcaggacccttggagtccatccagatgatgacctgctcttcaccgtcttctccaagggccagaagcggaaaatgaaatccctggatgagtcggccctgtgcatcttcatcttgaagcagataaatgaccgcattaaggagcggctgcagtcttgttaccggggcgagggcacgctggacctggcctggctcaaggtgaaggacatcccctgcagcagtgcgctcttaaccattgacgataacttctgtggcctggacatgaatgctcccctgggagtgtccgacatggtgcgtggaattcccgtcttcacggaggacagggaccgcatgacgtctgtcatcgcatatgtctacaagaaccactctctggcctttgtgggcaccaaaagtggcaagctgaagaagatccgggtggatggacccaggggcaacgccctccagtatgagacggtgcaggtggtggaccccggcccagtcctccgggatatggccttctccaaggaccacgagcaactctacatcatgtcagagaggcagctcaccagagtccctgtggagtcctgtggtcagtatcagagctgcggcgagtgccttggctcaggcgacccccactgtggctggtgtgtgctgcacaacacttgcacccggaaggagcggtgtgagcggtccaaggagccccgcaggtttgcctcggagatgaagcagtgtgtccggctgacggtccatcccaacaatatctccgtctctcagtacaacgtgctgctggtcctggagacgtacaatgtcccggagctgtcagctggcgtcaactgcacctttgaggacctgtcagagatggatgggctggtcgtgggcaatcagatccagtgctactcccctgcagccaaggaggtgccccggatcatcacagagaatggggaccaccatgtcgtacagcttcagctcaaatcaaaggagaccggcatgaccttcgccagcaccagctttgtcttctacaattgcagcgtccacaattcgtgcctgtcctgcgtggagagtccataccgctgccactggtgtaaataccggcatgtctgcacccatgaccccaagacctgctccttccaggaaggccgagtgaagctgcccgaggactgcccccagctgctgcgagtggacaagatcctggtgcccgtggaggtgatcaagcctatcacgctgaaggccaagaacctcccccagccccagtctgggcagcgtggctacgaatgcatcctcaacattcagggcagcgagcagcgagtgcccgccctgcgcttcaacagctccagcgtacagtgccagaacacctcttattcctatgaagggatggagatcaacaacctgcccgtggagttgacagtcgtgtggaatgggcacttcaacattgacaacccagctcagaataaagttcacctctacaagtgtggagccatgcgtgagagctgcgggctgtgcctcaaggctgacccagacttcgcatgtggctggtgccagggcccaggccagtgcaccctgcgccagcactgccctgcccaggagagccagtggctggagctgtctggtgccaaaagcaagtgcacaaacccccgcatcacagagataatcccggtgacaggcccccgggaagggggcaccaaggtcactatccgaggggagaacctgggcctggaatttcgcgacatcgcctcccatgtcaaggttgctggcgtggagtgcagccctttagtggatggttacatccctgcagaacagatcgtgtgtgagatgggggaggccaagcccagccagcatgcaggcttcgtggagatctgcgtggctgtgtgtcggcctgaattcatggcccggtcctcacagctctattacttcatgacactgactctctcagatctgaagcccagccgggggcccatgtccggagggacccaagtgaccatcacaggcaccaacctgaatgccggaagcaacgtggtggtgatgtttggaaagcagccctgtctcttccacaggcgatctccatcctacattgtctgcaacaccacatcctcagatgaggtgctagagatgaaggtgtcggtgcaggtggacagggccaagatccaccaggacctggtctttcagtatgtggaagaccccaccatcgtgcggattgagccagaatggagcattgtcagtggaaacacacccatcgccgtatgggggacccacctggacctcatacagaacccccagatccgtgccaagcatggagggaaggagcacatcaatatctgtgaggttctgaacgctactgagatgacctgtcaggcgcccgccctcgctctgggtcctgaccaccagtcagacctgaccgagaggcccgaggagtttggcttcatcctggacaacgtccagtccctgctcatcctcaacaagaccaacttcacctactatcccaacccggtgtttgaggcctttggtccctcaggaatcctggagctcaagcctggcacgcccatcatcctaaagggcaagaacctgatcccgcctgtggctgggggcaacgtgaagctgaactacactgtgctggttggggagaagccgtgcaccgtgaccgtgtcagatgtccagctgctctgcgagtcccccaacctcatcggcaggcacaaagtgatggcccgtgtcggtggcatggagtactccccggggatggtgtacattgccccggacagcccgctcagcctgcccgccatcgtcagcatcgcagtggctggcggcctcctcatcattttcatcgtggccgtgctcattgcctataaacgcaagtcccgcgaaagtgacctcacgctgaagcggctgcagatgcagatggacaacctggagtcccgtgtggccctggagtgcaaggaagcctttgccgagctgcagacggacatccatgagctgaccagtgacctggatggagccgggattccgttcctggactatagaacttacaccatgcgggtgctgttcccaggaattgaagaccaccctgtcctccgggaccttgaggtcccgggctaccggcaggagcgtgtggagaaaggcctgaagctcttcgcccagctcatcaacaacaaggtgttcctgctgtccttcatccgcacgcttgagtcccagcgtagcttctccatgcgcgaccgtggcaacgtggcctcactcatcatgaccgtgctgcagagcaagctggagtacgccactgatgtgctgaagcagctgctggccgacctcattgacaagaacctggagagcaagaaccaccctaagctgctgctcaggaggactgagtcagtggctgagaagatgctgaccaattggtttactttcctcctctacaagttcctcaaggagtgtgctggggagcccctcttctccctgttctgtgccatcaagcagcagatggagaagggccccattgacgccatcacgggcgaggcccgctactccttgagcgaggacaagctcatccgccagcagattgactacaaaaccctggtcctgagctgtgtcagcccagacaatgccaacagccccgaggtcccagtaaagatcctcaactgtgacaccatcactcaggtcaaggagaagattctggatgccatcttcaagaatgtgccttgctcccaccggcccaaagctgcagatatggatctggagtggcgacaaggaagtggggcaaggatgatcttgcaggatgaagacatcaccaccaagattgagaatgattggaagcgactgaacacactggcccactaccaggtgccagatggttccgtggtggcattagtgtccaagcaggtgacagcctataacgcagtgaacaactccaccgtctccaggacctcagcaagtaaatatgaaaacatgatccggtacacgggcagccccgacagcctccgctcacggacacctatgatcactcctgacctggagagtggagtcaagatgtggcacctagtgaagaaccacgagcacggagaccagaaggagggggaccgggggagcaagatggtgtctgaaatctacctgacccgactcctggccactaagggcacactgcagaagtttgtggatgacctctttgagaccatcttcagcacggcacaccgtggctctgccctgcccctggccatcaagtacatgtttgacttcctggatgagcaggctgataaacatggcattcatgacccgcacgtccgccatacctggaagagcaattgcctgcccctgaggttttgggtcaacatgatcaagaacccgcagtttgtgtttgacatccataagaacagcatcacagacgcctgcctctctgtggtggctcagaccttcatggactcttgctccacgtcagagcaccggctgggcaaggactcgccctccaacaagctgctgtatgccaaggacatccccagctacaagaattgggtggagaggtattactcagacatagggaagatgccagccatcagcgaccaagacatgaacgcatacctggctgagcagtcccggatgcacatgaatgagttcaacaccatgagtgcactctcagagatcttctcctatgtgggcaaatacagcgaggagatccttggacctctggaccacgatgaccagtgtgggaagcagaaactggcctacaaactagaacaagtcataaccctcatgagcttagacagctgagaaccgtccttccagggccgccctggagggggacacaccaagccgtgcctcagtctagattatcatctttaccaagtgcaagttccgactggcatcagcagcatcccctgagcagcgctgtttctctctctttctctctgcctctttccgtttctccctccttcctggatctcttctcttccagttgctctgccaacacgattggaccaagccactgaccctcagttagtccaagaatggccaggcccatggcaagggagctgaccagaagatgtcagagaggcctctgtctcccaggtgctcctgaccctgtgcatgtcagcagcagggtgcaaataacgaatgaggagccagggacaggggacatttctgtgctgctacttcaccttccactttggcagcccctgctttggtctgagccttggcctagggaagaggcaaggaaggacttcagtattatctttactgggaagacatcacctggctctcccttcccacagttccatctccagtggttcagccagtggtctgatcgctttgcagctgtgagaagaaaggctacacctcctgcatgtggctggagcagggcatgtgtgggcagctgggaggtgctccttgaggctccttctcccccactgggctggtgtccagaggcttcctgtccttttccaggtctccagagggacctgcctgccctgcctgctcccccgccagtagaaagccaggcaggagaaagaatagcaattacattccaccatggagatgctcctgaccttttcatctgaatcctagtagcagaaatgtaacacagggggagaaaaggaaagagagttgcatctaccctggaagcagaatttgttttccatttaccctcaaattcaaatgagtcacaatcatagtcataggtctagtccactaccagagccctgagtgctgtcaagagaaagcatctatctccaccctcctttgtcaaccttcatcaagggtcaacgtgaaatgcagagtgcatctaggagattctacctccagccatctccatggctccatccccatcatccttcctgagaactccatagacggctggggccaacagcctagtccctgttccctctgcagaatccggtgccattgctatgcagatgactttgtcactgggctgtccagacctctttgggaatgatttcatcaacatctcagctgtctctcatcattctccttcctcatctcttcagcagtcatccttgaaagaaacagacttaagcaaagcctcacggagacagcccaaaatgccagccaacctcagcctccagcttgtcagatctgggagggacaaagagtcgagctgatgggcctggctggaattaagaagagggacatacaaatgaccttggccttggcatccatctccccatctgttcttacatctacagatgcacgattttagccaggcaggcaaatgtgtgcctagaaattgatactaggtaagcagaggctatggggagagatggtctaatggagggttctaggaacctttcatcctaaggagaccttaggtgctgtctggtgcagtctcccatcctaagcaggagtctctgttggcacctctgctctggagttgttcaccactatgggagacaaggagaaacatcttaggtgaggttgaggagaaggattcacagtcttgccttcactccccaaacatcagacatcattccttgtcacccactcagaatgagccccccttggggaagaaaccacaccatttccagcaaagtccatggagcatccggtacttttaagaacacttgcccctttggatatgaatatgtgcacatgtgtgtgagcacatgtatgtgtgtgtgtgtgtctgccccaggtgtaggcggaaagctcaaaaggatttcttgtcctttgtaggaggatttttgaagtgttccccttctctttccccttgctcatccattcatcctgcagcttcaggacatttcaacacttacttgctttctatgctgagagctggtgggtggaaggagagggcgcttgtccataggaaatcagggtggtcgcctgccgaggcctggaccttggaacagggcatcatgtgacatcgcagaggacagatggtggaaaagacatgagcaacctaatgggaagaggaaaatgggaaacaatgcattggaagaggaagaaaaaaaataaataaccaaaggttttggcaagtgcagtaccaggtggagaagcttgacttttctatccttgatcattttattccctcccaagaagtcagtcacaggacctggaaggccagaaagggtacatgtgggagacggtctgaggaagtacctcggtcactacaatatttttgcacatataaagggttggggaggaaagagacacaaacgtatttaacacagatttgctggatggaagctgcgtgtgtgaacgtgtgtatgagtgagtgcattttgattttttttttttttttttgcacagttaagagaaaaaatcaaacaagcagaaaaaaaaaagaaaaaagacttatcacggttctgctgaagcttttattttttactggatgatgattattgttattgttactttggcggtacaggactttattttattccatgtttttgttataagaaaaatttcaaacacctcagagaaatagaaaggttaggaagaaagaggagacaaggacagacaaattttctggctgtccccatttctcctgggggaggggtttggggctggtttgactttaattggtgggtgggttgtttctgccgctctgtttgctgcagtccccgtggcctgcttggggactgagaaatttgagccaggtatccagagccacagcccatcttgcttataaaaattatcttctgctgtttgttttccatttcttccgtttggattcttggtgcacgtgtgatatggtatttaaaagcaaagacaagcaacattgtcaaaaagctgtccttgccccccatcccccacccaaatcttttttccaaactcccccagggatcttccttaccccactggcagagcaaacatccaggggctgtccatgtggcttgcgggctcccagagaaaggaattgggccaactttgtcctgtgggatggaggccccttcacggcctccctcgaggcaaagttaatttgtagggtcaccattatgttgagtcatgagcagacagaaggagagaaaaggccatcttccttaccttcccctccaacttatcccgtaccctcccagggaaaatggtaccagactgagccatcaaaatcactgacaaagtttaggtgggaattttttttgcatgttggagagagaagggcttaaggtagcagggaagaagggggctttgtggggtcctaaattttaaggaataagtagaggaagacaagaaacagagtggtaggctggtcatttctcctggccacaagtccccccagatgcagcttttacccattctttgtccttccccataaggagagaccctgacatttcttggtagctgcaaatagtgccactaagtgaaggtggccatcatgccagttacttcctcaggaaaatattttcttgccttcttctttcagtatggttttaaatttgggaacagtggataacccaagtgtcccacaggccaaggtacattccaatggcagcatgatccctgcacccaaagccagcccctaaagcctaccccttgtgcacccgcagcctggtaagtgagcttggctgcttgtgaggagctacaagtgaaagagaagttattttaaataaatcccaaagtttgaggcagactgtccaggactgttcccaggaagaagcaggagttacccacaggaaaagtctctgacctggtcccctcaggcccagctacctgcgcccaccagcagtgaaggttgatgtactggcccagcatctccacctcccccatgcaaccaggtccctggtaccgtgtctcccgttgcatgtctggcttctgcctgtgctcctcctgccacgagcatcctccctgtccctcctcattccaccgtgtctctcctgcacacatagcctctgtcccagggcgatttatccacttgagtacaggagctgctcagacctctcagcccagccctctgtgactgccccagccccatcctaccccacccaaagctgccttcctggctgtaggagctccctcgtctagccaaggccctatgggtccccatccgaggatccacaagcaatgacttcccaaatgacctccactgcaagaagaatccttaccactgtttccagagccgtgaacgatgctgtgatgggcccaggtctcagcaccaccctctgtgacctaaaaagaaaagctcaatttccatctgtcttctttcccaggaccaaggggacacagtaatgtgaagtcaaatacttaaccgagcaaagggccagtattgttatcagtcaaggacaaacctcccacctcacagacagccaagcagtgagggaaagacagacagacataggtaggaaggtgctctgcaggcacaaggcccagagaagcccctctccgggaacttcccctgctccttccaggaacagtgagcccagtgagcagccccagccagctcttcaaggccttcaaggggtctttccatgactgagtcacctccaggagctcacctgacccccagagaagacctaccccaggcagctccgtgccctggcttctccccatgccccaaatccccccccgccatccctcctggtcctcgtctacatcaagggcctcttcccctcttcctgccagctctcaggacaggtgactgggaggccttgaaccctcagcctcttcctttaaaaaaaacaaaacaaaacaaaactgtgggccatttatttgggattttggagttgtttggtttttgtttgtatatcttaatagttcgaaagtaagaagggagccctgctatggatgttaagtccaaattactcggttagtgggagcaaaacctatgacttccaaggggatgaggagaggttcagaggacaggaggagcctcccccattgaaaaaaaaaaatgggtcaggacattccctggatgaggacaatgctaggggtggcatctcacatggctgctgctattcctggtgcttccccacacttttgacagatggagtccttctcctaccgcctcctgccacctcaccctacaggcattctctatgtaggaaacaagagccttattttatagagtggggagctgagacacagcctcaggtaacactgacacagctcccgaatgaggctgggacactctgcaaacctctcctcatggtgctaagggtggcatgctcttgacaggaaacctaaatgaccactcctctcatttggaaagtaatccactgcagtaaaagtttcagacatgcaagagagagtttttttttttttactacaaatttttgctcccccataaaattattttattagagggagtatccaagttttaaaagtatatagaattttttggttgtaagagaaatacatactcattaggatcccgattaaattccttgagtagactggtgcctaccagaaagcaaagcaaagttaaacaaaacgaaacaaaatccttcatatacaaaaagaactttctgtttgtattggcagaggtagtgaggtgattcaggtaggctgaaaatcctgggttgcgggagcctcactttattccattcccacccgctttgatgtctatgcttggctctctgggctgcccctggtactgccgaatcctacacatctcttatcagctttcctcaaactttaaggaggctctgtgagggatgggtcatgggaagacccaagctttccctccgccaggattgcaaaagcaagtagacttggtctatgcagctcttcttccagcaatttctttatttggaattagaacttcctttgttagtatctttgatcttttgactcaagcacattttggaagggctcccttacaaaagtagaatttaaaacagaggatacagttaaagagcaacccaaaggacgcttaagaaaccgagaccacttcaccaaacaggactaaggaacactttcgtgcacagaagtcagccgcaatccaggcacaggacgaagatgggatacacgtgctcatctgtctgtcctcctttcctctccctccccgacgttctagttagcttgttgacttgttaaaccttctgttcttaaaatgaaaagctagcttacctcaaagaatcttgtttccattcggaaaccaacgattttgtgttttagaatggacagccctcccctcaccactccctaccttggcctggtgtccttgagacatacggtctttgcttagtcgtgtgttggctgctttgagcaggaacaaggcctccaggccctgaggtgggaaggaaggattggatgccactgccctcctccccactttagcatgtaggggccagcccatctcttccagcagggtcctgctgagttaccatagcaaccagcaactccagggtaccacaacagacaatggctcagcgagccgacgtgtggggatgatgcaggggttttggcccagccagaggacccagagttgagcttcaaatgctagagaaggggagaaacaggatggaagggtggtttaaggaaccggcaggggtctttgagtcacatagagaagccgttgaaggaggtagggcaggttatctctgttccagtcacccccttccagccccatcccacttctgtttcaaactaaagctcccacctcgaacattgaccctttgttagaacaaagcaaagcatatctttagacaacagtgttaaaatgagcctcaaatgtatgtggatgagatctctaagaagagggtcttctggttttgatttttaaagaagagtatcctagtaaaatattaaaaaaaaattaaaaagtttttaaaaaggaaacctgtgctatttaaattggagcccagttgtaacttggtaaaggcaagcttctgtacctttgttataattaattgtatacctgtgtatgtaaatataaggcattcctattttgcagttcagaacaaaaaaaacttatttgtaatatagaataaagtttattaaaaaataataaaaatgcagtttggga

SEQ ID NO: 16127 - DNA, 7143 bp, Homo sapiens
  ENST00000296440
agggccaggtgcgcaggggagaaacaaggcgccttggagttcaggtgactcccacacgggtcatgctgttgtctcctgatccagccggccctgccaggtgaccatgcctgctctgggcccagctcttctccaggctctctgggccgggtgggtcctcaccctccagccccttccaccaactgcattcactcccaatggcacgtatctgcagcacctggcaagggaccccacctcaggcaccctctacctgggggctaccaacttcctgttccagctgagccctgggctgcagctggaggccacagtgtccaccggccctgtgctagacagcagggactgcctgccacctgtgatgcctgatgagtgcccccaggcccagcctaccaacaacccgaatcagctgctcctggtgagcccaggggccctggtggtatgcgggagcgtgcaccagggggtctgtgaacagcggcgcctggggcagctcgagcagctgctgctgcggccagagcggcctggggacacacaatatgtggctgccaatgatcctgcggtcagcacggtggggctggtagcccagggcttggcaggggagcccctcctgtttgtggggcgaggatacaccagcaggggtgtggggggtggcattccacccatcacaacccgggccctgtggccgcccgacccccaagctgccttctcctatgaggagacagccaagctggcagtgggccgcctctccgagtacagccaccacttcgtgagtgcctttgcacgtggggccagcgcctacttcctgttcctgcggcgggacctgcaggctcagtctagagcttttcgtgcctatgtatctcgagtgtgtctccgggaccagcactactactcctatgtggagttgcctctggcctgcgaaggtggccgctacgggctgatccaggctgcagctgtggccacgtccagggaggtggcgcatggggaggtgctctttgcagctttctcctcggctgcaccccccactgtgggccggcccccatcggcggctgctggggcatctggagcctctgccctctgtgccttccccctggatgaggtggaccggcttgctaatcgcacgcgagatgcctgctacacccgggagggtcgtgctgaggatgggaccgaggtggcctacatcgagtatgatgtcaattctgactgtgcacagctgccagtggacaccctggatgcttatccctgtggctcagaccacacgcccagccccatggccagccgggtcccgctggaagccacaccaattctggagtggccagggattcagctaacagctgtggcagtcaccatggaagatggacacaccatcgctttcctgggtgatagtcaagggcagctgcacagggtctacttgggcccagggagcgatggccacccatactccacacagagcatccagcaggggtctgcagtgagcagagacctcacctttgatgggacctttgagcacctgtatgtcatgacccagagcacacttctgaaggttcctgtggcttcctgtgctcagcacctggactgtgcatcttgccttgctcacagggacccatactgtgggtggtgcgtgctccttggcaggtgcagtcgccgttctgagtgctcgaggggccagggcccagagcagtggctatggagcttccagcctgagctgggctgtctgcaagtggcagccatgagtcctgccaacatcagccgagaggagacgagggaggttttcctatcagtgccagacctgccacccctgtggccaggggagtcatattcctgccactttggggaacatcagagtcctgccctgctgactggttctggtgtgatgtgcccctccccagaccctagtgaggccccagtgctgccgagaggagccgactacgtatccgtgagcgtggagctcagatttggcgctgttgtgatcgccaaaacttccctctctttctatgactgtgtggcggtcactgaactccgcccatctgcgcagtgccaggcctgtgtgagcagccgctgggggtgtaactggtgtgtctggcagcacctgtgcacccacaaggcctcgtgtgatgctgggcccatggttgcaagccatcagagcccgcttgtctccccagaccctcctgcaagaggtggacccagcccctccccacccacagcccccaaagccctggccacccctgctcctgacacccttcccgtggagcctggggctccctccacagccacagcttcggacatctcacctggggctagtccttccctgctcagcccctgggggccatgggcaggttctggctccatatcttcccctggctccacagggtcgcctctccatgaggagccctcccctcccagcccccaaaatggacctggaaccgctgtccctgcccccactgacttcagaccctcagccacacctgaggacctcttggcctccccgctgtcaccctcagaggtagcagcagtgccccctgcagaccctggccccgaggctcttcatcccacagtgcccctggacctgccccctgccactgttcctgccaccactttcccaggggccatgggctccgtgaagcccgccctggactggctcacgagagaaggcggcgagctgcccgaggcggacgagtggacggggggtgacgcacccgccttctccacttccaccctcctctcaggtgatggagactcagcagagcttgagggccctcccgcccccctcatcctcccgtccagcctcgactaccagtatgacacccccgggctctgggagctggaagaggcgaccttgggggcaagctcctgcccctgtgtggagagcgttcagggctccacgttgatgccggtccatgtggagcgggaaatccggctgctaggcaggaacctgcaccttttccaggatggcccaggagacaatgagtgtgtgatggagctggagggcctcgaggtggtggttgaggcccgggtcgagtgtgagccacctccagatacccagtgccatgtcacctgccagcagcaccagctcagctatgaggctctgcagccggagctccgtgtggggctgtttctgcgtcgggccggccgtctgcgtgtggacagtgctgaggggctgcatgtggtactgtatgactgttccgtgggacatggagactgcagccgctgccaaactgccatgccccagtatggctgtgtgtggtgtgagggggagcgtccacgttgtgtgacccgggaggcctgtggtgaggctgaggctgtggccacccagtgcccagcgcccctcatccactcggtggagccactgactgggcctgtagacggaggcacccgtgtcaccatcaggggctccaacctgggccagcatgtgcaggatgtgctgggcatggtcacggtggctggagtgccctgtgctgtggatgcccaggagtacgaggtctccagcagcctcgtgtgcatcaccggggccagtggggaggaggtggccggcgccacagcggtggaggtgccgggaagaggacgtggtgtctcagaacacgactttgcctaccaggatccgaaggtccattccatcttcccggcccgcggccccagagctgggggcacccgtctcaccctgaatggctccaagctcctgactgggcggctggaggacatccgagtggtggttggagaccagccttgtcacttgctgccggagcagcagtcagaacaactgcggtgtgagaccagcccacgccccacgcctgccacgctccctgtggctgtgtggtttggggccacggagcggaggcttcaacgcggacagttcaagtataccttggaccccaacatcacctctgctggccccaccaagagcttcctcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacggcatgttcccttggaccctcctgcagtagccagcaatttgaggagccgtgccatgtcaactcctcccagctcatcacgtgccgcacacctgccctcccaggcctgcctgaggacccctgggtccgggtggaatttatccttgacaacctggtctttgactttgcaacactgaaccccacacctttctcctatgaggccgaccccaccctgcagccactcaaccctgaggaccccaccatgccattccggcacaagcctgggagtgtgttctccgtggagggggagaacctggaccttgcaatgtccaaggaggaggtggtggctatgataggggatggcccctgtgtggtgaagacgctgacgcggcaccacctgtactgcgagccccccgtggagcagcccctgccacggcaccatgccctccgagaggcacctgactctttgcctgagttcacggtgcagatggggaacttgcgcttctccctgggtcacgtgcagtatgacggcgagagccctggggcttttcctgtggcagcccaggtgggcttgggggtgggcacctctcttctggctctgggtgtcatcatcattgtcctcatgtacaggaggaagagcaagcaggccctgagggactataagaaggttcagatccagctggagaatctggagagcagtgtgcgggaccgctgcaagaaggaattcacagacctcatgactgagatgaccgatctcaccagtgacctcctgggcagcggcatccccttcctcgactacaaggtgtatgcggagaggatcttcttccctgggcaccgcgagtcgcccttgcaccgggacctgggtgtgcctgagagcagacggcccactgtggagcaagggctggggcagctctctaacctgctcaacagcaagctcttcctcaccaagttcatccacacgctggagagccagcgcaccttttcagctcgggaccgtgcctacgtggcatctctgctcaccgtggcactgcatgggaagcttgagtatttcactgacatcctccgcactctgctcagtgacctggttgcccagtatgtggccaagaaccccaagctgatgctgcgcaggacagagactgtggtggagaagctgctcaccaactggatgtccatctgtctgtataccttcgtgagggactccgtaggggagcctctgtacatgctctttcgagggattaagcaccaagtggataaggggccagtggacagtgtgacaggcaaggccaaatacaccttgaacgacaaccgcctgctcagagaggatgtggagtaccgtcccctgaccttgaatgcactattggctgtggggcctggggcaggagaggcccagggcgtgcccgtgaaggtcctagactgtgacaccatctcccaggcaaaggagaagatgctggaccagctttataaaggagtgcctctcacccagcggccagaccctcgcacccttgatgttgagtggcggtctggggtggccgggcacctcattctttctgacgaggatgtcacttctgaggtccagggtctgtggaggcgcctgaacacactgcagcattacaaggtcccagatggagcaactgtggccctcgtcccctgcctcaccaagcatgtgctccgggaaaaccaggattatgtccctggagagcggaccccaatgctggaggatgtagatgaggggggcatccggccctggcacctggtgaagccaagtgatgagccggagccgcccaggcctcggaggggcagccttcggggcggggagcgtgagcgcgccaaggccatccctgagatctacctgacccgcctgctgtccatgaagggcaccctgcagaagttcgtggatgacctgttccaggtgattctcagcaccagccgccccgtgccgctcgctgtgaagtacttctttgacctgctggatgagcaggcccagcagcatggcatctccgaccaggacaccatccacatctggaagaccaacagcttgcctctgaggttctggatcaatataataaaaaacccgcagtttgtgttcgacgtgcaaacatctgataacatggatgcggtgctccttgtcattgcacagaccttcatggacgcctgcaccctggccgaccacaagctgggccgggactccccgatcaacaaacttctgtatgcacgggacattccccggtacaagcggatggtggaaaggtactatgcagacatcagacagactgtcccagccagcgaccaagagatgaactctgtcctggctgaactgtcctggaactactccggagacctcggggcgcgagtggccctgcatgaactctacaagtacatcaacaagtactatgaccagatcatcactgccctggaggaggatggcacggcccagaagatgcagctgggctatcggctccagcagattgcagctgctgtggaaaacaaggtcacagatctataggaacccaggagccacggcctgctgttgcttcagcctggcctgggcagccctggaagctcggaggagaggccaccttcttaggtgcctgtagtgactgacaagcagagttagtggaaggtgactcccagtctcctggtggctctggcctcggccctgctggatccacctcctagacccggggcctcaaggctcatggggtagtacccagcctgctccccgagtccagcgaccctgtgacaccggtctgcagggagttggggactaagggcttccagagagtggctggaagagactccaggcccctggggagactgtactgttcctgaacactggccttggccacactgggattcggagaggaaggaggagagccccatgcttcctgtctgcctcctccaccatccctgacctcagttgagctgcctctggccttgttgctgctgccacatcctaggtctaagagttgaacgcctctcctaggccactacaaactgacccctcagcagggctggctgccacagggctgccctgcctcataggtagccatggtgagggctatctgctgcaggggggtcttggggagagtggtgactccattgacccagcttttcattaaaggataacacactgca

SEQ ID NO: 16128 - DNA, 3264 bp, Homo sapiens
  ENST00000485535
tgtggtgaagacgctgacgcggcaccacctgtactgcgagccccccgtggagcagcccctgccacggcaccatgccctccgagaggcacctgactctttgcctgagttcacggtgcagatggggaacttgcgcttctccctgggtcacgtgcagtatgacggcgagagccctggggcttttcctgtggcagcccaggtgggcttgggggtgggcacctctcttctggctctgggtgtcatcatcattgtcctcatgtacaggtgggtgcagccagatgtggctgggctggggcaggtcgtgggatctggctggactgggaagggacagaccgggccaggagtcaggaaacattctctgtaaatggccagagagtaaatattttcgctttgcaggccaagtggtctctgttcaacaactcagctttgccactgtggcacaaaggcagccagggacgacatggaaacacatgaaagtggctgtgttctaacaaatctttataaaaataggttgtgggatggatttggcctggttgtggttggctgatctctaggctaaactgtgctgggctagacggggcatgggtgtgtgtgacttgcttgggacgggacaggctgaatcgtactgggctaggcttgagcttggctggcatggctgcattggactgtgctggatgaggccggggtgtgcctggggattgtcaggcaggcctgggcgagtaggactcatctggccatcctctcctgaccctggggctgagcaggaggaagagcaagcaggccctgagggactataagaaggttcagatccagctggagaatctggagagcagtgtgcgggaccgctgcaagaaggaattcacagacctcatgactgagatgaccgatctcaccagtgacctcctgggcagcggcatccccttcctcgactacaaggtgtatgcggagaggatcttcttccctgggcaccgcgagtcgcccttgcaccgggacctgggtgtgcctgagagcagacggcccactgtggagcaagggctggggcagctctctaacctgctcaacagcaagctcttcctcaccaagttcatccacacgctggagagccagcgcaccttttcagctcgggaccgtgcctacgtggcatctctgctcaccgtggcactgcatgggaagcttgagtatttcactgacatcctccgcactctgctcagtgacctggttgcccagtatgtggccaagaaccccaagctgatgctgcgcaggacagagactgtggtggagaagctgctcaccaactggatgtccatctgtctgtataccttcgtgagggactccgtaggggagcctctgtacatgctctttcgagggattaagcaccaagtggataaggggccagtggacagtgtgacaggcaaggccaaatacaccttgaacgacaaccgcctgctcagagaggatgtggagtaccgtcccctgaccttgaatgcactattggctgtggggcctggggcaggagaggcccagggcgtgcccgtgaaggtcctagactgtgacaccatctcccaggcaaaggagaagatgctggaccagctttataaaggagtgcctctcacccagcggccagaccctcgcacccttgatgttgagtggcggtctggggtggccgggcacctcattctttctgacgaggatgtcacttctgaggtccagggtctgtggaggcgcctgaacacactgcagcattacaaggtcccagatggagcaactgtggccctcgtcccctgcctcaccaagcatgtgctccgggaaaaccaggattatgtccctggagagcggaccccaatgctggaggatgtagatgaggggggcatccggccctggcacctggtgaagccaagtgatgagccggagccgcccaggcctcggaggggcagccttcggggcggggagcgtgagcgcgccaaggccatccctgagatctacctgacccgcctgctgtccatgaagggcaccctgcagaagttcgtggatgacctgttccaggtgattctcagcaccagccgccccgtgccgctcgctgtgaagtacttctttgacctgctggatgagcaggcccagcagcatggcatctccgaccaggacaccatccacatctggaagaccaacagcttgcctctgaggttctggatcaatataataaaaaacccgcagtttgtgttcgacgtgcaaacatctgataacatggatgcggtgctccttgtcattgcacagaccttcatggacgcctgcaccctggccgaccacaagctgggccgggactccccgatcaacaaacttctgtatgcacgggacattccccggtacaagcggatggtggaaaggtactatgcagacatcagacagactgtcccagccagcgaccaagagatgaactctgtcctggctgaactgtcctggaactactccggagacctcggggcgcgagtggccctgcatgaactctacaagtacatcaacaagtactatgaccagatcatcactgccctggaggaggatggcacggcccagaagatgcagctgggctatcggctccagcagattgcagctgctgtggaaaacaaggtcacagatctataggaacccaggagccacggcctgctgttgcttcagcctggcctgggcagccctggaagctcggaggagaggccaccttcttaggtgcctgtagtgactgacaagcagagttagtggaaggtgactcccagtctcctggtggctctggcctcggccctgctggatccacctcctagacccggggcctcaaggctcatggggtagtacccagcctgctccccgagtccagcgaccctgtgacaccggtctgcagggagttggggactaagggcttccagagagtggctggaagagactccaggcccctggggagactgtactgttcctgaacactggccttggccacactgggattcggagaggaaggaggagagccccatgcttcctgtctgcctcctccaccatccctgacctcagttgagctgcctctggccttgttgctgctgccacatcctaggtctaagagttgaacgcctctcctaggccactacaaactgacccctcagcagggctggctgccacagggctgccctgcctcataggtagccatggtgagggctatctgctgcaggggggtcttggggagagtggtgactccattgacccagcttttcattaaaggataacacactg

SEQ ID NO: 16129 - DNA, 7308 bp, Homo sapiens
  ENST00000358536
gcccggccgacgcggctttgtctcctttgttcccggcggtggcagcgccgcgcgggaggggcgggcagcgggcgcagttttccgcccctcggtctccgggtaacagctgcggctccgccagacccggggagaggccgctgcgcgcggagcccgagcccggagcggccgacgcccgcctcggcgcgcacatcccgcggggcccggccgggtggtgactcccacacgggtcatgctgttgtctcctgatccagccggccctgccaggtgaccatgcctgctctgggcccagctcttctccaggctctctgggccgggtgggtcctcaccctccagccccttccaccaactgcattcactcccaatggcacgtatctgcagcacctggcaagggaccccacctcaggcaccctctacctgggggctaccaacttcctgttccagctgagccctgggctgcagctggaggccacagtgtccaccggccctgtgctagacagcagggactgcctgccacctgtgatgcctgatgagtgcccccaggcccagcctaccaacaacccgaatcagctgctcctggtgagcccaggggccctggtggtatgcgggagcgtgcaccagggggtctgtgaacagcggcgcctggggcagctcgagcagctgctgctgcggccagagcggcctggggacacacaatatgtggctgccaatgatcctgcggtcagcacggtggggctggtagcccagggcttggcaggggagcccctcctgtttgtggggcgaggatacaccagcaggggtgtggggggtggcattccacccatcacaacccgggccctgtggccgcccgacccccaagctgccttctcctatgaggagacagccaagctggcagtgggccgcctctccgagtacagccaccacttcgtgagtgcctttgcacgtggggccagcgcctacttcctgttcctgcggcgggacctgcaggctcagtctagagcttttcgtgcctatgtatctcgagtgtgtctccgggaccagcactactactcctatgtggagttgcctctggcctgcgaaggtggccgctacgggctgatccaggctgcagctgtggccacgtccagggaggtggcgcatggggaggtgctctttgcagctttctcctcggctgcaccccccactgtgggccggcccccatcggcggctgctggggcatctggagcctctgccctctgtgccttccccctggatgaggtggaccggcttgctaatcgcacgcgagatgcctgctacacccgggagggtcgtgctgaggatgggaccgaggtggcctacatcgagtatgatgtcaattctgactgtgcacagctgccagtggacaccctggatgcttatccctgtggctcagaccacacgcccagccccatggccagccgggtcccgctggaagccacaccaattctggagtggccagggattcagctaacagctgtggcagtcaccatggaagatggacacaccatcgctttcctgggtgatagtcaagggcagctgcacagggtctacttgggcccagggagcgatggccacccatactccacacagagcatccagcaggggtctgcagtgagcagagacctcacctttgatgggacctttgagcacctgtatgtcatgacccagagcacacttctgaaggttcctgtggcttcctgtgctcagcacctggactgtgcatcttgccttgctcacagggacccatactgtgggtggtgcgtgctccttggcaggtgcagtcgccgttctgagtgctcgaggggccagggcccagagcagtggctatggagcttccagcctgagctgggctgtctgcaagtggcagccatgagtcctgccaacatcagccgagaggagacgagggaggttttcctatcagtgccagacctgccacccctgtggccaggggagtcatattcctgccactttggggaacatcagagtcctgccctgctgactggttctggtgtgatgtgcccctccccagaccctagtgaggccccagtgctgccgagaggagccgactacgtatccgtgagcgtggagctcagatttggcgctgttgtgatcgccaaaacttccctctctttctatgactgtgtggcggtcactgaactccgcccatctgcgcagtgccaggcctgtgtgagcagccgctgggggtgtaactggtgtgtctggcagcacctgtgcacccacaaggcctcgtgtgatgctgggcccatggttgcaagccatcagagcccgcttgtctccccagaccctcctgcaagaggtggacccagcccctccccacccacagcccccaaagccctggccacccctgctcctgacacccttcccgtggagcctggggctccctccacagccacagcttcggacatctcacctggggctagtccttccctgctcagcccctgggggccatgggcaggttctggctccatatcttcccctggctccacagggtcgcctctccatgaggagccctcccctcccagcccccaaaatggacctggaaccgctgtccctgcccccactgacttcagaccctcagccacacctgaggacctcttggcctccccgctgtcaccctcagaggtagcagcagtgccccctgcagaccctggccccgaggctcttcatcccacagtgcccctggacctgccccctgccactgttcctgccaccactttcccaggggccatgggctccgtgaagcccgccctggactggctcacgagagaaggcggcgagctgcccgaggcggacgagtggacggggggtgacgcacccgccttctccacttccaccctcctctcaggtgatggagactcagcagagcttgagggccctcccgcccccctcatcctcccgtccagcctcgactaccagtatgacacccccgggctctgggagctggaagaggcgaccttgggggcaagctcctgcccctgtgtggagagcgttcagggctccacgttgatgccggtccatgtggagcgggaaatccggctgctaggcaggaacctgcaccttttccaggatggcccaggagacaatgagtgtgtgatggagctggagggcctcgaggtggtggttgaggcccgggtcgagtgtgagccacctccagatacccagtgccatgtcacctgccagcagcaccagctcagctatgaggctctgcagccggagctccgtgtggggctgtttctgcgtcgggccggccgtctgcgtgtggacagtgctgaggggctgcatgtggtactgtatgactgttccgtgggacatggagactgcagccgctgccaaactgccatgccccagtatggctgtgtgtggtgtgagggggagcgtccacgttgtgtgacccgggaggcctgtggtgaggctgaggctgtggccacccagtgcccagcgcccctcatccactcggtggagccactgactgggcctgtagacggaggcacccgtgtcaccatcaggggctccaacctgggccagcatgtgcaggatgtgctgggcatggtcacggtggctggagtgccctgtgctgtggatgcccaggagtacgaggtctccagcagcctcgtgtgcatcaccggggccagtggggaggaggtggccggcgccacagcggtggaggtgccgggaagaggacgtggtgtctcagaacacgactttgcctaccaggatccgaaggtccattccatcttcccggcccgcggccccagagctgggggcacccgtctcaccctgaatggctccaagctcctgactgggcggctggaggacatccgagtggtggttggagaccagccttgtcacttgctgccggagcagcagtcagaacaactgcggtgtgagaccagcccacgccccacgcctgccacgctccctgtggctgtgtggtttggggccacggagcggaggcttcaacgcggacagttcaagtataccttggaccccaacatcacctctgctggccccaccaagagcttcctcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacggcatgttcccttggaccctcctgcagtagccagcaatttgaggagccgtgccatgtcaactcctcccagctcatcacgtgccgcacacctgccctcccaggcctgcctgaggacccctgggtccgggtggaatttatccttgacaacctggtctttgactttgcaacactgaaccccacacctttctcctatgaggccgaccccaccctgcagccactcaaccctgaggaccccaccatgccattccggcacaagcctgggagtgtgttctccgtggagggggagaacctggaccttgcaatgtccaaggaggaggtggtggctatgataggggatggcccctgtgtggtgaagacgctgacgcggcaccacctgtactgcgagccccccgtggagcagcccctgccacggcaccatgccctccgagaggcacctgactctttgcctgagttcacggtgcagatggggaacttgcgcttctccctgggtcacgtgcagtatgacggcgagagccctggggcttttcctgtggcagcccaggtgggcttgggggtgggcacctctcttctggctctgggtgtcatcatcattgtcctcatgtacaggaggaagagcaagcaggccctgagggactataagaaggttcagatccagctggagaatctggagagcagtgtgcgggaccgctgcaagaaggaattcacagacctcatgactgagatgaccgatctcaccagtgacctcctgggcagcggcatccccttcctcgactacaaggtgtatgcggagaggatcttcttccctgggcaccgcgagtcgcccttgcaccgggacctgggtgtgcctgagagcagacggcccactgtggagcaagggctggggcagctctctaacctgctcaacagcaagctcttcctcaccaagttcatccacacgctggagagccagcgcaccttttcagctcgggaccgtgcctacgtggcatctctgctcaccgtggcactgcatgggaagcttgagtatttcactgacatcctccgcactctgctcagtgacctggttgcccagtatgtggccaagaaccccaagctgatgctgcgcaggacagagactgtggtggagaagctgctcaccaactggatgtccatctgtctgtataccttcgtgagggactccgtaggggagcctctgtacatgctctttcgagggattaagcaccaagtggataaggggccagtggacagtgtgacaggcaaggccaaatacaccttgaacgacaaccgcctgctcagagaggatgtggagtaccgtcccctgaccttgaatgcactattggctgtggggcctggggcaggagaggcccagggcgtgcccgtgaaggtcctagactgtgacaccatctcccaggcaaaggagaagatgctggaccagctttataaaggagtgcctctcacccagcggccagaccctcgcacccttgatgttgagtggcggtctggggtggccgggcacctcattctttctgacgaggatgtcacttctgaggtccagggtctgtggaggcgcctgaacacactgcagcattacaaggtcccagatggagcaactgtggccctcgtcccctgcctcaccaagcatgtgctccgggaaaaccaggattatgtccctggagagcggaccccaatgctggaggatgtagatgaggggggcatccggccctggcacctggtgaagccaagtgatgagccggagccgcccaggcctcggaggggcagccttcggggcggggagcgtgagcgcgccaaggccatccctgagatctacctgacccgcctgctgtccatgaagggcaccctgcagaagttcgtggatgacctgttccaggtgattctcagcaccagccgccccgtgccgctcgctgtgaagtacttctttgacctgctggatgagcaggcccagcagcatggcatctccgaccaggacaccatccacatctggaagaccaacagcttgcctctgaggttctggatcaatataataaaaaacccgcagtttgtgttcgacgtgcaaacatctgataacatggatgcggtgctccttgtcattgcacagaccttcatggacgcctgcaccctggccgaccacaagctgggccgggactccccgatcaacaaacttctgtatgcacgggacattccccggtacaagcggatggtggaaaggtactatgcagacatcagacagactgtcccagccagcgaccaagagatgaactctgtcctggctgaactgtcctggaactactccggagacctcggggcgcgagtggccctgcatgaactctacaagtacatcaacaagtactatgaccagatcatcactgccctggaggaggatggcacggcccagaagatgcagctgggctatcggctccagcagattgcagctgctgtggaaaacaaggtcacagatctataggaacccaggagccacggcctgctgttgcttcagcctggcctgggcagccctggaagctcggaggagaggccaccttcttaggtgcctgtagtgactgacaagcagagttagtggaaggtgactcccagtctcctggtggctctggcctcggccctgctggatccacctcctagacccggggcctcaaggctcatggggtagtacccagcctgctccccgagtccagcgaccctgtgacaccggtctgcagggagttggggactaagggcttccagagagtggctggaagagactccaggcccctggggagactgtactgttcctgaacactggccttggccacactgggattcggagaggaaggaggagagccccatgcttcctgtctgcctcctccaccatccctgacctcagttgagctgcctctggccttgttgctgctgccacatcctaggtctaagagttgaacgcctctcctaggccactacaaactgacccctcagcagggctggctgccacagggctgccctgcctcataggtagccatggtgagggctatctgctgcaggggggtcttggggagagtggtgactccattgacccagcttttcattaaaggataacacactg

SEQ ID NO: 16130 - DNA, 5859 bp, Homo sapiens
  ENST00000456774
atgcctgctctgggcccagctcttctccaggctctctgggccgggtgggtcctcaccctccagccccttccaccaactgcattcactcccaatggcacgtatctgcagcacctggcaagggaccccacctcaggcaccctctacctgggggctaccaacttcctgttccagctgagccctgggctgcagctggaggccacagtgtccaccggccctgtgctagacagcagggactgcctgccacctgtgatgcctgatgagtgcccccaggcccagcctaccaacaacccgaatcagctgctcctggtgagcccaggggccctggtggtatgcgggagcgtgcaccagggggtctgtgaacagcggcgcctggggcagctcgagcagctgctgctgcggccagagcggcctggggacacacaatatgtggctgccaatgatcctgcggtcagcacggtggggctggtagcccagggcttggcaggggagcccctcctgtttgtggggcgaggatacaccagcaggggtgtggggggtggcattccacccatcacaacccgggccctgtggccgcccgacccccaagctgccttctcctatgaggagacagccaagctggcagtgggccgcctctccgagtacagccaccacttcgtgagtgcctttgcacgtggggccagcgcctacttcctgttcctgcggcgggacctgcaggctcagtctagagcttttcgtgcctatgtatctcgagtgtgtctccgggaccagcactactactcctatgtggagttgcctctggcctgcgaaggtggccgctacgggctgatccaggctgcagctgtggccacgtccagggaggtggcgcatggggaggtgctctttgcagctttctcctcggctgcaccccccactgtgggccggcccccatcggcggctgctggggcatctggagcctctgccctctgtgccttccccctggatgaggtggaccggcttgctaatcgcacgcgagatgcctgctacacccgggagggtcgtgctgaggatgggaccgaggtggcctacatcgagtatgatgtcaattctgactgtgcacagctgccagtggacaccctggatgcttatccctgtggctcagaccacacgcccagccccatggccagccgggtcccgctggaagccacaccaattctggagtggccagggattcagctaacagctgtggcagtcaccatggaagatggacacaccatcgctttcctgggtgatagtcaagggcagctgcacagggtctacttgggcccagggagcgatggccacccatactccacacagagcatccagcaggggtctgcagtgagcagagacctcacctttgatgggacctttgagcacctgtatgtcatgacccagagcacacttctgaaggttcctgtggcttcctgtgctcagcacctggactgtgcatcttgccttgctcacagggacccatactgtgggtggtgcgtgctccttggcaggtgcagtcgccgttctgagtgctcgaggggccagggcccagagcagtggctatggagcttccagcctgagctgggctgtctgcaagtggcagccatgagtcctgccaacatcagccgagaggagacgagggaggttttcctatcagtgccagacctgccacccctgtggccaggggagtcatattcctgccactttggggaacatcagagtcctgccctgctgactggttctggtgtgatgtgcccctccccagaccctagtgaggccccagtgctgccgagaggagccgactacgtatccgtgagcgtggagctcagatttggcgctgttgtgatcgccaaaacttccctctctttctatgactgtgtggcggtcactgaactccgcccatctgcgcagtgccaggcctgtgtgagcagccgctgggggtgtaactggtgtgtctggcagcacctgtgcacccacaaggcctcgtgtgatgctgggcccatggttgcaagccatcagagcccgcttgtctccccagaccctcctgcaagaggtgatggagactcagcagagcttgagggccctcccgcccccctcatcctcccgtccagcctcgactaccagtatgacacccccgggctctgggagctggaagaggcgaccttgggggcaagctcctgcccctgtgtggagagcgttcagggctccacgttgatgccggtccatgtggagcgggaaatccggctgctaggcaggaacctgcaccttttccaggatggcccaggagacaatgagtgtgtgatggagctggagggcctcgaggtggtggttgaggcccgggtcgagtgtgagccacctccagatacccagtgccatgtcacctgccagcagcaccagctcagctatgaggctctgcagccggagctccgtgtggggctgtttctgcgtcgggccggccgtctgcgtgtggacagtgctgaggggctgcatgtggtactgtatgactgttccgtgggacatggagactgcagccgctgccaaactgccatgccccagtatggctgtgtgtggtgtgagggggagcgtccacgttgtgtgacccgggaggcctgtggtgaggctgaggctgtggccacccagtgcccagcgcccctcatccactcggtggagccactgactgggcctgtagacggaggcacccgtgtcaccatcaggggctccaacctgggccagcatgtgcaggatgtgctgggcatggtcacggtggctggagtgccctgtgctgtggatgcccaggagtacgaggtctccagcagcctcgtgtgcatcaccggggccagtggggaggaggtggccggcgccacagcggtggaggtgccgggaagaggacgtggtgtctcagaacacgactttgcctaccaggatccgaaggtccattccatcttcccggcccgcggccccagagctgggggcacccgtctcaccctgaatggctccaagctcctgactgggcggctggaggacatccgagtggtggttggagaccagccttgtcacttgctgccggagcagcagtcagaacaactgcggtgtgagaccagcccacgccccacgcctgccacgctccctgtggctgtgtggtttggggccacggagcggaggcttcaacgcggacagttcaagtataccttggaccccaacatcacctctgctggccccaccaagagcttcctcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacggcatgttcccttggaccctcctgcagtagccagcaatttgaggagccgtgccatgtcaactcctcccagctcatcacgtgccgcacacctgccctcccaggcctgcctgaggacccctgggtccgggtggaatttatccttgacaacctggtctttgactttgcaacactgaaccccacacctttctcctatgaggccgaccccaccctgcagccactcaaccctgaggaccccaccatgccattccggcacaagcctgggagtgtgttctccgtggagggggagaacctggaccttgcaatgtccaaggaggaggtggtggctatgataggggatggcccctgtgtggtgaagacgctgacgcggcaccacctgtactgcgagccccccgtggagcagcccctgccacggcaccatgccctccgagaggcacctgactctttgcctgagttcacggtgcagatggggaacttgcgcttctccctgggtcacgtgcagtatgacggcgagagccctggggcttttcctgtggcagcccaggtgggcttgggggtgggcacctctcttctggctctgggtgtcatcatcattgtcctcatgtacaggaggaagagcaagcaggccctgagggactataagaaggttcagatccagctggagaatctggagagcagtgtgcgggaccgctgcaagaaggaattcacagacctcatgactgagatgaccgatctcaccagtgacctcctgggcagcggcatccccttcctcgactacaaggtgtatgcggagaggatcttcttccctgggcaccgcgagtcgcccttgcaccgggacctgggtgtgcctgagagcagacggcccactgtggagcaagggctggggcagctctctaacctgctcaacagcaagctcttcctcaccaagttcatccacacgctggagagccagcgcaccttttcagctcgggaccgtgcctacgtggcatctctgctcaccgtggcactgcatgggaagcttgagtatttcactgacatcctccgcactctgctcagtgacctggttgcccagtatgtggccaagaaccccaagctgatgctgcgcaggacagagactgtggtggagaagctgctcaccaactggatgtccatctgtctgtataccttcgtgagggactccgtaggggagcctctgtacatgctctttcgagggattaagcaccaagtggataaggggccagtggacagtgtgacaggcaaggccaaatacaccttgaacgacaaccgcctgctcagagaggatgtggagtaccgtcccctgaccttgaatgcactattggctgtggggcctggggcaggagaggcccagggcgtgcccgtgaaggtcctagactgtgacaccatctcccaggcaaaggagaagatgctggaccagctttataaaggagtgcctctcacccagcggccagaccctcgcacccttgatgttgagtggcggtctggggtggccgggcacctcattctttctgacgaggatgtcacttctgaggtccagggtctgtggaggcgcctgaacacactgcagcattacaaggtcccagatggagcaactgtggccctcgtcccctgcctcaccaagcatgtgctccgggaaaaccaggattatgtccctggagagcggaccccaatgctggaggatgtagatgaggggggcatccggccctggcacctggtgaagccaagtgatgagccggagccgcccaggcctcggaggggcagccttcggggcggggagcgtgagcgcgccaaggccatccctgagatctacctgacccgcctgctgtccatgaagggcaccctgcagaagttcgtggatgacctgttccaggtgattctcagcaccagccgccccgtgccgctcgctgtgaagtacttctttgacctgctggatgagcaggcccagcagcatggcatctccgaccaggacaccatccacatctggaagaccaacagcttgcctctgaggttctggatcaatataataaaaaacccgcagtttgtgttcgacgtgcaaacatctgataacatggatgcggtgctccttgtcattgcacagaccttcatggacgcctgcaccctggccgaccacaagctgggccgggactccccgatcaacaaacttctgtatgcacgggacattccccggtacaagcggatggtggaaaggtactatgcagacatcagacagactgtcccagccagcgaccaagagatgaactctgtcctggctgaactgtcctggaactactccggagacctcggggcgcgagtggccctgcatgaactctacaagtacatcaacaagtactatgaccagatcatcactgccctggaggaggatggcacggcccagaagatgcagctgggctatcggctccagcagattgcagctgctgtggaaaacaaggtcacagatctatag

SEQ ID NO: 16131 - DNA, 424 bp, Homo sapiens
  ENST00000483753
aaccccagaccttgctgaagcaggtagacctgggctgtcttcctaccaaggaggcccccttgctctaccctgttctgtccccatctggcacacctggcctggggtccctgggccatggaggggactctgcttcccactgtagtgcccatcccattctctacctctcaggtccccttctcccccagcccttccctggggtcctgggctgcctcctgtggctctctgcacccctcgtctctctcacctttcatttggcctcttccctagaactactccggagacctcggggcgcgagtggccctgcatgaactctacaagtacatcaacaagtactatgaccagatcatcactgccctggaggaggatggcacggcccagaagatgcagctgggctatcggctccagcagattgcagctgctgtgg

SEQ ID NO: 16132 - DNA, 317 bp, Homo sapiens
  ENST00000497627
catggatgcggtgctccttgtcattgcacagaccttcatggacgcctgcaccctggccgaccacaagctgggccgggactccccgatcaacaaacttctgtatgcacgggacattccccggtacaagcggatggtggaaaggtactatgcagacatcagacagactgtcccagccagcgaccaagagatgaactctgtcctggctgaactgtcctgggtaaggcctccctctgcttcttgggttgggcataggcctcctgccacaacggtccttcccccttcacactgcccctttgcagggaagcccttgggaacct

SEQ ID NO: 16133 - DNA, 367 bp, Homo sapiens
  ENST00000483676
aagttcgtggatgacctgttccaggtgattctcagcaccagccgccccgtgccgctcgctgtgaagtacttctttgacctgctggatgagcaggcccagcagcatggcatctccgaccaggacaccatccacatctggaagaccaacagcttgcctctgaggttctggatcaatataataaaaaacccgcagtttgtgttcgacgtgcaaacatctgataacatggatgcggtgctccttgtcattgcacagaccttcatggacgcctgcaccctggccgaccacaagctgggccgggactccccgatcaacaaacttctgtatgcacgggacattccccggtacaagcggatggtggaaaggtact

SEQ ID NO: 16134 - DNA, 576 bp, Homo sapiens
  ENST00000478171
actgtggccctcgtcccctgcctcaccaagcatgtgctccgggaaaaccaggattatgtccctggagagcggaccccaatgctggaggatgtagatgaggggggcatccggccctggcacctggtgaagccaagtgatgagccggagccgcccaggcctcggaggggcagccttcggggcggggagcgtgagcgcgccaaggccatccctgagatctacctgacccgcctgctgtccatgaagggcaccctgcagaagttcgtggatgacctgttccaggtgattctcagcaccagccgccccgtgccgctcgctgtgaagtacttctttgacctgctggatgagcaggcccagcagcatggcatctccgaccaggacaccatccacatctggaagaccaacaggtggggtggagctgggtgggctctaggtgtgtgtggggggtcttctcttctgcctccccagcacattcatcggccatgcctgccccacccgcagcttgcctctgaggttctggatcaatataataaaaaacccgcagtttgtgttcgacgtgcaaacatctgataacatgga

SEQ ID NO: 16135 - DNA, 835 bp, Homo sapiens
  ENST00000470525
aagcaccaagtggataaggggccagtggacagtgtgacaggcaaggccaaatacaccttgaacgacaaccgcctgctcagagaggatgtggagtaccgtcccctgaccttgaatgcactattggctgtggggcctggggcaggagaggcccagggcgtgcccgtgaaggtcctagactgtgacaccatctcccaggcaaaggagaagatgctggaccagctttataaaggagtgcctctcacccagcggccagaccctcgcacccttgatgttggtgagggcgtggagagcccctggggacctgagccactgttgggcctgggctggccccggaccaactctgcagggacaactcatcactcagggtggggaggatgctgggaggcaggcagaagctggctttggaacatctttcttggacagcctctcatctggggagggggtccctgctcttggtctttggagaggttgagtaaggctgccccatgatggaggggctggtgtccctgtggaggaggagatgggctccactatgggaagggtatcttccagccctgcacccagttctgccttgcccttgcagagtggcggtctggggtggccgggcacctcattctttctgacgaggatgtcacttctgaggtccagggtctgtggaggcgcctgaacacactgcagcattacaaggtcccagatggagcaactgtggccctcgtcccctgcctcaccaagcatgtgctccgggaaaaccaggattatgtccctggagagcggaccccaatgctggaggatgtagatgaggggggcatccggccctggcacctggtgaagccaa

SEQ ID NO: 16136 - DNA, 851 bp, Homo sapiens
  ENST00000461261
cgatctcaccagtgacctcctgggcagcggcatccccttcctcgactacaaggtgtatgcggagaggatcttcttccctgggcaccgcgagtcgcccttgcaccgggacctgggtgtgcctgagagcagacggcccactgtggagcaagggctggggcagctctctaacctgctcaacagcaagctcttcctcaccaagttcatccacacgctggagagccagcgcaccttttcagctcgggaccgtgcctacgtggcatctctgctcaccgtggcactgcatgggaagcttgagtatttcactgacatcctccgcactctgctcagtgacctggttgcccagtatgtggccaagaaccccaagctgatgctgcgcaggacagagactgtggtggagaagctgctcaccaactggatgtccatctgtctgtataccttcgtgagggtgagggggcagaggtggacagggctcctgtccagggagggtcaggccctccaaacttctaagccctcagccaccatgcagctcggacacttgtgccagagcagagactcctgctcagcctgtcctcagtccccttaagcccatgtcctgtccccttccccagtgtgcgtcatgtcccatacacctctgccacctgctggggggccctaactgcctgtgctctcctaggactccgtaggggagcctctgtacatgctctttcgagggattaagcaccaagtggataaggggccagtggacagtgtgacaggcaaggccaaatacaccttgaacgacaaccgcctgctcagagaggatgtggagtaccgtcccctgaccttgaatgcactattggctgtggggcctg

SEQ ID NO: 16137 - DNA, 1034 bp, Homo sapiens
  ENST00000473996
caggcctgcctgaggacccctgggtccgggtggaatttatccttgacaacctggtctttgactttgcaacactgaaccccacacctttctcctatgaggccgaccccaccctgcagccactcaaccctgaggaccccaccatgccattccggcacaagcctgggagtgtgttctccgtggagggggagaacctggaccttgcaatgtccaaggaggaggtggtggctatgataggggatggcccctgtgtggtgaagacgctgacgcggcaccacctgtactgcgagccccccgtggagcagcccctgccacggcaccatgccctccgagaggcacctgactctttgcctgagttcacggtcagtgggcaggtccctggccgggctgggcattgacctgggccaaacccttgctcacaggtggctcctgacacaggtgcagatggggaacttgcgcttctccctgggtcacgtgcagtatgacggcgagagccctggggcttttcctgtggcagcccaggtgggcttgggggtgggcacctctcttctggctctgggtgtcatcatcattgtcctcatgtacaggtgggtgcagccagatgtggctgggctggggcaggtcgtgggatctggctggactgggaagggacagaccgggccaggagtcaggaaacattctctgtaaatggccagagagtaaatattttcgctttgcaggccaagtggtctctgttcaacaactcagctttgccactgtggcacaaaggcagccagggacgacatggaaacacatgaaagtggctgtgttctaacaaatctttataaaaataggttgtgggatggatttggcctggttgtggttggctgatctctaggctaaactgtgctgggctagacggggcatgggtgtgtgtgacttgcttgggacgggacaggctgaatcgtactgggctaggcttgagcttggctggcatggctgcattggactgtgctggatgaggccggggtgtgcctggggattgtcaggcaggcctg

SEQ ID NO: 16138 - DNA, 3863 bp, Homo sapiens
  ENST00000449094
atgcctgctctgggcccagctcttctccaggctctctgggccgggtgggtcctcaccctccagccccttccaccaactgcattcactcccaatggcacgtatctgcagcacctggcaagggaccccacctcaggcaccctctacctgggggctaccaacttcctgttccagctgagccctgggctgcagctggaggccacagtgtccaccggccctgtgctagacagcagggactgcctgccacctgtgatgcctgatgagtgcccccaggcccagcctaccaacaacccgaatcagctgctcctggtgagcccaggggccctggtggtatgcgggagcgtgcaccagggggtctgtgaacagcggcgcctggggcagctcgagcagctgctgctgcggccagagcggcctggggacacacaatatgtggctgccaatgatcctgcggtcagcacggtggggctggtagcccagggcttggcaggggagcccctcctgtttgtggggcgaggatacaccagcaggggtgtggggggtggcattccacccatcacaacccgggccctgtggccgcccgacccccaagctgccttctcctatgaggagacagccaagctggcagtgggccgcctctccgagtacagccaccacttcgtgagtgcctttgcacgtggggccagcgcctacttcctgttcctgcggcgggacctgcaggctcagtctagagcttttcgtgcctatgtatctcgagtgtgtctccgggaccagcactactactcctatgtggagttgcctctggcctgcgaaggtggccgctacgggctgatccaggctgcagctgtggccacgtccagggaggtggcgcatggggaggtgctctttgcagctttctcctcggctgcaccccccactgtgggccggcccccatcggcggctgctggggcatctggagcctctgccctctgtgccttccccctggatgaggtggaccggcttgctaatcgcacgcgagatgcctgctacacccgggagggtcgtgctgaggatgggaccgaggtggcctacatcgagtatgatgtcaattctgactgtgcacagctgccagtggacaccctggatgcttatccctgtggctcagaccacacgcccagccccatggccagccgggtcccgctggaagccacaccaattctggagtggccagggattcagctaacagctgtggcagtcaccatggaagatggacacaccatcgctttcctgggtgatagtcaagggcagctgcacagggtctacttgggcccagggagcgatggccacccatactccacacagagcatccagcaggggtctgcagtgagcagagacctcacctttgatgggacctttgagcacctgtatgtcatgacccagagcacacttctgaaggttcctgtggcttcctgtgctcagcacctggactgtgcatcttgccttgctcacagggacccatactgtgggtggtgcgtgctccttggcaggtgcagtcgccgttctgagtgctcgaggggccagggcccagagcagtggctatggagcttccagcctgagctgggctgtctgcaagtggcagccatgagtcctgccaacatcagccgagaggagacgagggaggttttcctatcagtgccagacctgccacccctgtggccaggggagtcatattcctgccactttggggaacatcagagtcctgccctgctgactggttctggtgtgatgtgcccctccccagaccctagtgaggccccagtgctgccgagaggagccgactacgtatccgtgagcgtggagctcagatttggcgctgttgtgatcgccaaaacttccctctctttctatgactgtgtggcggtcactgaactccgcccatctgcgcagtgccaggcctgtgtgagcagccgctgggggtgtaactggtgtgtctggcagcacctgtgcacccacaaggcctcgtgtgatgctgggcccatggttgcaagccatcaggtgatggagactcagcagagcttgagggccctcccgcccccctcatcctcccgtccagcctcgactaccagtatgacacccccgggctctgggagctggaagaggcgaccttgggggcaagctcctgcccctgtgtggagagcgttcagggctccacgttgatgccggtccatgtggagcgggaaatccggctgctaggcaggaacctgcaccttttccaggatggcccaggagacaatgagtgtgtgatggagctggagggcctcgaggtggtggttgaggcccgggtcgagtgtgagccacctccagatacccagtgccatgtcacctgccagcagcaccagctcagctatgaggctctgcagccggagctccgtgtggggctgtttctgcgtcgggccggccgtctgcgtgtggacagtgctgaggggctgcatgtggtactgtatgactgttccgtgggacatggagactgcagccgctgccaaactgccatgccccagtatggctgtgtgtggtgtgagggggagcgtccacgttgtgtgacccgggaggcctgtggtgaggctgaggctgtggccacccagtgcccagcgcccctcatccactcggtggagccactgactgggcctgtagacggaggcacccgtgtcaccatcaggggctccaacctgggccagcatgtgcaggatgtgctgggcatggtcacggtggctggagtgccctgtgctgtggatgcccaggagtacgaggtctccagcagcctcgtgtgcatcaccggggccagtggggaggaggtggccggcgccacagcggtggaggtgccgggaagaggacgtggtgtctcagaacacgactttgcctaccaggatccgaaggtccattccatcttcccggcccgcggccccagagctgggggcacccgtctcaccctgaatggctccaagctcctgactgggcggctggaggacatccgagtggtggttggagaccagccttgtcacttgctgccggagcagcagtcagaacaactgcggtgtgagaccagcccacgccccacgcctgccacgctccctgtggctgtgtggtttggggccacggagcggaggcttcaacgcggacagttcaagtataccttggaccccaacatcacctctgctggccccaccaagagcttcctcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacggcatgttcccttggaccctcctgcagtagccagcaatttgaggagccgtgccatgtcaactcctcccagctcatcacgtgccgcacacctgccctcccaggcctgcctgaggacccctgggtccgggtggaatttatccttgacaacctggtctttgactttgcaacactgaaccccacacctttctcctatgaggccgaccccaccctgcagccactcaaccctgaggaccccaccatgccattccggcacaagcctgggagtgtgttctccgtggagggggagaacctggaccttgcaatgtccaaggaggaggtggtggctatgataggggatggcccctgtgtggtgaagacgctgacgcggcaccacctgtactgcgagccccccgtggagcagcccctgccacggcaccatgccctccgagaggcacctgactctttgcctgagttcacggtgcagatggggaacttgcgcttctccctgggtcacgtgcagtatgacggcgagagccct

SEQ ID NO: 16139 - DNA, 627 bp, Homo sapiens
  ENST00000465117
ggagcggaggcttcaacgcggacagttcaagtataccttggaccccaacatcacctctgctggccccaccaagagcttcctcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacgtttgaggagccgtgccatgtcaactcctcccagctcatcacgtgccgcacacctgccctcccaggcctgcctgaggacccctgggtccgggtggaatttatccttgacaacctggtctttgactttgcaacactgaaccccacacctttctcctatgaggccgaccccaccctgcagccactcaaccctgaggaccccaccatgccattccggcacaagcctgggagtgtgttctccgtggagggggagaacctggaccttgcaatgtccaaggaggaggtggtggctatgataggggatggcccctgtgtggtgaagacgctgacgcggcaccacctgtactgcgagccccccgtggagcagcccctgccacggcaccatgccctccgagaggcacctgactcttt

SEQ ID NO: 16140 - DNA, 688 bp, Homo sapiens
  ENST00000467913
tgcagctccactatgtgggggtttgtagggctttatgttgaggcactgagaatcccatgctgctagtaggggcaaggggtcgtgtggtttggggctggggctgagctgacctagccgggactgggctgtgctttaggtccaggtaacataagccatcttacgttacgtaagctcacggtctgtttcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacggcatgttcccttggaccctcctgcagtagccagcaatttgaggagccgtgccatgtcaactcctcccagctcatcacgtgccgcacacctgccctcccaggcctgcctgaggacccctgggtccgggtggaatttatccttgacaacctggtctttgactttgcaacactgaaccccacacctttctcctatgaggccgaccccaccctgcagccactcaaccctgaggaccccaccatgccattccggcacaagcctgggagtgtgttctccgtggagggggagaacctggaccttgcaatgtccaaggaggaggtggtggctatgataggggatggcccctgtgtggtgaagacgctgacgc

SEQ ID NO: 16141 - DNA, 1025 bp, Homo sapiens
  ENST00000464294
atgctttgagtgggtactgtgcatgtgacgtggcggaggacatgggcggctagctgtgcccactcacttgctcagcagctcgccccacaaccaggctgacagggcccctttgtaaatttatgccacagataaattcttccttattgggggcccctggggttgaacttaaatgattgaagccacaaatattaattctcagataccaaggccttctgatgtgtcataaagaattccctccaaagtgagagagggtctctgtcaatcttatggagcatgggaaggggaagaccacctgacagtagggcagggagaggggctgccaggtaagcttgaggggcccttgatgcagcctggcaccccctagcctgccctgtgcctacagcctcgtgtgcatcaccggggccagtggggaggaggtggccggcgccacagcggtggaggtgccgggaagaggacgtggtgtctcagaacacgactttgcctaccaggatccgaaggtccattccatcttcccggcccgcggccccagagctgggggcacccgtctcaccctgaatggctccaagctcctgactgggcggctggaggacatccgagtggtggttggagaccagccttgtcacttgctgccggagcagcagtcagaacaactgcggtgtgagaccagcccacgccccacgcctgccacgctccctgtggctgtgtggtttggggccacggagcggaggcttcaacgcggacagttcaagtataccttggaccccaacatcacctctgctggccccaccaagagcttcctcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacggcatgttcccttggaccctcctgcagtagccagcaatttgaggagccgtgccatgtcaactcctcccagctcatcacgtgccgcaca

SEQ ID NO: 16142 - DNA, 560 bp, Homo sapiens
  ENST00000484485
gagctgcccgaggcggacgagtggacggggggtgacgcacccgccttctccacttccaccctcctctcaggtgatggagactcagcagagcttgagggccctcccgcccccctcatcctcccgtccagcctcgactaccagtatgacacccccgggctctgggagctggaagaggcgaccttgggggcaagctcctgcccctgtgtggagagcgttcagggctccacgttgatgccggtccatgtggagcgggaaatccggctgctaggcaggaacctgcaccttttccagctcagctatgaggctctgcagccggagctccgtgtggggctgtttctgcgtcgggccggccgtctgcgtgtggacagtgctgaggggctgcatgtggtactgtatgactgttccgtgggacatggagactgcagccgctgccaaactgccatgccccagtatggctgtgtgtggtgtgagggggagcgtccacgttgtgtgacccgggaggcctgtggtgaggctgaggctgtggccacccagtgcccagcgcccctcatccactcggt

SEQ ID NO: 16143 - DNA, 663 bp, Homo sapiens
  ENST00000462738
gactaccagtatgacacccccgggctctgggagctggtgaggcccagcccaggaaggaggcctcaggggaggggatgtggggaagatgctacccctagcttgccttgtgattctgcactgggaggaggtgaggggcagggtggagtctgcagccccacaccggccttgcctctggaatctggcaaggcagagggctgagctgggcagggtgggctccatagactgccttgcccttggtgcctgcaggaagaggcgaccttgggggcaagctcctgcccctgtgtggagagcgttcagggctccacgttgatgccggtccatgtggagcgggaaatccggctgctaggcaggaacctgcaccttttccaggatggcccaggagacaatgagtgtgtgatggagctggagggcctcgaggtggtggttgaggcccgggtcgagtgtgagccacctccagatacccagtgccatgtcacctgccagcagcaccagctcagctatgaggctctgcagccggagctccgtgtggggctgtttctgcgtcgggccggccgtctgcgtgtggacagtgctgaggggctgcatgtggtactgtatgactgttccgtgggacatggagactgcagccgctgccaaactgccatgccccagtatggctgtgtg

SEQ ID NO: 16144 - DNA, 626 bp, Homo sapiens
  ENST00000466353
gggaaggagcggagacgagcccggccgacgcggctttgtctcctttgttcccggcggtggcagcgccgcgcgggaggggcgggcagcgggcgcagttttccgcccctcggtctccgggtaacagctgcggctccgccagacccggggagaggccgctgcgcgcggagcccgagcccggagcggccgacgcccgcctcggcgcgcacatcccgcggggcccggccgggtgactacgtatccgtgagcgtggagctcagatttggcgctgttgtgatcgccaaaacttccctctctttctatgactgtgtggcggtcactgaactccgcccatctgcgcagtgccaggcctgtgtgagcagccgctgggggtgtaactggtgtgtctggcagcacctgtgcacccacaaggcctcgtgtgatgctgggcccatggttgcaagccatcagagcccgcttgtctccccagaccctcctgcaagaggtggacccagcccctccccacccacagcccccaaagccctggccacccctgctcctgacacccttcccgtggagcctggggctccctccacagccacagcttcggacatctcacctggggctagtccttccctgctcagcccctg

SEQ ID NO: 16145 - DNA, 284 bp, Homo sapiens
  ENST00000473683
tgctgaggatgggaccgaggtggcctacatcgagtatgatgtcaattctgactgtgcacagctgccagtggacaccctggatgcttatccctgtggctcagaccacacgcccagccccatggccagccgggtcccgctggaagccacaccaattctggagtggccagggattcagctaacagctgtggcagtcaccatggaagatggacacaccatcgctttcctgggtgatagtcaagggcagctgcacaggggagcgatggccacccatactccacacagag

SEQ ID NO: 16146 - DNA, 6146 bp, Homo sapiens
  ENST00000361971
gctcctggcaccgccagctgctacttggccctcgccggtggcccaccaggacaatgcccccccgcagccatctcatgcccatcgccactgccctggggcagctgaactgagcgtatgtgccacgccgcccaggagacccctctgctgcaccacttcatggcccccgtgatggctcgctggcctcccttcggcctctgcctcctcctgctgctgctgtccccaccgccactgcccttgacaggggcccatcgcttctccgcacctaataccactctcaaccacttggcactggcacctggccgaggcacactctatgtcggcgcagtgaaccgcctcttccagctcagccccgagctgcagctcgaggccgtggctgtcactggccctgtaatcgacagccctgactgcgtgcccttccgtgacccagccgagtgcccacaggcccagctcactgacaatgccaaccagctgctgctggtgagcagccgcgcccaggagctggtggcctgcgggcaggtgcggcagggcgtgtgtgagacacggcgccttggggatgtggccgaggtgctgtaccaggctgaggaccctggtgacgggcagtttgtggctgccaataccccgggagtggcaacggtggggctggtggtgcccttgcccggccgggacctcctgcttgtggccagaggcctggcgggcaagctgtcggcaggggtgccacccctggccatccgccagctggccgggtctcagcccttctccagcgagggcctgggccgcctggtggtgggcgacttctccgactacaacaacagctacgtcggggcctttgccgacgcccgctccgcctacttcgtgttccgccgccgcggggcccgggcccaggctgagtaccgctcctacgtggcccgcgtctgcctgggggacaccaacctgtactcctacgtggaggtccccctcgcctgccagggccagggcctcatccaggccgccttccttgccccgggcaccttgctaggggtgtttgccgcgggcccaaggggcacccaggcggcgctctgtgccttccccatggtggagctgggtgccagcatggagcaggcccggagactctgctacacggcgggcggccggggccccagcggcgcagaggaagccaccgtggagtacggcgtcacgtcgcgctgcgtcaccctgccccttgattcccccgagtcgtacccctgtggcgacgagcacacccccagccccattgctggccgccagcccctggaggtccagcctctgctgaagctcgggcagccggtcagcgccgtggcagctctccaggcagatgggcacatgatagccttcctgggggacacccagggccagctgtacaaggtctttctccacggctcccagggccaggtttaccactcccagcaagtggggcctccaggctcagccatcagcccagacctgctgctggacagcagtggcagtcacctctatgtcctgactgcccaccaggtggaccggatacctgtggcagcctgcccccagttccctgactgtgccagctgcctccaggcccaggacccgctgtgtggctggtgtgtcctccagggcaggtgtacccggaagggccagtgcgggcgggcaggccagctgaaccagtggctgtggagttatgaggaggacagccactgcctgcacatccagagcctgctgccgggccaccacccccgccaggagcagggccaggtcactttgtctgtcccccggctgcccatcctggatgcagatgaatacttccattgtgcgttcggggactatgacagcttggctcatgtggaagggccccacgtggcctgtgtcacccctccccaagaccaggtgccacttaaccctccaggcacagaccacgtcactgtgcccctggccctgatgttcgaggacgtgactgtggctgccaccaacttctccttttatgactgcagtgccgtccaggccttggaggcggctgccccgtgtcgcgcttgcgtgggcagcatctggcggtgtcactggtgcccgcagagtagccactgcgtgtacggagagcactgcccagagggcgagaggaccatctacagcgcccaggaggtggacatccaggtgcgtggcccaggggcttgcccacaggtcgaaggcctggcaggtccccacctggtgcctgtgggctgggagagccatttggccctacgcgtgcggaaccttcaacatttccgaggcctgcctgcctccttccactgctggctggagctgcctggagaacttcggggactgccggccaccctggaggagacagcaggggattcaggcctcatccactgccaggcccaccagttttatccctccatgtcccagcgggagctcccagtgcccatctacgtcacccagggtgaagcccagaggctggacaacacccatgctctttatgtgatcctgtacgactgcgccatgggccacccggactgcagccactgccaagcggccaacaggagcctgggctgcctgtggtgtgctgacggccagcctgcctgtcgctatgggcccttgtgcccgccgggggctgtggagctgctgtgtcctgcgcccagcattgatgcagtcgagcccctgaccggtccccctgagggaggcttggccctcaccatcctgggctccaacctgggccgggccttcgccgatgtgcagtacgccgtgagcgtggccagccggccctgcaaccctgagccctctctctaccgcacgtcggcccggattgtgtgtgtgacatctcctgcccccaatggcaccactgggcccgtccgggtggccattaagagccagccaccaggcatctcaagccagcacttcacctaccaggaccctgtcctgctgagcctgagtcctcgctggggcccccaggcagggggcacccagctcaccatccgaggtcagcacctccagacaggtggcaacaccagtgccttcgtgggtggccaaccctgtcccatcctggagccagtgtgtccggaggccatcgtgtgccgtaccaggccccaggctgccccaggagaagcagcggtccttgtggtctttggccatgcccagcgcacactgctcgccagccccttccgctacaccgccaacccccagcttgtagcggcggagcccagtgccagcttccgggggggtgggcgactgatccgtgtcaggggcaccggcctagacgtggtgcagcggcccctactgtctgtgtggctggaggctgacgcagaggtgcaggcttccagggcccagccccaggacccacagccaaggaggagctgtggagcccctgctgcggacccccaggcttgtatccagctcggtggggggctgctgcagtgctccaccgtctgctccgtcaactcgtccagcctcctcctgtgccggagccctgctgtaccagacagagcccacccgcagcgggtcttcttcaccctagacaacgtgcaagtggacttcgccagtgccagtgggggccagggcttcctgtaccagcccaacccccgcctggcacccctcagccgcgaggggcctgcccgcccctaccgcctcaagccaggccatgtcctggatgtggagggcgagggcctcaacctgggcatcagcaaggaggaggtgcgcgtgcacatcggccgcggcgagtgcctggtgaagacgctcacgcgcacccacctgtactgcgagccgcctgcgcacgccccgcagcctgccaatggctccggcctgccacagttcgtggtgcagatgggcaatgtgcagctggccctgggccctgtgcagtacgaggctgaacccccgctgtctgcctttcccgtggaggcccaggcaggcgtgggcatgggtgctgcagtgctgattgccgccgtgctcctcctcaccctcatgtacaggcacaagagcaagcaggccctgcgggactaccagaaggtgctagtgcagctggagagcctggagaccggcgtgggagaccagtgccgcaaggagttcacagacctcatgacggagatgaccgacctcagcagcgacctggagggcagcgggatccccttcctggactaccgcacctacgccgagcgcgccttcttccctggccatggcggttgcccgctgcagcccaagcctgaggggccaggggaggacggccactgtgccactgtgcgccagggcctcacgcagctctccaacctgctcaacagcaagctcttcctcctcacgctcatccacaccctggaggagcagcccagcttttcccagagggatcgctgccatgtggcttcgctgctgtcgctagcgctacacggcaagctggagtacctgacggacatcatgaggaccctgctgggtgacctggcggcccattacgtgcacaggaaccccaagctcatgctacgcaggacagagaccatggtggagaaactgctcaccaactggctgtccatctgcctgtacgccttcctgagggaggtggctggtgaaccactgtacatgctcttccgggccatccagtaccaggtggacaaaggccccgtggacgccgtgacaggcaaggccaaacggaccctgaatgatagccgcttgctgcgggaggacgtggagttccagcccctgacgctgatggtgctggtggggcccggggctggcggggccgcaggcagcagcgagatgcagcgcgtgccagcccgggtgctcgacacggacaccatcacccaggtcaaggagaaggtgttggaccaagtctacaagggcacccccttctcccagaggccctcagtgcatgccctagaccttgagtggcgctcaggcctggctggtcacctgaccctatcggacgaagacttgacctccgtgacccaaaaccactggaagagactcaacaccttgcaacactacaaggtcccagatggagcaacagtggggctcgtccctcagctgcaccgtggcagcaccatctcccagagcctggcccagaggtgccccttgggagagaacatacccacgctggaggatggcgaggaggggggggtgtgcctctggcacctggtgaaagccaccgaggagccagaaggggccaaggtgcggtgcagcagcctgcgggagcgcgagccagcaagggccaaggccattccggaaatctacctcacccgtctgctgtccatgaagggcacgctgcagaagtttgtggacgacaccttccaggccattctcagcgtgaaccggcccatccccatcgccgtcaagtacctgtttgaccttctggatgagctagcagagaagcacggcatcgaggacccagggaccctgcacatctggaagaccaacagtctgctgctgcggttctgggtgaatgccttgaagaacccacagctcatctttgatgtacgggtgtcggacaatgtggacgccatccttgctgtcatcgcccagaccttcattgactcctgtaccacctcggagcataaagtgggccgggattccccagtgaacaaactgctctacgcccgggagatcccacgctacaagcagatggtggagaggtactatgcggacattcgccagagctctccggcgagctaccaggagatgaactctgctttggctgagctctccgggaactacacttctgctccccactgtctggaggctctgcaagaactctacaaccacatccacaggtactatgatcagattatcagtgccctggaggaggaccctgtgggccagaagctgcagctggcctgccgcctgcagcaggtcgccgccctggtggaaaacaaagtgactgacctgtgagctctggctcagacagcagcaagccggatccaccaacaccgcagcgccttatgaccccggaaccgagccagccactgaggggagctggcagagcctgggggcacagggtgcaaagccaggcactgtgcccagcagtgggctccctgcctgccacctcccctgccagcccacccaccttccccccacctgagattgtttctaatttataaggatccccctccttccccctctccccattgtatttatttgcctgctggaaaatcacatccggaaataaaatagaaatatgtctttttatttta

SEQ ID NO: 16147 - DNA, 774 bp, Homo sapiens
  ENST00000411613
agagcctggagaccggcgtgggagaccagtgccgcaaggagttcacagacctcatgacggagatgaccgacctcagcagcgacctggagggcagcgggatccccttcctggactaccgcacctacgccgagcgcgccttcttccctggccatggcggttgcccgctgcagcccaagcctgaggggccaggggaggacggccactgtgccactgtgcgccagggcctcacgcagctctccaacctgctcaacagcaagctcttcctcctcacgctcatccacaccctggaggagcagcccagcttttcccagagggatcgctgccatgtggcttcgctgctgtcgctagcgctacacggcaagctggagtacctgacggacatcatgaggaccctgctgggtgacctggcggcccattacgtgcacaggaaccccaagctcatgctacgcaggacagagaccatggtggagaaactgctcaccaactggctgtccatctgcctgtacgccttcctgagggaggtggctggtgaaccactgtacatgctcttccgggccatccagtaccaggtggacaaaggccccgtggacgccgtgacagagtggcgctcaggcctggctggtcacctgaccctatcggacgaagacttgacctccgtgacccaaaaccactggaagagactcaacaccttgcaacactacaaggtcccagatggagcaacagtggggctcgtccctcagctgcaccgtggcagcaccatctcccagagcctgg

SEQ ID NO: 16148 - DNA, 717 bp, Homo sapiens
  ENST00000482654
gatccccttcctggactaccgcacctacgccgagcgcgccttcttccctggccatggcggttgcccgctgcagcccaagcctgaggggccaggggaggacggccactgtgccactgtgcgccagggcctcacgcagctctccaacctgctcaacagcaagctcttcctcctcacgcgctacacggcaagctggagtacctgacggacatcatgaggaccctgctgggtgacctggcggcccattacgtgcacaggaaccccaagctcatgctacgcaggacagagaccatggtggagaaactgctcaccaactggctgtccatctgcctgtacgccttcctgagggaggtggctggtgaaccactgtacatgctcttccgggccatccagtaccaggtggacaaaggccccgtggacgccgtgacaggcaaggccaaacggaccctgaatgatagccgcttgctgcgggaggacgtggagttccagcccctgacgctgatggtgctggtggggcccggggctggcggggccgcaggcagcagcgagatgcagcgcgtgccagcccgggtgctcgacacggacaccatcacccaggtcaaggagaaggtgttggaccaagtctacaagggcacccccttctcccagaggccctcagtgcatgccctagaccttgagtggcgctcaggcctggctggtcacctgaccctatcggacgaa

SEQ ID NO: 16149 - DNA, 489 bp, Homo sapiens
  ENST00000455214
caaacggaccctgaatgatagccgcttgctgcgggaggacgtggagttccagcccctgacgctgatggtgctggtggggcccggggctggcggggccgcaggcagcagcgagatgcagcgcgtgccagcccgggtgctcgacacggacaccatcacccaggtcaaggagaaggtgttggaccaagtctacaagggcacccccttctcccagaggccctcagtgcatgccctagaccttgagtggcgctcaggcctggctggtcacctgaccctatcggacgaagacttgacctccgtgacccaaaaccactggaagagactcaacaccttgcaacactacaaggtcccagatggagcaacagtggggctcgtccctcagctgcaccgtggcagcaccatctcccagagcctggcccagaggtgccccttgggagagagtgagtccctcggccctgacctggggccactggagtccaggctgggcaggca

SEQ ID NO: 16150 - DNA, 773 bp, Homo sapiens
  ENST00000485980
ggtgtgcctctggcacctggtgaaagccaccgaggagccagaaggggccaaggtgcggtgcagcagcctgcgggagcgcgagccagcaagggccaaggccattccggaaatctacctcacccgtctgctgtccatgaagggcacgctgcagaagtttgtggacgacaccttccaggccattctcagcgtgaaccggcccatccccatcgccgtcaagtacctgtttgaccttctggatgagctagcagagaagcacggcatcgaggacccagggaccctgcacatctggaagaccaacaggtgcctttcctgctgccccacccctgctgtgcatatggtccactgagtcccagagagaccaggacattcccagggtggatgcgcccacctggggtttctggaacttacaggaagatctagggcccaggtcacctaggccaccaggccagcttccagcggcccctggctccgagtgtgttgccagtaggctggagtacatggggcggagatcacgatggcaggccagggcctcacgcccacgcctgccctgcgcccccagtctgctgctgcggttctgggtgaatgccttgaagaacccacagctcatctttgatgtacgggtgtcggacaatgtggacgccatccttgctgtcatcgcccagaccttcattgactcctgtaccacctcggagcataaagtgggccgggattccccagtgaacaaactgctctacgcccgggagatcccacgctacaagcagatggtggagagg

SEQ ID NO: 16151 - DNA, 526 bp, Homo sapiens
  ENST00000448847
ctgcctcgcagggcacgctgcagaagtttgtggacgacaccttccaggccattctcagcgtgaaccggcccatccccatcgccgtcaagtacctgtttgaccttctggatgagctagcagagaagcacggcatcgaggacccagggaccctgcacatctggaagaccaacagtctgctgctgcggttctgggtgaatgccttgaagaacccacagctcatctttgatgtacgggtgtcggacaatgtggacgccatccttgctgtcatcgcccagaccttcattgactcctgtaccacctcggagcataaagtgggccgggtgagagcagtgccagcagcagcagctggcaggggcttgaggaggaaaggcttatgggggaagcctagagggctgtgcacagagctctgggtgggcagtggcagcatcatgggggcaccttcacctccgagctcatgcctagcgcctcccctccctccggagcaggattccccagtgaacaaactgctctacgcccgggagatccc

SEQ ID NO: 16152 - DNA, 626 bp, Homo sapiens
  ENST00000469190
cagtggcagcatcatgggggcaccttcacctccgagctcatgcctagcgcctcccctccctccggagcaggattccccagtgaacaaactgctctacgcccgggagatcccacgctacaagcagatggtggagaggtactatgcggacattcgccagagctctccggcgagctaccaggagatgaactctgctttggctgagctctccgggaactacacttctgctccccactgtctggaggctctgcaagaactctacaaccacatccacaggtactatgatcaggtcgccgccctggtggaaaacaaagtgactgacctgtgagctctggctcagacagcagcaagccggatccaccaacaccgcagcgccttatgaccccggaaccgagccagccactgaggggagctggcagagcctgggggcacagggtgcaaagccaggcactgtgcccagcagtgggctccctgcctgccacctcccctgccagcccacccaccttccccccacctgagattgtttctaatttataaggatccccctccttccccctctccccattgtatttatttgcctgctggaaaatcacatccggaaataaaatagaaatatgtctttttatttt

SEQ ID NO: 16153 - DNA, 699 bp, Homo sapiens
  ENST00000472415
gtctgctcctccaggtactatgcggacattcgccagagctctccggcgagctaccaggagatgaactctgctttggctgagctctccggggtgaggcatggcccggggggtgcgcctgtccacacgtgggtggaaagactagcagagcagaggggggagacttggggcttgaggaccaggctgggacctcactgcccccctccacgtggtgcccccagaactacacttctgctccccactgtctggaggctctgcaagaactctacaaccacatccacaggtactatgatcagattatcagtgccctggaggaggaccctgtgggccagaagctgcagctggcctgccgcctgcagcaggtcgccgccctggtggaaaacaaagtgactgacctgtgagctctggctcagacagcagcaagccggatccaccaacaccgcagcgccttatgaccccggaaccgagccagccactgaggggagctggcagagcctgggggcacagggtgcaaagccaggcactgtgcccagcagtgggctccctgcctgccacctcccctgccagcccacccaccttccccccacctgagattgtttctaatttataaggatccccctccttccccctctccccattgtatttatttgcctgctggaaaatcacatccggaaataaaatagaaatatgtctttttatttt

SEQ ID NO: 16154 - DNA, 6377 bp, Homo sapiens
  ENST00000538966
gatgagtcggactgggcacgattgcattgtggggagggaggctggggctctgtgagacgtgctcctggcaccgccagctgctacttggccctcgccggtggcccaccaggacaatgcccccccgcagccatctcatgcccatcgccactgccctggggcagctgaactgagcgtatgtgccacgccgcccaggagacccctctgctgcaccacttcatgcacccccgctgccttgccccagtgcttcctcgccctggagctgggcgccagcatggagctcacccctgcctcttcgctgacttgctccttgctcagcccgcggctgcctggctctttcccccagctgcggagggttcctccttgcagccggccctggctgcccaaggcccccgtgatggctcgctggcctcccttcggcctctgcctcctcctgctgctgctgtccccaccgccactgcccttgacaggggcccatcgcttctccgcacctaataccactctcaaccacttggcactggcacctggccgaggcacactctatgtcggcgcagtgaaccgcctcttccagctcagccccgagctgcagctcgaggccgtggctgtcactggccctgtaatcgacagccctgactgcgtgcccttccgtgacccagccgagtgcccacaggcccagctcactgacaatgccaaccagctgctgctggtgagcagccgcgcccaggagctggtggcctgcgggcaggtgcggcagggcgtgtgtgagacacggcgccttggggatgtggccgaggtgctgtaccaggctgaggaccctggtgacgggcagtttgtggctgccaataccccgggagtggcaacggtggggctggtggtgcccttgcccggccgggacctcctgcttgtggccagaggcctggcgggcaagctgtcggcaggggtgccacccctggccatccgccagctggccgggtctcagcccttctccagcgagggcctgggccgcctggtggtgggcgacttctccgactacaacaacagctacgtcggggcctttgccgacgcccgctccgcctacttcgtgttccgccgccgcggggcccgggcccaggctgagtaccgctcctacgtggcccgcgtctgcctgggggacaccaacctgtactcctacgtggaggtccccctcgcctgccagggccagggcctcatccaggccgccttccttgccccgggcaccttgctaggggtgtttgccgcgggcccaaggggcacccaggcggcgctctgtgccttccccatggtggagctgggtgccagcatggagcaggcccggagactctgctacacggcgggcggccggggccccagcggcgcagaggaagccaccgtggagtacggcgtcacgtcgcgctgcgtcaccctgccccttgattcccccgagtcgtacccctgtggcgacgagcacacccccagccccattgctggccgccagcccctggaggtccagcctctgctgaagctcgggcagccggtcagcgccgtggcagctctccaggcagatgggcacatgatagccttcctgggggacacccagggccagctgtacaaggtctttctccacggctcccagggccaggtttaccactcccagcaagtggggcctccaggctcagccatcagcccagacctgctgctggacagcagtggcagtcacctctatgtcctgactgcccaccaggtggaccggatacctgtggcagcctgcccccagttccctgactgtgccagctgcctccaggcccaggacccgctgtgtggctggtgtgtcctccagggcaggtgtacccggaagggccagtgcgggcgggcaggccagctgaaccagtggctgtggagttatgaggaggacagccactgcctgcacatccagagcctgctgccgggccaccacccccgccaggagcagggccaggtcactttgtctgtcccccggctgcccatcctggatgcagatgaatacttccattgtgcgttcggggactatgacagcttggctcatgtggaagggccccacgtggcctgtgtcacccctccccaagaccaggtgccacttaaccctccaggcacagaccacgtcactgtgcccctggccctgatgttcgaggacgtgactgtggctgccaccaacttctccttttatgactgcagtgccgtccaggccttggaggcggctgccccgtgtcgcgcttgcgtgggcagcatctggcggtgtcactggtgcccgcagagtagccactgcgtgtacggagagcactgcccagagggcgagaggaccatctacagcgcccaggaggtggacatccaggtgcgtggcccaggggcttgcccacaggtcgaaggcctggcaggtccccacctggtgcctgtgggctgggagagccatttggccctacgcgtgcggaaccttcaacatttccgaggcctgcctgcctccttccactgctggctggagctgcctggagaacttcggggactgccggccaccctggaggagacagcaggggattcaggcctcatccactgccaggcccaccagttttatccctccatgtcccagcgggagctcccagtgcccatctacgtcacccagggtgaagcccagaggctggacaacacccatgctctttatgtgatcctgtacgactgcgccatgggccacccggactgcagccactgccaagcggccaacaggagcctgggctgcctgtggtgtgctgacggccagcctgcctgtcgctatgggcccttgtgcccgccgggggctgtggagctgctgtgtcctgcgcccagcattgatgcagtcgagcccctgaccggtccccctgagggaggcttggccctcaccatcctgggctccaacctgggccgggccttcgccgatgtgcagtacgccgtgagcgtggccagccggccctgcaaccctgagccctctctctaccgcacgtcggcccggattgtgtgtgtgacatctcctgcccccaatggcaccactgggcccgtccgggtggccattaagagccagccaccaggcatctcaagccagcacttcacctaccaggaccctgtcctgctgagcctgagtcctcgctggggcccccaggcagggggcacccagctcaccatccgaggtcagcacctccagacaggtggcaacaccagtgccttcgtgggtggccaaccctgtcccatcctggagccagtgtgtccggaggccatcgtgtgccgtaccaggccccaggctgccccaggagaagcagcggtccttgtggtctttggccatgcccagcgcacactgctcgccagccccttccgctacaccgccaacccccagcttgtagcggcggagcccagtgccagcttccgggggggtgggcgactgatccgtgtcaggggcaccggcctagacgtggtgcagcggcccctactgtctgtgtggctggaggctgacgcagaggtgcaggcttccagggcccagccccaggacccacagccaaggaggagctgtggagcccctgctgcggacccccaggcttgtatccagctcggtggggggctgctgcagtgctccaccgtctgctccgtcaactcgtccagcctcctcctgtgccggagccctgctgtaccagacagagcccacccgcagcgggtcttcttcaccctagacaacgtgcaagtggacttcgccagtgccagtgggggccagggcttcctgtaccagcccaacccccgcctggcacccctcagccgcgaggggcctgcccgcccctaccgcctcaagccaggccatgtcctggatgtggagggcgagggcctcaacctgggcatcagcaaggaggaggtgcgcgtgcacatcggccgcggcgagtgcctggtgaagacgctcacgcgcacccacctgtactgcgagccgcctgcgcacgccccgcagcctgccaatggctccggcctgccacagttcgtggtgcagatgggcaatgtgcagctggccctgggccctgtgcagtacgaggctgaacccccgctgtctgcctttcccgtggaggcccaggcaggcgtgggcatgggtgctgcagtgctgattgccgccgtgctcctcctcaccctcatgtacaggcacaagagcaagcaggccctgcgggactaccagaaggtgctagtgcagctggagagcctggagaccggcgtgggagaccagtgccgcaaggagttcacagacctcatgacggagatgaccgacctcagcagcgacctggagggcagcgggatccccttcctggactaccgcacctacgccgagcgcgccttcttccctggccatggcggttgcccgctgcagcccaagcctgaggggccaggggaggacggccactgtgccactgtgcgccagggcctcacgcagctctccaacctgctcaacagcaagctcttcctcctcacgctcatccacaccctggaggagcagcccagcttttcccagagggatcgctgccatgtggcttcgctgctgtcgctagcgctacacggcaagctggagtacctgacggacatcatgaggaccctgctgggtgacctggcggcccattacgtgcacaggaaccccaagctcatgctacgcaggacagagaccatggtggagaaactgctcaccaactggctgtccatctgcctgtacgccttcctgagggaggtggctggtgaaccactgtacatgctcttccgggccatccagtaccaggtggacaaaggccccgtggacgccgtgacaggcaaggccaaacggaccctgaatgatagccgcttgctgcgggaggacgtggagttccagcccctgacgctgatggtgctggtggggcccggggctggcggggccgcaggcagcagcgagatgcagcgcgtgccagcccgggtgctcgacacggacaccatcacccaggtcaaggagaaggtgttggaccaagtctacaagggcacccccttctcccagaggccctcagtgcatgccctagaccttgagtggcgctcaggcctggctggtcacctgaccctatcggacgaagacttgacctccgtgacccaaaaccactggaagagactcaacaccttgcaacactacaaggtcccagatggagcaacagtggggctcgtccctcagctgcaccgtggcagcaccatctcccagagcctggcccagaggtgccccttgggagagaacatacccacgctggaggatggcgaggaggggggggtgtgcctctggcacctggtgaaagccaccgaggagccagaaggggccaaggtgcggtgcagcagcctgcgggagcgcgagccagcaagggccaaggccattccggaaatctacctcacccgtctgctgtccatgaagggcacgctgcagaagtttgtggacgacaccttccaggccattctcagcgtgaaccggcccatccccatcgccgtcaagtacctgtttgaccttctggatgagctagcagagaagcacggcatcgaggacccagggaccctgcacatctggaagaccaacagtctgctgctgcggttctgggtgaatgccttgaagaacccacagctcatctttgatgtacgggtgtcggacaatgtggacgccatccttgctgtcatcgcccagaccttcattgactcctgtaccacctcggagcataaagtgggccgggattccccagtgaacaaactgctctacgcccgggagatcccacgctacaagcagatggtggagaggtactatgcggacattcgccagagctctccggcgagctaccaggagatgaactctgctttggctgagctctccgggaactacacttctgctccccactgtctggaggctctgcaagaactctacaaccacatccacaggtactatgatcagattatcagtgccctggaggaggaccctgtgggccagaagctgcagctggcctgccgcctgcagcaggtcgccgccctggtggaaaacaaagtgactgacctgtgagctctggctcagacagcagcaagccggatccaccaacaccgcagcgccttatgaccccggaaccgagccagccactgaggggagctggcagagcctgggggcacagggtgcaaagccaggcactgtgcccagcagtgggctccctgcctgccacctcccctgccagcccacccaccttccccccacctgagattgtttctaatttataaggatccccctccttccccctctccccattgtatttatttgcctgctggaaaatcacatccggaaataaaatagaaatatgtctttttattttattttg

SEQ ID NO: 16155 - DNA, 7346 bp, Homo sapiens
  ENST00000258526
gcgaggaggaaacggtgccggagcgcgcagggcttgctgccgccaccgccgctgcacaggctgccggagcgagcctgccgcgcgccgccctccccgctctccttcctgggcgagctgcggggatggggcggccgcgggagcccgagcgcgcgcaggaaccgccgccgccgccgcccgcgtctccgttgccgcgcgcctgagccgccgtcgccgccgcgcgccctgcccgggggcggcccccccagccccatggaggtctcccggaggaaggcgccgccgcgccccccgcgccccgcagcgccactgcccctgctcgcctatctgctggcactggcggctcccggccggggcgcggacgagcccgtgtggcggtcggagcaagccatcggagccatcgcggcgagccaggaggacggcgtgtttgtggcgagcggcagctgcctggaccagctggactacagcctggagcacagcctctcgcgcctgtaccgggaccaagcgggcaactgcacagagccggtctcgctggcgccccccgcgcggccccggcccgggagcagcttcagcaagctgctgctgccctaccgcgagggggcggccggcctcggggggctgctgctcaccggctggaccttcgaccggggcgcctgcgaggtgcggcccctgggcaacctgagccgcaactccctgcgcaacggcaccgaggtggtgtcgtgccacccgcagggctcgacggccggcgtggtgtaccgcgcgggccggaacaaccgctggtacctggcggtggccgccacctacgtgctgcctgagccggagacggcgagccgctgcaaccccgcggcatccgaccacgacacggccatcgcgctcaaggacacggaggggcgcagcctggccacgcaggagctggggcgcctcaagctgtgcgagggcgcgggcagcctgcacttcgtggacgcctttctctggaacggcagcatctacttcccctactacccctacaactacacgagcggcgctgccaccggctggcccagcatggcgcgcatcgcgcagagcaccgaggtgctgttccagggccaggcatccctcgactgcggccacggccaccccgacggccgccgcctgctcctctcctccagcctagtggaggccctggacgtctgggcgggagtgttcagcgcggccgctggagagggccaggagcggcgctcccccaccaccacggcgctctgcctcttcagaatgagtgagatccaggcgcgcgccaagagggtcagctgggacttcaagacggccgagagccactgcaaagaaggggatcaacctgaaagagtccaaccaatcgcatcatctaccttgatccattccgacctgacatccgtttatggcaccgtggtaatgaacaggactgttttattcttggggactggagatggccagttacttaaggttattcttggtgagaatttgacttcaaattgtccagaggttatctatgaaattaaagaagagacacctgttttctacaaactcgttcctgatcctgtgaagaatatctacatttatctaacagctgggaaagaggtgaggagaattcgtgttgcaaactgcaataaacataaatcctgttcggagtgtttaacagccacagaccctcactgcggttggtgccattcgctacaaaggtgcacttttcaaggagattgtgtacattcagagaacttagaaaactggctggatatttcgtctggagcaaaaaagtgccctaaaattcagataattcgaagcagtaaagaaaagactacagtgactatggtgggaagcttctctccaagacactcaaagtgcatggtgaagaatgtggactctagcagggagctctgccagaataaaagtcagcccaaccggacctgcacctgtagcatcccaaccagagcaacctacaaagatgtttcagttgtcaacgtgatgttctccttcggttcttggaatttatcagacagattcaactttaccaactgctcatcattaaaagaatgcccagcatgcgtagaaactggctgcgcgtggtgtaaaagtgcaagaaggtgtatccaccccttcacagcttgcgacccttctgattatgagagaaaccaggaacagtgtccagtggctgtcgagaagacatcaggaggaggaagacccaaggagaacaaggggaacagaaccaaccaggctttacaggtcttctacattaagtccattgagccacagaaagtatcgacattagggaaaagcaacgtgatagtaacgggagcaaactttacccgggcatcgaacatcacaatgatcctgaaaggaaccagtacctgtgataaggatgtgatacaggttagccatgtgctaaatgacacccacatgaaattctctcttccatcaagccggaaagaaatgaaggatgtgtgtatccagtttgatggtgggaactgctcttctgtgggatccttatcctacattgctctgccacattgttcccttatatttcctgctaccacctggatcagtggtggtcaaaatataaccatgatgggcagaaattttgatgtaattgacaacttaatcatttcacatgaattaaaaggaaacataaatgtctctgaatattgtgtggcgacttactgcgggtttttagcccccagtttaaagagttcaaaagtgcgcacgaatgtcactgtgaagctgagagtacaagacacctacttggattgtggaaccctgcagtatcgggaggaccccagattcacggggtatcgggtggaatccgaggtggacacagaactggaagtgaaaattcaaaaagaaaatgacaacttcaacatttccaaaaaagacattgaaattactctcttccatggggaaaatgggcaattaaattgcagttttgaaaatattactagaaatcaagatcttaccaccatcctttgcaaaattaaaggcatcaagactgcaagcaccattgccaactcttctaagaaagttcgggtcaagctgggaaacctggagctctacgtcgagcaggagtcagttccttccacatggtattttctgattgtgctccctgtcttgctagtgattgtcatttttgcggccgtgggggtgaccaggcacaaatcgaaggagctgagtcgcaaacagagtcaacaactagaattgctggaaagcgagctccggaaagagatacgtgacggctttgctgagctgcagatggataaattggatgtggttgatagttttggaactgttcccttccttgactacaaacattttgctctgagaactttcttccctgagtcaggtggcttcacccacatcttcactgaagatatgcataacagagacgccaacgacaagaatgaaagtctcacagctttggatgccctaatctgtaataaaagctttcttgttactgtcatccacacccttgaaaagcagaagaacttttctgtgaaggacaggtgtctgtttgcctccttcctaaccattgcactgcaaaccaagctggtctacctgaccagcatcctagaggtgctgaccagggacttgatggaacagtgtagtaacatgcagccgaaactcatgctgagacgcacggagtccgtcgtcgaaaaactcctcacaaactggatgtccgtctgcctttctggatttctccgggagactgtcggagagcccttctatttgctggtgacgactctgaaccagaaaattaacaagggtcccgtggatgtaatcacttgcaaagccctgtacacacttaatgaagactggctgttgtggcaggttccggaattcagtactgtggcattaaacgtcgtctttgaaaaaatcccggaaaacgagagtgcagatgtctgtcggaatatttcagtcaatgttctcgactgtgacaccattggccaagccaaagaaaagattttccaagcattcttaagcaaaaatggctctccttatggacttcagcttaatgaaattggtcttgagcttcaaatgggcacacgacagaaagaacttctggacatcgacagttcctccgtgattcttgaagatggaatcaccaagctaaacaccattggccactatgagatatcaaatggatccactataaaagtctttaagaagatagcaaattttacttcagatgtggagtactcggatgaccactgccatttgattttaccagattcggaagcattccaagatgtgcaaggaaagagacatcgagggaagcacaagttcaaagtaaaagaaatgtatctgacaaagctgctgtcgaccaaggtggcaattcattctgtgcttgaaaaactttttagaagcatttggagtttacccaacagcagagctccatttgctataaaatacttttttgactttttggacgcccaggctgaaaacaaaaaaatcacagatcctgacgtcgtacatatttggaaaacaaacagccttcctcttcgcttctgggtaaacatcctgaagaaccctcagtttgtctttgacattaagaagacaccacatatagacggctgtttgtcagtgattgcccaggcattcatggatgcattttctctcacagagcagcaactagggaaggaagcaccaactaataagcttctctatgccaaggatatcccaacctacaaagaagaagtaaaatcttattacaaagcaatcagggatttgcctccattgtcatcctcagaaatggaagaatttttaactcaggaatctaagaaacatgaaaatgaatttaatgaagaagtggccttgacagaaatttacaaatacatcgtaaaatattttgatgagattctaaataaactagaaagagaacgagggctggaagaagctcagaaacaactcttgcatgtaaaagtcttatttgatgaaaagaagaaatgcaagtggatgtaagcactctggggcctggcttaatctggcaaagttcttcagacgacttgggagcaaaatggctgcttgagctactctgtgtcgttaatttgttgtttgcacataggttccactttgggcactgtctttttaagagaccaaggcacatgcacagcttttagaaagcataccaacccttgtgcctgtgtgtataccgtgggaacccttctgtaaatagagttgaagtggttgttgcaaacagcctccttgtttacagagaatacaaggccagtaagcgaatgtcagtattgtaactacagtctccacttaagcacaatgatataagtggttttgtttgaaaactacagctatgtagcacttgtgctacactgcacctctgcattgtaaagggatactgccagtgctcaaaacaaaatgtgaaatgagtcatttggaaacaaggtgggggtgttagggcaacctcgaggatttgcagcattgaaactttccccagtagttcttggaaaagctgaccgcagaatttggtagtgtacacttagcatttgtgagtgtgtgtgtgtgtttaaaccaaaaactaacagtgttgcaacattgttgaaagggctcgtgtttttcagtggtcatcaactgcactccatcaaactcacctccatttcaccaaggagctctaaagtaaggagagtgggctttatttaaatgaacagcattttaaccagatactttgtcctaatgtatgttccttttcttcatctgttttttcatactaaatgtatttgatagtggacatgttggatattatacaaaaaaatcattaattcatttctgttccaaaacctttgatcagaacgatctgtggaagagtaactccatttctatatgagtgagtgtctccttgctttagatttctggtgaaccctgtggttatgaatacttgtgtgtgatttaaaaaaaaaaagatacattttacattttatcgaattgctgttcacactggagtattatatataaatatatatatttgaggcccaaggcctgaaaaatattagtatacaacttggtatcttagtcttactatgtactttttgaaagtattcctcgcaggagaaagaatttaaaatacccattttattcatgcctttctttttaaagaattctctatccagttatactgtagtctttttagtgctgattttttaattcctgaatttttgctgctcatgaccagttttaataccactgtgttttccttctattaaaccagaagaagtaaacagcataattggcaactcttgagcttttcttgtggcaggcaccttttacccttggtgctccaaatcccccatctaggaaagaaaattttttcaagtcaaataacattgatcacatattccttgaaatcatttaccaacactgtatggagcattaggatttaaatatgaatttgtcttaaaggcaattcctttttgcttctgtattatctggaaaagcatgagagaggtgacacctcaacaaactgatcagagaaaataagcagttactaccctgataggcaccttcccaatcctgttgcttttgaccattgtctgtccaacggacacacctcaaacaaacaaaactaccaaatagatgacagatcagaataaaggtgagaggtctggtccccattgaaggctgctacagtcttcaaagaggtgaaggagttcataagagaacaacagtaggaaagttgagagccaagggtaggagagttgcccaaaagacttcccctactactttagggtactgaaaactcaaaggatcagctacagctttatctaagtatttactaaatgctacatgagggtgtccctgtccagctttctggcacatgagtcctgtgtggagagttacctcctcttccagggactgtgctgttgggaactttgggcaagtcacttacctctttgtgcctcaatttctgtataatatttctaagctacctcactgaggtggtatgaagattcactaatgtatgtagcgtgtttgtcaatcctccagtgaaaagcactatctagatcacattttggatcacattagccaaatgcagtaaatggccaaattagatgtgtgctgaagacaatcagtcactgggtctatattaaacagcaaccagagcaacaaatggcaaacaatttctattttcaagtttctttgcatatttttttggtgcaaaaccatttataaacttttttttctaacactagtgtctacagcagcattcaaaaaaattctgttaccttttctgtattaggatttaaagtctatttcttattgtatacctgattgaagctgttcttggagatgaatgttttaaatgtctatatccaaaaaataaacattttgatgtaactgtg

SEQ ID NO: 16156 - DNA, 705 bp, Homo sapiens
  ENST00000546733
gcgggactcagagtcaccaccctggggctgaaccagaaagaaggggatcaacctgaaagagtccaaccaatcgcatcatctaccttgatccattccgacctgacatccgtttatggcaccgtggtaatgaacaggactgttttattcttggggactggagatggccagttacttaaggttattcttggtgagaatttgacttcaaattgtccagaggttatctatgaaattaaagaagagacacctgttttctacaaactcgttcctgatcctgtgaagaatatctacatttatctaacagctgggaaagaggtgaggagaattcgtgttgcaaactgcaataaacataaatcctgttcggagtgtttaacagccacagaccctcactgcggttggtgccattcgctacaaaggtatctcctgaattctttctcaccaactcgcatttttgaaaaagtgtcatgcggcagaacacttgttgccctactttaacgatccattccagtgacctgagggaactgatctcttcctcgactaaaatcttgttgtgcaatcctaatgaattctcgaaggtgtttccagcggcgtccgtgctatgcaatcactggacccgggagctccccagtctcggggcgggaggggcaggtgtgcagccttcaggagaacgggagagagcaggcaggtttggcttttactttctccaga

SEQ ID NO: 16157 - DNA, 527 bp, Homo sapiens
  ENST00000551850
cccatacagtctgatgctcatggcaagagagacgtgaccaaaagctgccgtggaagtcccaaaaagaggcactactctcagcctgggaggatctgggaggcttcagagagaaagaaggggatcaacctgaaagagtccaaccaatcgcatcatctaccttgatccattccgacctgacatccgtttatggcaccgtggtaatgaacaggactgttttattcttggggactggagatggccagttacttaaggttattcttggtgagaatttgacttcaaattgtccagaggttatctatgaaattaaagaagagacacctgttttctacaaactcgttcctgatcctgtgaagaatatctacatttatctaacagctgggaaagaggtgaggagaattcgtgttgcaaactgcaataaacataaatcctgttcggagtgtttaacagccacagaccctcactgcggttggtgccattcgctacaaaggtgcacttttcaaggagattgtgtacattcagagaactta

SEQ ID NO: 16158 - DNA, 524 bp, Homo sapiens
  ENST00000546659
tttttttttttttttgccttcttttaaatgcttgcatgccacatcacagagggaaattctaggatgtgaacattgtcctaaaacgcaggaattaagtcagttttctgtgttgctagatgcccagcatgcgtagaaactggctgcgcgtggtgtaaaagtgcaagaaggtgtatccaccccttcacagcttgcgacccttctgattatgagagaaaccaggaacagtgtccagtggctgtcgagaagacatcaggaggaggaagacccaaggagaacaaggggaacagaaccaaccaggctttacaggtcagaccctatttttgtgtggttgaggggaaaacctgtctttgaatgaccatgaccacaactcatactactttgggttccttaaaaaaattctctattttactttctaccaaaattcccttttgtgtctttggttttttaaccaagtttcacttaattagcgcaatacatcaatggctggacactcacataaaataaattaaaactctgtaattatg

SEQ ID NO: 16159 - DNA, 742 bp, Homo sapiens
  ENST00000549810
aaaggcatcaagactgcaagcaccattgccaactcttctaagaaagttcgggtcaagctgggaaacctggagctctacgtcgagcaggagtcagttccttccacatggtattttctgattgtgctccctgtcttgctagtgattgtcatttttgcggccgtgggggtgaccaggcacaaatcgaaggagctgagtcgcaaacagagtcaacaactagaattgctggaaagcgagctccggaaagagatacgtgacggctttgctgagctgcagatggataaattggatgtggttgatagttttggaactgttcccttccttgactacaaacattttgctctgagaactttcttccctgagggctctgaggagtcgtctacttaaccttttgggttgctggtcttacctatgttctcacgcctccattttctcacccactcactcagccttctccatttaccctcccaagtctttggcgaggtacactcatcctgcgtatcatcactgccatgtcctgataccccagctctgccatattgcccttcttttttgcggtatgatgaccacatagaggcccaacctcttaaacacatcaataccaatgatcacatttcaatctagacttctaagcaacggctgaaatctctccaggccaaaggagagtttgtatcaccttaccagaagcttctccggaacaattggccagaagcctagagttcagaaacccagacacatgcagtaa

SEQ ID NO: 16160 - DNA, 1894 bp, Homo sapiens
  ENST00000549217
agccaactgggatctttggttacaagtgaaggttatttgatttagctttcacttgtaaaatgacggccgtgggggtgaccaggcacaaatcgaaggagctgagtcgcaaacagagtcaacaactagaattgctggaaagcgagctccggaaagagatacgtgacggctttgctgagctgcagatggataaattggatgtggttgatagttttggaactgttcccttccttgactacaaacattttgctctgagaactttcttccctgagtcaggtggcttcacccacatcttcactgaagatatgcataacagagacgccaacgacaagaatgaaagtctcacagctttggatgccctaatctgtaataaaagctttcttgttactgtcatccacacccttgaaaagcagaagaacttttctgtgaaggacaggtgtctgtttgcctccttcctaaccattgcactgcaaaccaagctggtctacctgaccagcatcctagaggtgctgaccagggacttgatggaacagtgtagtaacatgcagccgaaactcatgctgagacgcacggagtccgtcgtcgaaaaactcctcacaaactggatgtccgtctgcctttctggatttctccgggagactgtcggagagcccttctatttgctggtgacgactctgaaccagaaaattaacaagggtcccgtggatgtaatcacttgcaaagccctgtacacacttaatgaagactggctgttgtggcaggttccggaattcagtactgtggcattaaacgtcgtctttgaaaaaatcccggaaaacgagagtgcagatgtctgtcggaatatttcagtcaatgttctcgactgtgacaccattggccaagccaaagaaaagattttccaagcattcttaagcaaaaatggctctccttatggacttcagcttaatgaaattggtcttgagcttcaaatgggcacacgacagaaagaacttctggacatcgacagttcctccgtgattcttgaagatggaatcaccaagctaaacaccattggccactatgagatatcaaatggatccactataaaagtctttaagaagatagcaaattttacttcagatgtggagtactcggatgaccactgccatttgattttaccagattcggaagcattccaagatgtgcaaggaaagagacatcgagggaagcacaagttcaaagtaaaagaaatgtatctgacaaagctgctgtcgaccaagccttcctcttcgcttctgggtaaacatcctgaagaaccctcagtttgtctttgacattaagaagacaccacatatagacggctgtttgtcagtgattgcccaggcattcatggatgcattttctctcacagagcagcaactagggaaggaagcaccaactaataagcttctctatgccaaggatatcccaacctacaaagaagaagtaaaatcttattacaaagcaatcagggatttgcctccattgtcatcctcagaaatggaagaatttttaactcaggaatctaagaaacatgaaaatgaatttaatgaagaagtggccttgacagaaatttacaaatacatcgtaaaatattttgatgaggtaagattttaaataacattgtttttaacctttgaatcaggcacaaggatgtggttatagcattctgtcagtttcagaacagctctggcatcccaaaaggccagaaagggaagccaggaagcctgtctgagatgggggatcctggcactgagccagaccctgtacatggctgccccccttacagttttatcatgctgcccacatttggaccagcctgaatttacatttgagttcatggggcctacagccaccctgactcaagttaactttgatg

SEQ ID NO: 16161 - DNA, 557 bp, Homo sapiens
  ENST00000550080
tttagctttcacttgtaaaatgagtaaggttttggtttttttctgctgcattttggcatcttcctcttcagagtgacccctcactgggaaattttcttataagatccagctttttaatgctattttctagtttcattctagctcctgctctctgtccctatctgttttgtttttgtttttgtttttaagaactgtaaagattgctatttgttttcatttttggtttttgagttaccatgtccctctgatgcagcatctctgtctcttagcggccgtgggggtgaccaggcacaaatcgaaggagctgagtcgcaaacagagtcaacaactagaattgctggaaagcgagctccggaaagagatacgtgacggctttgctgagctgcagatggataaattggatgtggttgatagttttggaactgttcccttccttgactacaaacattttgctctgagaactttcttccctgagaacagagacgccaacgacaagaatgaaagtctcacagctttggatgccctaatctgtaataaaagctttcttgttactgtca

SEQ ID NO: 16162 - DNA, 2455 bp, Homo sapiens
  ENST00000547057
acttgtaaaatgagtaaggttttggtttttttctgctgcattttggcatcttcctcttcagagtgacccctcactgggaaattttcttataagatccagctttttaatgctattttctagtttcattctagctcctgctctctgtccctatctgttttgtttttgtttttgtttttaagaactgtaaagattgctatttgttttcatttttggtttttgagttaccatgtccctctgatgcagcatctctgtctcttagcggccgtgggggtgaccaggcacaaatcgaaggagctgagtcgcaaacagagtcaacaactagaattgctggaaagcgagctccggaaagagatacgtgacggctttgctgagctgcagatggataaattggatgtggttgatagttttggaactgttcccttccttgactacaaacattttgctctgagaactttcttccctgagtcaggtggcttcacccacatcttcactgaagatatgcataacagagacgccaacgacaagaatgaaagtctcacagctttggatgccctaatctgtaataaaagctttcttgttactgtcatccacacccttgaaaagcagaagaacttttctgtgaaggacaggtgtctgtttgcctccttcctaaccattgcactgcaaaccaagctggtctacctgaccagcatcctagaggtgctgaccagggacttgatggaacagtgtagtaacatgcagccgaaactcatgctgagacgcacggagtccgtcgtcgaaaaactcctcacaaactggatgtccgtctgcctttctggatttctccgggagactgtcggagagcccttctatttgctggtgacgactctgaaccagaaaattaacaagggtcccgtggatgtaatcacttgcaaagccctgtacacacttaatgaagactggctgttgtggcaggttccggaattcagtactgtggcattaaacgtcgtctttgaaaaaatcccggaaaacgagagtgcagatgtctgtcggaatatttcagtcaatgttctcgactgtgacaccattggccaagccaaagaaaagattttccaagcattcttaagcaaaaatggctctccttatggacttcagcttaatgaaattggtcttgagcttcaaatgggcacacgacagaaagaacttctggacatcgacagttcctccgtgattcttgaagatggaatcaccaagctaaacaccattggccactatgagatatcaaatggatccactataaaagtctttaagaagatagcaaattttacttcagatgtggagtactcggatgaccactgccatttgattttaccagattcggaagcattccaagatgtgcaaggaaagagacatcgagggaagcacaagttcaaagtaaaagaaatgtatctgacaaagctgctgtcgaccaaggtggcaattcattctgtgcttgaaaaactttttagaagcatttggagtttacccaacagcagagctccatttgctataaaatacttttttgactttttggacgcccaggctgaaaacaaaaaaatcacagatcctgacgtcgtacatatttggaaaacaaacagccttcctcttcgcttctgggtaaacatcctgaagaaccctcagtttgtctttgacattaagaagacaccacatatagacggctgtttgtcagtgattgcccaggcattcatggatgcattttctctcacagagcagcaactagggaaggaagcaccaactaataagcttctctatgccaaggatatcccaacctacaaagaagaagtaaaatcttattacaaagcaatcagggatttgcctccattgtcatcctcagaaatggaagaatttttaactcaggaatctaagaaacatgaaaatgaatttaatgaagaagtggccttgacagaaatttacaaatacatcgtaaaatattttgatgagattctaaataaactagaaagagaacgagggctggaagaagctcagaaacaactcttgcatgtaaaagtcttatttgatgaaaagaagaaatgcaagtggatgtaagcactctggggcctggcttaatctggcaaagttcttcagacgacttgggagcaaaatggctgcttgagctactctgtgtcgttaatttgttgtttgcacataggttccactttgggcactgtctttttaagagaccaaggcacatgcacagcttttagaaagcataccaacccttgtgcctgtgtgtataccgtgggaacccttctgtaaatagagttgaagtggttgttgcaaacagcctccttgtttacagagaatacaaggccagtaagcgaatgtcagtattgtaactacagtctccacttaagcacaatgatataagtggttttgtttgaaaactacagctatgtagcacttgtgctacactgca

SEQ ID NO: 16163 - DNA, 564 bp, Homo sapiens
  ENST00000551495
acgttttcatttttagcccagtgactgcctgatgttcatagtgttatcatcatcactatcatctctattattattactttgaatttttattgtgggttttttttggatcatgaattcaatattgaataattcattgtcttggaaaacccattgtgggtctactttctaactttaaacttatatatgattttgtattatactatatatttttttctttttatcagaacagagacgccaacgacaagaatgaaagtctcacagctttggatgccctaatctgtaataaaagctttcttgttactgtcatccacacccttgaaaagcagaagaacttttctgtgaaggacaggtgtctgtttgcctccttcctaaccattgcactgcaaaccaagctggtctacctgaccagcatcctagaggtgctgaccagggacttgatggaacagtgtagtaacatgcagccgaaactcatgctgagacgcacggagtccgtcgtcgaaaaactcctcacaaactggatgtccgtctgcctttctggatttctccgggagactgtcggagagc

SEQ ID NO: 16164 - DNA, 1813 bp, Homo sapiens
  ENST00000545312
acagtgctgattcaagagcgtctcgagcactctgagtggtgagggggcggctcggctcgccaggaggaagtggcatccagccagtcggcgatactttcactttcagtggaataattcccgctggtgcaggggtctgatgtccctccaccaggtgctcaagggggtctgggacaccgacagccctagtcctcctgtcctaccccacagacgtttagtgggtgacagtagctccgtgaccgccaggagactgtcggagagcccttctatttgctggtgacgactctgaaccagaaaattaacaagggtcccgtggatgtaatcacttgcaaagccctgtacacacttaatgaagactggctgttgtggcaggttccggaattcagtactgtggcattaaacgtcgtctttgaaaaaatcccggaaaacgagagtgcagatgtctgtcggaatatttcagtcaatgttctcgactgtgacaccattggccaagccaaagaaaagattttccaagcattcttaagcaaaaatggctctccttatggacttcagcttaatgaaattggtcttgagcttcaaatgggcacacgacagaaagaacttctggacatcgacagttcctccgtgattcttgaagatggaatcaccaagctaaacaccattggccactatgagatatcaaatggatccactataaaagtctttaagaagatagcaaattttacttcagatgtggagtactcggatgaccactgccatttgattttaccagattcggaagcattccaagatgtgcaaggaaagagacatcgagggaagcacaagttcaaagtaaaagaaatgtatctgacaaagctgctgtcgaccaaggtggcaattcattctgtgcttgaaaaactttttagaagcatttggagtttacccaacagcagagctccatttgctataaaatacttttttgactttttggacgcccaggctgaaaacaaaaaaatcacagatcctgacgtcgtacatatttggaaaacaaacagccttcctcttcgcttctgggtaaacatcctgaagaaccctcagtttgtctttgacattaagaagacaccacatatagacggctgtttgtcagtgattgcccaggcattcatggatgcattttctctcacagagcagcaactagggaaggaagcaccaactaataagcttctctatgccaaggatatcccaacctacaaagaagaagtaaaatcttattacaaagcaatcagggatttgcctccattgtcatcctcagaaatggaagaatttttaactcaggaatctaagaaacatgaaaatgaatttaatgaagaagtggccttgacagaaatttacaaatacatcgtaaaatattttgatgagattctaaataaactagaaagagaacgagggctggaagaagctcagaaacaactcttgcatgtaaaagtcttatttgatgaaaagaagaaatgcaagtggatgtaagcactctggggcctggcttaatctggcaaagttcttcagacgacttgggagcaaaatggctgcttgagctactctgtgtcgttaatttgttgtttgcacataggttccactttgggcactgtctttttaagagaccaaggcacatgcacagcttttagaaagcataccaacccttgtgcctgtgtgtataccgtgggaacccttctgtaaatagagttgaagtggttgttgcaaacagcctccttgtttacagagaatacaaggccagtaagcgaatgtcagtattgtaactacagtctccacttaagcacaa

SEQ ID NO: 16165 - DNA, 610 bp, Homo sapiens
  ENST00000549187
ttaacaagggtcccgtggatgtaatcacttgcaaagccctgtacacacttaatgaagactggctgttgtggcaggttccggaattcagtactgtggcattaaacgtcgtctttgaaaaaatcccggaaaacgagagtgcagatgtctgtcggaatatttcagtcaatgttctcgactgtgacaccattggccaagccaaagaaaagattttccaagcattcttaagcaaaaatggctctccttatggacttcagcttaatgaaattggtcttggtaaggcggtgcgggagctatgtggtcccaggccctgatgagtgtccctccctgcctgccctccctccctgtcccccctccctgcccccaccagcttccattcagtgacacttacacagccaggttgttcctggagggcatgtctaggggccaagagactgctttggtctctcatgggcatcctgattcttcgaaggaagcacggtccttcaaagatggcgtttgttgttgttgtctttaaatattacgtctgtaaatcagattgatgagattgcaggccctgagactgcacggaatcaccttgcatcatgaaatacagaaaggtgtcaacacagtg

SEQ ID NO: 16166 - DNA, 2127 bp, Homo sapiens
  ENST00000449260
ggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctgtgcctgggattcttctcacaggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctgagtactctcatatgatgctgtgattttcctggagttgacagaaacacctatatttcccccagtcttccctgggagactactattaactgaaataaatactcagagcctga

SEQ ID NO: 16167 - DNA, 2516 bp, Homo sapiens
  ENST00000552882
gggggctagacaagtttcttccccggtggggcggctgaacactcttcccaagtacctgctttgggtccaagtttcctacctatgtctctagtctgtagggatttcttgatttctaactcactattttcaccaatcctggggaaaatatgtatcgacctaaggttaaattccacctggcccaggagcctcctttggaaaccaggaagccgggaatctcgttgcaaaggaatcctgggcctcagaggagtcgttgcctctgcctcatagcataccccgacactgtctctgttttgggatgcagggttctgtttctgtctttttgagaagttcctggtttaattcactctcccatgataaactgttgtgtctggggcctatcccagtccccccagtgcctttggttgctggagggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctgagtactctcatatgatgctgtgattttcctggagttgacagaaacacctatatttcccccagtcttccctgggagactactattaactgaaataaatactcagagcctga

SEQ ID NO: 16168 - DNA, 1867 bp, Homo sapiens
  ENST00000550464
agtgcctttggttgctggagggaagaacacaatggatctggtgctaaaaagatgccttcttcatttggctgtgataggtgctttgctggctgtgggggctacaaaagggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctgagtactctcatatgatgctgtgattttcctggagttgacagaaacacctatatttcccccagtcttccctgggagactactattaactgaaataaatactcagagcctg

SEQ ID NO: 16169 - DNA, 2757 bp, Homo sapiens
  ENST00000548747
agtttggttcttgggggctagacaagtttcttccccggtggggcggctgaacactcttcccaagtacctgctttgggtccaagtttcctacctatgtctctagtctgtagggatttcttgatttctaactcactattttcaccaatcctggggaaaatatgtatcgacctaaggttaaattccacctggcccaggagcctcctttggaaaccaggaagccgggaatctcgttgcaaaggaatcctgggcctcagaggagtcgttgcctctgcctcatagcataccccgacactgtctctgttttgggatgcagggttctgtttctgtctttttgagaagttcctggtttaattcactctcccatgataaactgttgtgtctggtatgtgttacgcagctgcctttcagttagctcttgcccgggagtgcatcaagatgagagtgacccagtgaaaccagaaactgtcattgagtagcaggatgggaaagcaatgtctagggaccaggatccctttgtcagtttttcctttttcctctcctccggcccctcccaggccttctctgagggagaagaggaagggctatgcaaatgagcacccttttcttatataggggcctatcccagtccccccagtgcctttggttgctggagggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctgagtactctcatatgatgctgtgattttcctggagttgacagaaacacctatatttcccccagtcttccctgggagactactattaactgaaataaatactcagagcctg

SEQ ID NO: 16170 - DNA, 2204 bp, Homo sapiens
  ENST00000548493
tcaacgtcagagccggggggcgagcccagcgctcctccccgcaaatgatcccgccccaggggcctatcccagtccccccagtgcctttggttgctggagggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctgagtactctcatatgatgctgtgattttcctggagttgacagaaacacctatatttcccccagtcttccctgggagactactattaactgaaataaatactcagagcctg

SEQ ID NO: 16171 - DNA, 901 bp, Homo sapiens
  ENST00000550447
gagggaagaacacaatggatctggtgctaaaaagatgccttcttcatttggctgtgataggtgctttgctggctgtgggggctacaaaaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctgggagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctgagtactctcatatga

SEQ ID NO: 16172 - DNA, 503 bp, Homo sapiens
  ENST00000549564
aacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacagggtggctcggggacatactgcctcaatgtgtctctggctgataccaacagcctggcagtggtcagcacccagcttatcatgcctgtgcctgggattcttctcacaggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctacccc

SEQ ID NO: 16173 - DNA, 1355 bp, Homo sapiens
  ENST00000549404
ccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctgtgcctgggattcttctcacaggtcaagaagcaggccttgggcaggttccgctgatcg

SEQ ID NO: 16174 - DNA, 505 bp, Homo sapiens
  ENST00000550762
gaaacagtgatgcttaaatgagttaacacacgttgaatgtctagcctaggacctgacatagtgtggggtgtgataaacatttgaggattttttaaaactccaatgccacccctaactgtgactctggaggagtcattttcttcttctgggcctcagtttccttatctatagaataaggtttcccaggtcttatctgattccaagcctgtgactccagaatccagtaactctggttcaacctgaaaaaatgcctgcttggcctctgcctccagatgagtcatctgtctcttgatcttgcctccttgatcctctcctgccaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgact

SEQ ID NO: 16175 - DNA, 895 bp, Homo sapiens
  ENST00000548803
gaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctgggttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctg

SEQ ID NO: 16176 - DNA, 1047 bp, Homo sapiens
  ENST00000547137
ggagggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctgggaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctaca

SEQ ID NO: 16177 - DNA, 912 bp, Homo sapiens
  ENST00000546543
ggagggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagagggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaacc

SEQ ID NO: 16178 - DNA, 754 bp, Homo sapiens
  ENST00000556802
caattttaggggttttgatatacaaaaaagaatgccagggtttgagagtgactctgtatttatctttcagggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcagg

SEQ ID NO: 16179 - DNA, 576 bp, Homo sapiens
  ENST00000548689
agcgctcctccccgcaaatgatcccgccccagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagcctt

SEQ ID NO: 16180 - DNA, 801 bp, Homo sapiens
  ENST00000550590
agtgcctttggttgctggagggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggtgagggactcccttctcagcctatcatccacacttgtgtttacttctttctacctgatcacctttcttttggccgccccttccaccttaacttctgtgattttctctaatcttcattttcctcttagatcttttctctttcttagcacctagcccccttcaactctatcataattctttctggcaactcttcctcaattgtagtcctaccccatggaatgcctcattaggaccccttccctgtccccccatatcacagccttccaaacaccctcagaagtaatcatacttcctgacctcc

SEQ ID NO: 16181 - DNA, 646 bp, Homo sapiens
  ENST00000549430
agcgctcctccccgcaaatgatcccgccccagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggtgagggactcccttctcagcctatcatccacacttgtgtttacttctttctacctgatcacctttcttttggccgccccttccaccttaacttctgtgattttctctaatcttcattttcctcttagatcttttctctttcttagcacctagcccccttcaactctatcataattctttctggcaactcttcctcaattgtagtcctaccccatggaatg

SEQ ID NO: 16182 - DNA, 568 bp, Homo sapiens
  ENST00000549418
aagtttggttcttgggggctagacaagtttcttccccggtggggcggctgaacactcttcccaagggcctatcccagtccccccagtgcctttggttgctggagggaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttat

SEQ ID NO: 16183 - DNA, 573 bp, Homo sapiens
  ENST00000549233
ggaaaacttttctgtctgtgatatgaaacagaaaggaaaaacggcgggcttactgggaaatgcagtgtcgaaagagttggctggccaagactagaagagtccgaaagatccggaagagctggtcaatctcagaatctccagggaatagggcccggcgagtcacctgaaaatggggaaagaggaaataccaagacccacgttgacgtcagtcaaaactctcctctatacaaaggagttcccacagacagtaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatctt

SEQ ID NO: 16184 - DNA, 461 bp, Homo sapiens
  ENST00000549413
gaagaacacaatggatctggtgctaaaaagatgccttcttcatttggctgtgataggtgctttgctggctgtgggggctacaaaagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatggtgagtacttctctattctaggtccttattcctagggctcaggttccctggtatgcccagtgagctcagggaatgccccttccttctctacttttttttttttttcttttttgagac

SEQ ID NO: 16185 - DNA, 4845 bp, Homo sapiens
  ENST00000341744
ggaaagctagcggcagaggctcagccccggcggcagcgcgcgccccgctgccagcccattttccggacgccacccgcgggcactgccgacgcccccggggctgccgaggggaggccgggggggcgcagcggagcgcggtcccgcgcactgagccccgcggcgccccgggaacttggcggcgacccgagcccggcgagccggggcgcgcctcccccgccgcgcgcctcctgcatgcggggccccagctccgggcgccggccggagccccccccggccgcccccgagccccccgcgccccgcgccgcgccgccgcgccgtccatgcaccgcttgatgggggtcaacagcaccgccgccgccgccgccgggcagcccaatgtctcctgcacgtgcaactgcaaacgctctttgttccagagcatggagatcacggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccacccaccatctcgctgtcagacggggaggagcccccaccctaccagggcccctgcaccctccagcttcgggaccccgagcagcagctggaactgaaccgggagtcggtgcgcgcacccccaaacagaaccatcttcgacagtgacctgatggatagtgccaggctgggcggcccctgcccccccagcagtaactcgggcatcagcgccacgtgctacggcagcggcgggcgcatggaggggccgccgcccacctacagcgaggtcatcggccactacccggggtcctccttccagcaccagcagagcagtgggccgccctccttgctggaggggacccggctccaccacacacacatcgcgcccctagagagcgcagccatctggagcaaagagaaggataaacagaaaggacaccctctctagggtccccaggggggccgggctggggctgcgtaggtgaaaaggcagaacactccgcgcttcttagaagaggagtgagaggaaggcggggggcgcagcaacgcatcgtgtggccctcccctcccacctccctgtgtataaatatttacatgtgatgtctggtctgaatgcacaagctaagagagcttgcaaaaaaaaaaagaaaaaagaaaaaaaaaaaccacgtttctttgttgagctgtgtcttgaaggcaaaagaaaaaaaatttctacagtagtctttcttgtttctagttgagctgcgtgcgtgaatgcttattttcttttgtttatgataatttcacttaactttaaagacatatttgcacaaaacctttgtttaaagatctgcaatattatatatataaatatatataagataagagaaactgtatgtgcgagggcaggagtatttttgtattagaagaggcctattaaaaaaaaaagttgttttctgaactagaagaggaaaaaaatggcaatttttgagtgccaagtcagaaagtgtgtattaccttgtaaagaaaaaaattacaaagcaggggtttagagttatttatataaatgttgagattttgcactattttttaatataaatatgtcagtgcttgcttgatggaaacttctcttgtgtctgttgagactttaagggagaaatgtcggaatttcagagtcgcctgacggcagagggtgagcccccgtggagtctgcagagaggccttggccaggagcggcgggctttcccgaggggccactgtccctgcagagtggatgcttctgcctagtgacaggttatcaccacgttatatattccctaccgaaggagacaccttttcccccctgacccagaacagcctttaaatcacaagcaaaataggaaagttaaccacggaggcaccgagttccaggtagtggttttgcctttcccaaaaatgaaaataaactgttaccgaaggaattagtttttcctcttcttttttccaactgtgaaggtccccgtggggtggagcatggtgcccctcacaagccgcagcggctggtgcccgggctaccagggacatgccagagggctcgatgacttgtctctgcagggcgctttggtggttgttcagctggctaaaggttcaccggtgaaggcaggtgcggtaactgccgcactggaccctaggaagccccaggtattcgcaatctgacctcctcctgtctgtttcccttcacggatcaattctcacttaagaggccaataaacaacccaacatgaaaaggtgacaagcctgggtttctcccaggataggtgaaagggttaaaatgagtaaagcagttgagcaaacaccaacccgagcttcgggcgcagaattcttcaccttctcttcccctttccatctcctttccccgcggaaacaacgcttcccttctggtgtgtctgttgatctgtgttttcatttacatctctcttagactccgctcttgttctccaggttttcaccagatagatttggggttggcgggacctgctggtgacgtgcaggtgaaggacaggaaggggcatgtgagcgtaaatagaggtgaccagaggagagcatgaggggtggggctttgggacccaccggggccagtggctggagcttgacgtctttcctccccatgggggtgggagggcccccagctggaagagcagactcccagctgctaccccctcccttcccatgggagtggctttccattttgggcagaatgctgactagtagactaacataaaagatataaaaggcaataactattgtttgtgagcaacttttttataacttccaaaacaaaaacctgagcacagttttgaagttctagccactcgagctcatgcatgtgaaacgtgtgctttacgaaggtggcagctgacagacgtgggctctgcatgccgccagcctagtagaaagttctcgttcattggcaacagcagaacctgcctctccgtgaagtcgtcagcctaaaatttgtttctctcttgaagaggattctttgaaaaggtcctgcagagaaatcagtacaggttatcccgaaaggtacaaggacgcacttgtaaagatgattaaaacgtatctttcctttatgtgacgcgtctctagtgccttactgaagaagcagtgacactcccgtcgctcggtgaggacgttcccggacagtgcctcactcacctgggactggtatcccctcccagggtccaccaagggctcctgcttttcagacaccccatcatcctcgcgcgtcctcaccctgtctctaccagggaggtgcctagcttggtgaggttactcctgctcctccaacctttttttgccaaggtttgtacacgactcccatctaggctgaaaacctagaagtggaccttgtgtgtgtgcatggtgtcagcccaaagccaggctgagacagtcctcatatcctcttgagccaaactgtttgggtctcgttgcttcatggtatggtctggatttgtgggaatggctttgcgtgagaaaggggaggagagtggttgctgccctcagccggcttgaggacagagcctgtccctctcatgacaactcagtgttgaagcccagtgtcctcagcttcatgtccagtggatggcagaagttcatggggtagtggcctctcaaaggctgggcgcatcccaagacagccagcaggttgtctctggaaacgaccagagttaagctctcggcttctctgctgagggtgcaccctttcctctagatggtagttgtcacgttatctttgaaaactcttggactgctcctgaggaggccctcttttccagtaggaagttagatgggggttctcagaagtggctgattggaaggggacaagcttcgtttcaggggtctgccgttccatcctggttcagagaaggccgagcgtggctttctctagccttgtcactgtctccctgcctgtcaatcaccacctttcctccagaggaggaaaattatctcccctgcaaagcccggttctacacagatttcacaaattgtgctaagaaccgtccgtgttctcagaaagcccagtgtttttgcaaagaatgaaaagggaccccatatgtagcaaaaatcagggctgggggagagccgggttcattccctgtcctcattggtcgtccctatgaattgtacgtttcagagaaattttttttcctatgtgcaacacgaagcttccagaaccataaaatatcccgtcgataaggaaagaaaatgtcgttgttgttgtttttctggaaactgcttgaaatcttgctgtactatagagctcagaaggacacagcccgtcctcccctgcctgcctgattccatggctgttgtgctgattccaatgctttcacgttggttcctggcgtgggaactgctctcctttgcagccccatttcccaagctctgttcaagttaaacttatgtaagctttccgtggcatgcggggcgcgcacccacgtccccgctgcgtaagactctgtatttggatgccaatccacaggcctgaagaaactgcttgttgtgtatcagtaatcattagtggcaatgatgacattctgaaaagctgcaatacttatacaataaattttacaattctttggaatgag

SEQ ID NO: 16186 - DNA, 4519 bp, Homo sapiens
  ENST00000395816
tggtcgtcctccttgggttcgggtgaaagcgcttgggggttcagtgggccatgatccccgagctgctggagaactgaaggcggacagtctcctgcgaaaccagcggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccacccaccatctcgctgtcagacggggaggagcccccaccctaccagggcccctgcaccctccagcttcgggaccccgagcagcagctggaactgaaccgggagtcggtgcgcgcacccccaaacagaaccatcttcgacagtgacctgatggatagtgccaggctgggcggcccctgcccccccagcagtaactcgggcatcagcgccacgtgctacggcagcggcgggcgcatggaggggccgccgcccacctacagcgaggtcatcggccactacccggggtcctccttccagcaccagcagagcagtgggccgccctccttgctggaggggacccggctccaccacacacacatcgcgcccctagagagcgcagccatctggagcaaagagaaggataaacagaaaggacaccctctctagggtccccaggggggccgggctggggctgcgtaggtgaaaaggcagaacactccgcgcttcttagaagaggagtgagaggaaggcggggggcgcagcaacgcatcgtgtggccctcccctcccacctccctgtgtataaatatttacatgtgatgtctggtctgaatgcacaagctaagagagcttgcaaaaaaaaaaagaaaaaagaaaaaaaaaaaccacgtttctttgttgagctgtgtcttgaaggcaaaagaaaaaaaatttctacagtagtctttcttgtttctagttgagctgcgtgcgtgaatgcttattttcttttgtttatgataatttcacttaactttaaagacatatttgcacaaaacctttgtttaaagatctgcaatattatatatataaatatatataagataagagaaactgtatgtgcgagggcaggagtatttttgtattagaagaggcctattaaaaaaaaaagttgttttctgaactagaagaggaaaaaaatggcaatttttgagtgccaagtcagaaagtgtgtattaccttgtaaagaaaaaaattacaaagcaggggtttagagttatttatataaatgttgagattttgcactattttttaatataaatatgtcagtgcttgcttgatggaaacttctcttgtgtctgttgagactttaagggagaaatgtcggaatttcagagtcgcctgacggcagagggtgagcccccgtggagtctgcagagaggccttggccaggagcggcgggctttcccgaggggccactgtccctgcagagtggatgcttctgcctagtgacaggttatcaccacgttatatattccctaccgaaggagacaccttttcccccctgacccagaacagcctttaaatcacaagcaaaataggaaagttaaccacggaggcaccgagttccaggtagtggttttgcctttcccaaaaatgaaaataaactgttaccgaaggaattagtttttcctcttcttttttccaactgtgaaggtccccgtggggtggagcatggtgcccctcacaagccgcagcggctggtgcccgggctaccagggacatgccagagggctcgatgacttgtctctgcagggcgctttggtggttgttcagctggctaaaggttcaccggtgaaggcaggtgcggtaactgccgcactggaccctaggaagccccaggtattcgcaatctgacctcctcctgtctgtttcccttcacggatcaattctcacttaagaggccaataaacaacccaacatgaaaaggtgacaagcctgggtttctcccaggataggtgaaagggttaaaatgagtaaagcagttgagcaaacaccaacccgagcttcgggcgcagaattcttcaccttctcttcccctttccatctcctttccccgcggaaacaacgcttcccttctggtgtgtctgttgatctgtgttttcatttacatctctcttagactccgctcttgttctccaggttttcaccagatagatttggggttggcgggacctgctggtgacgtgcaggtgaaggacaggaaggggcatgtgagcgtaaatagaggtgaccagaggagagcatgaggggtggggctttgggacccaccggggccagtggctggagcttgacgtctttcctccccatgggggtgggagggcccccagctggaagagcagactcccagctgctaccccctcccttcccatgggagtggctttccattttgggcagaatgctgactagtagactaacataaaagatataaaaggcaataactattgtttgtgagcaacttttttataacttccaaaacaaaaacctgagcacagttttgaagttctagccactcgagctcatgcatgtgaaacgtgtgctttacgaaggtggcagctgacagacgtgggctctgcatgccgccagcctagtagaaagttctcgttcattggcaacagcagaacctgcctctccgtgaagtcgtcagcctaaaatttgtttctctcttgaagaggattctttgaaaaggtcctgcagagaaatcagtacaggttatcccgaaaggtacaaggacgcacttgtaaagatgattaaaacgtatctttcctttatgtgacgcgtctctagtgccttactgaagaagcagtgacactcccgtcgctcggtgaggacgttcccggacagtgcctcactcacctgggactggtatcccctcccagggtccaccaagggctcctgcttttcagacaccccatcatcctcgcgcgtcctcaccctgtctctaccagggaggtgcctagcttggtgaggttactcctgctcctccaacctttttttgccaaggtttgtacacgactcccatctaggctgaaaacctagaagtggaccttgtgtgtgtgcatggtgtcagcccaaagccaggctgagacagtcctcatatcctcttgagccaaactgtttgggtctcgttgcttcatggtatggtctggatttgtgggaatggctttgcgtgagaaaggggaggagagtggttgctgccctcagccggcttgaggacagagcctgtccctctcatgacaactcagtgttgaagcccagtgtcctcagcttcatgtccagtggatggcagaagttcatggggtagtggcctctcaaaggctgggcgcatcccaagacagccagcaggttgtctctggaaacgaccagagttaagctctcggcttctctgctgagggtgcaccctttcctctagatggtagttgtcacgttatctttgaaaactcttggactgctcctgaggaggccctcttttccagtaggaagttagatgggggttctcagaagtggctgattggaaggggacaagcttcgtttcaggggtctgccgttccatcctggttcagagaaggccgagcgtggctttctctagccttgtcactgtctccctgcctgtcaatcaccacctttcctccagaggaggaaaattatctcccctgcaaagcccggttctacacagatttcacaaattgtgctaagaaccgtccgtgttctcagaaagcccagtgtttttgcaaagaatgaaaagggaccccatatgtagcaaaaatcagggctgggggagagccgggttcattccctgtcctcattggtcgtccctatgaattgtacgtttcagagaaattttttttcctatgtgcaacacgaagcttccagaaccataaaatatcccgtcgataaggaaagaaaatgtcgttgttgttgtttttctggaaactgcttgaaatcttgctgtactatagagctcagaaggacacagcccgtcctcccctgcctgcctgattccatggctgttgtgctgattccaatgctttcacgttggttcctggcgtgggaactgctctcctttgcagccccatttcccaagctctgttcaagttaaacttatgtaagctttccgtggcatgcggggcgcgcacccacgtccccgctgcgtaagactctgtatttggatgccaatccacaggcctgaagaaactgcttgttgtgtatcagtaatcattagtggcaatgatgacattctgaaaagctgcaatacttatacaataaattttacaattctttggaatgag

SEQ ID NO: 16187 - DNA, 4546 bp, Homo sapiens
  ENST00000347215
acgcgagttcccgtctttcctggtcgtcctccttgggttcgggtgaaagcgcttgggggttcagtgggccatgatccccgagctgctggagaactgaaggcggacagtctcctgcgaaaccaggcaatggcggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccacccaccatctcgctgtcagacggggaggagcccccaccctaccagggcccctgcaccctccagcttcgggaccccgagcagcagctggaactgaaccgggagtcggtgcgcgcacccccaaacagaaccatcttcgacagtgacctgatggatagtgccaggctgggcggcccctgcccccccagcagtaactcgggcatcagcgccacgtgctacggcagcggcgggcgcatggaggggccgccgcccacctacagcgaggtcatcggccactacccggggtcctccttccagcaccagcagagcagtgggccgccctccttgctggaggggacccggctccaccacacacacatcgcgcccctagagagcgcagccatctggagcaaagagaaggataaacagaaaggacaccctctctagggtccccaggggggccgggctggggctgcgtaggtgaaaaggcagaacactccgcgcttcttagaagaggagtgagaggaaggcggggggcgcagcaacgcatcgtgtggccctcccctcccacctccctgtgtataaatatttacatgtgatgtctggtctgaatgcacaagctaagagagcttgcaaaaaaaaaaagaaaaaagaaaaaaaaaaaccacgtttctttgttgagctgtgtcttgaaggcaaaagaaaaaaaatttctacagtagtctttcttgtttctagttgagctgcgtgcgtgaatgcttattttcttttgtttatgataatttcacttaactttaaagacatatttgcacaaaacctttgtttaaagatctgcaatattatatatataaatatatataagataagagaaactgtatgtgcgagggcaggagtatttttgtattagaagaggcctattaaaaaaaaaagttgttttctgaactagaagaggaaaaaaatggcaatttttgagtgccaagtcagaaagtgtgtattaccttgtaaagaaaaaaattacaaagcaggggtttagagttatttatataaatgttgagattttgcactattttttaatataaatatgtcagtgcttgcttgatggaaacttctcttgtgtctgttgagactttaagggagaaatgtcggaatttcagagtcgcctgacggcagagggtgagcccccgtggagtctgcagagaggccttggccaggagcggcgggctttcccgaggggccactgtccctgcagagtggatgcttctgcctagtgacaggttatcaccacgttatatattccctaccgaaggagacaccttttcccccctgacccagaacagcctttaaatcacaagcaaaataggaaagttaaccacggaggcaccgagttccaggtagtggttttgcctttcccaaaaatgaaaataaactgttaccgaaggaattagtttttcctcttcttttttccaactgtgaaggtccccgtggggtggagcatggtgcccctcacaagccgcagcggctggtgcccgggctaccagggacatgccagagggctcgatgacttgtctctgcagggcgctttggtggttgttcagctggctaaaggttcaccggtgaaggcaggtgcggtaactgccgcactggaccctaggaagccccaggtattcgcaatctgacctcctcctgtctgtttcccttcacggatcaattctcacttaagaggccaataaacaacccaacatgaaaaggtgacaagcctgggtttctcccaggataggtgaaagggttaaaatgagtaaagcagttgagcaaacaccaacccgagcttcgggcgcagaattcttcaccttctcttcccctttccatctcctttccccgcggaaacaacgcttcccttctggtgtgtctgttgatctgtgttttcatttacatctctcttagactccgctcttgttctccaggttttcaccagatagatttggggttggcgggacctgctggtgacgtgcaggtgaaggacaggaaggggcatgtgagcgtaaatagaggtgaccagaggagagcatgaggggtggggctttgggacccaccggggccagtggctggagcttgacgtctttcctccccatgggggtgggagggcccccagctggaagagcagactcccagctgctaccccctcccttcccatgggagtggctttccattttgggcagaatgctgactagtagactaacataaaagatataaaaggcaataactattgtttgtgagcaacttttttataacttccaaaacaaaaacctgagcacagttttgaagttctagccactcgagctcatgcatgtgaaacgtgtgctttacgaaggtggcagctgacagacgtgggctctgcatgccgccagcctagtagaaagttctcgttcattggcaacagcagaacctgcctctccgtgaagtcgtcagcctaaaatttgtttctctcttgaagaggattctttgaaaaggtcctgcagagaaatcagtacaggttatcccgaaaggtacaaggacgcacttgtaaagatgattaaaacgtatctttcctttatgtgacgcgtctctagtgccttactgaagaagcagtgacactcccgtcgctcggtgaggacgttcccggacagtgcctcactcacctgggactggtatcccctcccagggtccaccaagggctcctgcttttcagacaccccatcatcctcgcgcgtcctcaccctgtctctaccagggaggtgcctagcttggtgaggttactcctgctcctccaacctttttttgccaaggtttgtacacgactcccatctaggctgaaaacctagaagtggaccttgtgtgtgtgcatggtgtcagcccaaagccaggctgagacagtcctcatatcctcttgagccaaactgtttgggtctcgttgcttcatggtatggtctggatttgtgggaatggctttgcgtgagaaaggggaggagagtggttgctgccctcagccggcttgaggacagagcctgtccctctcatgacaactcagtgttgaagcccagtgtcctcagcttcatgtccagtggatggcagaagttcatggggtagtggcctctcaaaggctgggcgcatcccaagacagccagcaggttgtctctggaaacgaccagagttaagctctcggcttctctgctgagggtgcaccctttcctctagatggtagttgtcacgttatctttgaaaactcttggactgctcctgaggaggccctcttttccagtaggaagttagatgggggttctcagaagtggctgattggaaggggacaagcttcgtttcaggggtctgccgttccatcctggttcagagaaggccgagcgtggctttctctagccttgtcactgtctccctgcctgtcaatcaccacctttcctccagaggaggaaaattatctcccctgcaaagcccggttctacacagatttcacaaattgtgctaagaaccgtccgtgttctcagaaagcccagtgtttttgcaaagaatgaaaagggaccccatatgtagcaaaaatcagggctgggggagagccgggttcattccctgtcctcattggtcgtccctatgaattgtacgtttcagagaaattttttttcctatgtgcaacacgaagcttccagaaccataaaatatcccgtcgataaggaaagaaaatgtcgttgttgttgtttttctggaaactgcttgaaatcttgctgtactatagagctcagaaggacacagcccgtcctcccctgcctgcctgattccatggctgttgtgctgattccaatgctttcacgttggttcctggcgtgggaactgctctcctttgcagccccatttcccaagctctgttcaagttaaacttatgtaagctttccgtggcatgcggggcgcgcacccacgtccccgctgcgtaagactctgtatttggatgccaatccacaggcctgaagaaactgcttgttgtgtatcagtaatcattagtggcaatgatgacattctgaaaagctgcaatacttatacaataaattttacaattctttggaatgag

SEQ ID NO: 16188 - DNA, 800 bp, Homo sapiens
  ENST00000395814
ttggaacgagggctgcgggcaccagtgagcggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccacccaccatctcgctgtcagacggggaggagcccccaccctaccagggcccctgcaccctccagcttcgggaccccgagcagcagctggaactgaaccgggagtcggtgcgcgcacccccaaacagaaccatcttcgacagtgacctgatggatagtgccaggctgggcggcccctgcccccccagcagtaactcgggcatcagcgccacgtgctacggcagcggcgggcgcatggaggggccgccgcccacctacagcgaggtcatcggccactacccggggtcctccttccagcaccagcagagcagtgggccgccctccttgctggaggggacccggctccaccacacacacatcgcgcccctagagagcgcagccatctggagcaaagagaaggataaacagaaaggacaccctctctagggtccccaggggggcc

SEQ ID NO: 16189 - DNA, 831 bp, Homo sapiens
  ENST00000414037
ctctccaggcccctgccacctgtttgcacatgaccctctacacccgccatagcaatggagaccccgcctcctgctacagttaattaatccttcttttttgcttcacaataaaaatagcatggctcttctgattgtaaaaagtgatatacactccttatttaacgaaaaattcaaagaatttgataaatgacaggcgaaaagtcaaaatgcctgcaattccagcacatggagcggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccacccaccatctcgctgtcagacggggaggagcccccaccctaccagggcccctgcaccctccagcttcgggaccccgagcagcagctggaactgaaccgggagtcggtgcgcgcacccccaaacagaaccatcttcgacagtgacctgatggatagtgccaggctgggcggcccctgcccccccagcagtaactcgggcatcagcgccacgtgctacggcagcggcgggcgcatggaggggccgccgcccacctacagcgaggtcatcg

SEQ ID NO: 16190 - DNA, 859 bp, Homo sapiens
  ENST00000395819
gcgcactgagccccgcggcgccccgggaacttggcggcgacccgagcccggcgagccggggcgcgcctcccccgccgcgcgcctcctgcatgcggggccccagctccgggcgccggccggagccccccccggccgcccccgagccccccgcgccccgcgccgcgccgccgcgccgtccatgcaccgcttgatgggggtcaacagcaccgccgccgccgccgccgggcagcccaatgtctcctgcacgtgcaactgcaaacgctctttgttccagagcatggagatcagttgtcatggattcccagtatgcaagtcgcatcagcatcaggagtggaagagtctctgctggtccttaaggtctccaggaggggccagttccatcactggctttgggagcatgaaagtgacaaatccagccatgaatttgcctgagtgtcagtggttaagaatacaaaaagcggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccacccaccatctcgctgtcagacggggaggagcccccaccctaccagggcccctgcaccctccagcttcgg

SEQ ID NO: 16191 - DNA, 361 bp, Homo sapiens
  ENST00000472841
ctgaacctccctctgggctgggcacgcttggactcctccaaagagcttggaccagcctgagccacatccctgggcttgacttctccagaacaagcctcctggtctttctgggagagctctggcagcatcactgtgcctgtgcagggagagcgggaacccacttcctgcaccggctttctctgagttcttcaggatgaattcgctctggtctagcggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccct

SEQ ID NO: 16192 - DNA, 4627 bp, Homo sapiens
  ENST00000265626
ctgaacctccctctgggctgggcacgcttggactcctccaaagagcttggaccagcctgagccacatccctgggcttgacttctccagaacaagcctcctggtctttctgggagagctctggcagcatcactgtgcctgtgcagggagagcgggaacccacttcctgcaccggctttctctgagttcttcaggatgaattcgctctggtctagcggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccacccaccatctcgctgtcagacggggaggagcccccaccctaccagggcccctgcaccctccagcttcgggaccccgagcagcagctggaactgaaccgggagtcggtgcgcgcacccccaaacagaaccatcttcgacagtgacctgatggatagtgccaggctgggcggcccctgcccccccagcagtaactcgggcatcagcgccacgtgctacggcagcggcgggcgcatggaggggccgccgcccacctacagcgaggtcatcggccactacccggggtcctccttccagcaccagcagagcagtgggccgccctccttgctggaggggacccggctccaccacacacacatcgcgcccctagagagcgcagccatctggagcaaagagaaggataaacagaaaggacaccctctctagggtccccaggggggccgggctggggctgcgtaggtgaaaaggcagaacactccgcgcttcttagaagaggagtgagaggaaggcggggggcgcagcaacgcatcgtgtggccctcccctcccacctccctgtgtataaatatttacatgtgatgtctggtctgaatgcacaagctaagagagcttgcaaaaaaaaaaagaaaaaagaaaaaaaaaaaccacgtttctttgttgagctgtgtcttgaaggcaaaagaaaaaaaatttctacagtagtctttcttgtttctagttgagctgcgtgcgtgaatgcttattttcttttgtttatgataatttcacttaactttaaagacatatttgcacaaaacctttgtttaaagatctgcaatattatatatataaatatatataagataagagaaactgtatgtgcgagggcaggagtatttttgtattagaagaggcctattaaaaaaaaaagttgttttctgaactagaagaggaaaaaaatggcaatttttgagtgccaagtcagaaagtgtgtattaccttgtaaagaaaaaaattacaaagcaggggtttagagttatttatataaatgttgagattttgcactattttttaatataaatatgtcagtgcttgcttgatggaaacttctcttgtgtctgttgagactttaagggagaaatgtcggaatttcagagtcgcctgacggcagagggtgagcccccgtggagtctgcagagaggccttggccaggagcggcgggctttcccgaggggccactgtccctgcagagtggatgcttctgcctagtgacaggttatcaccacgttatatattccctaccgaaggagacaccttttcccccctgacccagaacagcctttaaatcacaagcaaaataggaaagttaaccacggaggcaccgagttccaggtagtggttttgcctttcccaaaaatgaaaataaactgttaccgaaggaattagtttttcctcttcttttttccaactgtgaaggtccccgtggggtggagcatggtgcccctcacaagccgcagcggctggtgcccgggctaccagggacatgccagagggctcgatgacttgtctctgcagggcgctttggtggttgttcagctggctaaaggttcaccggtgaaggcaggtgcggtaactgccgcactggaccctaggaagccccaggtattcgcaatctgacctcctcctgtctgtttcccttcacggatcaattctcacttaagaggccaataaacaacccaacatgaaaaggtgacaagcctgggtttctcccaggataggtgaaagggttaaaatgagtaaagcagttgagcaaacaccaacccgagcttcgggcgcagaattcttcaccttctcttcccctttccatctcctttccccgcggaaacaacgcttcccttctggtgtgtctgttgatctgtgttttcatttacatctctcttagactccgctcttgttctccaggttttcaccagatagatttggggttggcgggacctgctggtgacgtgcaggtgaaggacaggaaggggcatgtgagcgtaaatagaggtgaccagaggagagcatgaggggtggggctttgggacccaccggggccagtggctggagcttgacgtctttcctccccatgggggtgggagggcccccagctggaagagcagactcccagctgctaccccctcccttcccatgggagtggctttccattttgggcagaatgctgactagtagactaacataaaagatataaaaggcaataactattgtttgtgagcaacttttttataacttccaaaacaaaaacctgagcacagttttgaagttctagccactcgagctcatgcatgtgaaacgtgtgctttacgaaggtggcagctgacagacgtgggctctgcatgccgccagcctagtagaaagttctcgttcattggcaacagcagaacctgcctctccgtgaagtcgtcagcctaaaatttgtttctctcttgaagaggattctttgaaaaggtcctgcagagaaatcagtacaggttatcccgaaaggtacaaggacgcacttgtaaagatgattaaaacgtatctttcctttatgtgacgcgtctctagtgccttactgaagaagcagtgacactcccgtcgctcggtgaggacgttcccggacagtgcctcactcacctgggactggtatcccctcccagggtccaccaagggctcctgcttttcagacaccccatcatcctcgcgcgtcctcaccctgtctctaccagggaggtgcctagcttggtgaggttactcctgctcctccaacctttttttgccaaggtttgtacacgactcccatctaggctgaaaacctagaagtggaccttgtgtgtgtgcatggtgtcagcccaaagccaggctgagacagtcctcatatcctcttgagccaaactgtttgggtctcgttgcttcatggtatggtctggatttgtgggaatggctttgcgtgagaaaggggaggagagtggttgctgccctcagccggcttgaggacagagcctgtccctctcatgacaactcagtgttgaagcccagtgtcctcagcttcatgtccagtggatggcagaagttcatggggtagtggcctctcaaaggctgggcgcatcccaagacagccagcaggttgtctctggaaacgaccagagttaagctctcggcttctctgctgagggtgcaccctttcctctagatggtagttgtcacgttatctttgaaaactcttggactgctcctgaggaggccctcttttccagtaggaagttagatgggggttctcagaagtggctgattggaaggggacaagcttcgtttcaggggtctgccgttccatcctggttcagagaaggccgagcgtggctttctctagccttgtcactgtctccctgcctgtcaatcaccacctttcctccagaggaggaaaattatctcccctgcaaagcccggttctacacagatttcacaaattgtgctaagaaccgtccgtgttctcagaaagcccagtgtttttgcaaagaatgaaaagggaccccatatgtagcaaaaatcagggctgggggagagccgggttcattccctgtcctcattggtcgtccctatgaattgtacgtttcagagaaattttttttcctatgtgcaacacgaagcttccagaaccataaaatatcccgtcgataaggaaagaaaatgtcgttgttgttgtttttctggaaactgcttgaaatcttgctgtactatagagctcagaaggacacagcccgtcctcccctgcctgcctgattccatggctgttgtgctgattccaatgctttcacgttggttcctggcgtgggaactgctctcctttgcagccccatttcccaagctctgttcaagttaaacttatgtaagctttccgtggcatgcggggcgcgcacccacgtccccgctgcgtaagactctgtatttggatgccaatccacaggcctgaagaaactgcttgttgtgtatcagtaatcattagtggcaatgatgacattctgaaaagctgcaatacttatacaataaattttacaattctttggaatg

SEQ ID NO: 16193 - DNA, 3608 bp, Homo sapiens
  ENST00000256103
acactgcctttccccattgggtctctgtaagagtcacacgctttgggcatccttgaaaagaatcttctgaggcctcagcattttatctgagtcttctgaatcccacttagaactgtgttgagctctcacccatcacgatgagcaacaaattcctgggcacctggaaacttgtctctagtgagaactttgacgattacatgaaagctctgggtgtggggttagccaccagaaaactgggaaatttggccaaacccactgtgatcatcagcaagaaaggagatattataactatacgaactgaaagtacctttaaaaatacagaaatctccttcaagctaggccaggaatttgaagaaaccacagctgacaatagaaagaccaagagcatcgtaaccctgcagagaggatcactgaatcaagtgcagagatgggatggcaaagagacaaccataaagagaaagctagtgaatgggaaaatggtagcggaatgtaaaatgaagggcgtggtgtgcaccagaatctatgagaaggtctgaaaaatcatttcttcattgaagtggctttttatcatttaatgatggaaatcaattgcttccattgacaaaactgaatacactgcaaatatttgtttttgcttttgtcttaatatatcagatatgcaaaggcctaaactgagaattaatctaaaagtcagtgttatttaaacattttcaatgtgcatgcatgtcattattacatcaaagcatatatattggccagacacaaacagttgatgatgtcattcaattaactacaaaattctaatctatgttgaactttgtatacttgaaatgataataaaaaggatataatttcttagtaaaatgaaatcaaagtattgatcagggtagcaaactcaaatgctgacaggggccagaggagatatggggaaggagcatcagaaatgaggcaagctaggagaatgggctattataatgtaaagaattgtagtctcagttaaaaggggtagcctctactccagccaacattttaaaattaatggataatttatagacagttaaatttatagacagttaagtaaaaatggataatttatagacagataatttatagacaggtaaatgtgagttaaatataactcacatcccactcaagacacaaaacattttcttaatcctagtacatttttttctgtcccttcccaatcagtgtccttttctgttccacccctaccaaaagcaagtagtggtttggtttctatcatatagattaattttacctgctcatatgaagggaattgtacatcatgcattcttttctgtttgccttttttaaattcagcatcatgtttttgtgatacatccacattgttgcatgcagctgtagtttgtttctttttattaccaagtactatttcattgtatgaatatatcacagtttatccattctactattaagacaattgagctatttctaattttcggctgctatgaataaagctgctacaaatatttttgtacaagactttttgtaaacataggagtccctttattttaaataaataactagtcatatcattaggtccagtaattgttgacaggcaggaacgggggaccattgcattgtgcccaagtaataataaaactatttcagatgtattatatgattgagcaaatgagaaaacatgttgatgttgatgggagtcaggatgttcactatggaaaaacaaatatacaaatatgaaatgagggaaggcaagaaagaaccatgtggaaatggaatagaattggtataaattcataatttctaaaccatgtatatgtacgtttatatgtattataattgcatacacatgcctccatgcatatatgtgtgtgataatacacatgcatttatgtgcgtgtgtgtatacacatgcatatatttactaatcctatctgccaaaatggcttagacacaaaaacacctcagcagaaatgaatatacctagcactcagatcttcgtgtctaatatagtttgccactaaaaggaaccaaggctacttggaaaaatggatgattccaaagcaagggcaaggtaggaacaagatgagcttgaaatatcttgttatgccagaaagtaatgttaaaaaaaaaaatagaggtatattgccaaaacatagagccagcttgaaggggctcccactggccaaacttgagccaatctgagagcaaaataattgagaaaaataaataacaagataattgagaaaaaaataaaataaattcccaattccattgggaaaaaatagaaatccatgaatccatactgatataatgatagataatcgatagataggtagatgactgacagatgatagatagatatatagatagatagatagatagatagatagatagatagatagatagagaaatgagaaggtttctcttttgcaatagaacgtcatggaccagtgttaaatgtgagtggaaggagttctggaattggaaaaccatcatttttcaaccatcacagtaaatatggctcaggcaagaattatcaatcaatgctaaagctagggggaaatttcgcttaggagcaggatattagggtattagtctgggcttaaagtatctcctcacagattgttgttagtttctggggaaagaatagtaaccatgcaatggaaaaaaatggacaacctcttgactaggttatcaaaattaacctcaccaataaagggtggatgttcaacatgtgccttcaaatgtgacccactgagaaggaaacaacatcactgtaacaacaacaaccagaaacgacagggggttttgactgaattcttcaaaaatgtcaatgtcatagaagacaaagaaaggttgtggaaatgtttcagattaaatgatagtaaaaacacctgacaactaaacatagtaagtaatactagactggattctgtaccagaggtaacataagtgctccaaaggacaatgttaggtcaactggcaaattggaatatagacagtcaatcagataagaagtatactttgattaagtaaaaaaaatccctattcttggaaaatacacaataaagtattttgaggtaaagggccataatgtatgcaatctactctcaaaaaattcagaaacatatatttgtgtgcatttgcatgtgcaacagtacacacaaacatacataaagagagcaattgataaggcaaataaggtaacatttaacaataatctgatacacataaatagagaaagagcaattgataaagtaaatgaggtaaaatttaacaataatctgagcaaaaggtatatgtgttttctttgagacagtctgattcttgcaacttattctgtaagttggaacttatttccaaacatgattgaaaaaaaaccccgcacttggcaacttcttctctttttcagcctagaaatgtctgtgttaagtggttttttatttattgttgttgtttgttgttattgttgttttgttgccaggctccaactcacaaaatacgagtttaaaaactgcgttgttatttttagagatttgtgataatacaacttgttataaaatttattcctcaataaatataatttctctactatgcaaaaa

SEQ ID NO: 16194 - DNA, 1264 bp, Homo sapiens
  ENST00000519260
atctgagtcttctgaatcccacttagaactgtgttgagctctcacccatcacgatgagcaacaaattcctgggcacctggaaacttgtctctagtgagaactttgacgattacatgaaagctctggagcatcgtaaccctgcagagaggatcactgaatcaagtgcagagatgggatggcaaagagacaaccataaagagaaagctagtgaatgggaaaatggtagcggaatgtaaaatgaagggcgtggtgtgcaccagaatctatgagaaggtctgaaaaatcatttcttcattgaagtggctttttatcatttaatgatggaaatcaattgcttccattgacaaaactgaatacactgcaaatatttgtttttgcttttgtcttaatatatcagatatgcaaaggcctaaactgagaattaatctaaaagtcagtgttatttaaacattttcaatgtgcatgcatgtcattattacatcaaagcatatatattggccagacacaaacagttgatgatgtcattcaattaactacaaaattctaatctatgttgaactttgtatacttgaaatgataataaaaaggatataatttcttagtaaaatgaaatcaaagtattgatcagggtagcaaactcaaatgctgacaggggccagaggagatatggggaaggagcatcagaaatgaggcaagctaggagaatgggctattataatgtaaagaattgtagtctcagttaaaaggggtagcctctactccagccaacattttaaaattaatggataatttatagacagttaaatttatagacagttaagtaaaaatggataatttatagacagataatttatagacaggtaaatgtgagttaaatataactcacatcccactcaagacacaaaacattttcttaatcctagtacatttttttctgtcccttcccaatcagtgtccttttctgttccacccctaccaaaagcaagtagtggtttggtttctatcatatagattaattttacctgctcatatgaagggaattgtacatcatgcattcttttctgtttgccttttttaaattcagcatcatgtttttgtgatacatccacattgttgcatgcagctgtagtttgtttctttttattaccaagtactatttcattgtatgaatatatcacagtttatccattctactattaagacaattgagctatttctaattttcggctgctatgaataaagctgctacaaatatttttgtaca

SEQ ID NO: 16195 - DNA, 1817 bp, Homo sapiens
  ENST00000395938
tgttcccgttaaaggggaacgccaggagcctcccactgcccccttgcttcgcgcgcgcgcagccccgcagcgcagctttggcggcgccagcagcggagccaacgcacccgagtttgtgtttgaggccaccctgaggatcgggacagctgttcctttgggctgcagaaactccgctgagcagaacttgccgccagaatgctcctcctgttgctgagtatcatcgtcctccacgtcgcggtgctggtgctgctgttcgtctccacgatcgtcagccaatggatcgtgggcaatggacacgcaactgatctctggcagaactgtagcacctcttcctcaggaaatgtccaccactgtttctcatcatcaccaaacgaatggctgcagtctgtccaggccaccatgatcctgtcgatcatcttcagcattctgtctctgttcctgttcttctgccaactcttcaccctcaccaaggggggcaggttttacatcactggaatcttccaaattcttgctggtctgtgcgtgatgagtgctgcggccatctacacggtgaggcacccggagtggcatctcaactcggattactcctacggtttcgcctacatcctggcctgggtggccttccccctggcccttctcagcggtgtcatctatgtgatcttgcggaaacgcgaatgaggcgcccagacggtctgtctgaggctctgagcgtacatagggaagggaggaagggaaaacagaaagcagacaaagaaaaaagagctagcccaaaatcccaaactcaaaccaaaccaaacagaaagcagtggaggtgggggttgctgttgattgaagatgtatataatatctccggtttataaaacctatttataacactttttacatatatgtacatagtattgtttgctttttatgttgaccatcagcctcgtgttgagccttaaagaagtagctaaggaactttacatcctaacagtataatccagctcagtatttttgttttgttttttgtttgtttgttttgttttacccagaaataagataactccatctcgccccttccctttcatctgaaagaagatacctccctcccagtccacctcatttagaaaaccaaagtgtgggtagaaaccccaaatgtccaaaagcccttttctggtgggtgacccagtgcatccaacagaaacagccgctgcccgaacctctgtgtgaagctttacgcgcacacggacaaaatgcccaaactggagcccttgcaaaaacacggcttgtggcattggcatacttgcccttacaggtggagtatcttcgtcacacatctaaatgagaaatcagtgacaacaagtctttgaaatggtgctatggatttaccattccttattatcactaatcatctaaacaactcactggaaatccaattaacaattttacaacataagatagaatggagacctgaataattctgtgtaatataaatggtttataactgcttttgtacctagctaggctgctattattactataatgagtaaatcataaagccttcatcactcccacatttttcttacggtcggagcatcagaacaagcgtctagactccttgggaccgtgagttcctagagcttggctgggtctaggctgttctgtgcctccaaggactgtctggcaatgacttgtattggccaccaactgtagatgtatatatggtgcccttctgatgctaagactccagaccttttgtttttgctttgcattttctgattttataccaactgtgtggactaagatgcattaaaataaacatcagagtaactcac

SEQ ID NO: 16196 - DNA, 1810 bp, Homo sapiens
  ENST00000312280
agggaacatctcggggagcctggttggaagctgcaggcttagtctgtcggctgcgggtctctgactgccctgtggggagggtcttgccttaacatcccttgcatttggctgcaaagaaatctgcttggaagaaggggttacgctgtttggccgggcagaaactccgctgagcagaacttgccgccagaatgctcctcctgttgctgagtatcatcgtcctccacgtcgcggtgctggtgctgctgttcgtctccacgatcgtcagccaatggatcgtgggcaatggacacgcaactgatctctggcagaactgtagcacctcttcctcaggaaatgtccaccactgtttctcatcatcaccaaacgaatggctgcagtctgtccaggccaccatgatcctgtcgatcatcttcagcattctgtctctgttcctgttcttctgccaactcttcaccctcaccaaggggggcaggttttacatcactggaatcttccaaattcttgctggtctgtgcgtgatgagtgctgcggccatctacacggtgaggcacccggagtggcatctcaactcggattactcctacggtttcgcctacatcctggcctgggtggccttccccctggcccttctcagcggtgtcatctatgtgatcttgcggaaacgcgaatgaggcgcccagacggtctgtctgaggctctgagcgtacatagggaagggaggaagggaaaacagaaagcagacaaagaaaaaagagctagcccaaaatcccaaactcaaaccaaaccaaacagaaagcagtggaggtgggggttgctgttgattgaagatgtatataatatctccggtttataaaacctatttataacactttttacatatatgtacatagtattgtttgctttttatgttgaccatcagcctcgtgttgagccttaaagaagtagctaaggaactttacatcctaacagtataatccagctcagtatttttgttttgttttttgtttgtttgttttgttttacccagaaataagataactccatctcgccccttccctttcatctgaaagaagatacctccctcccagtccacctcatttagaaaaccaaagtgtgggtagaaaccccaaatgtccaaaagcccttttctggtgggtgacccagtgcatccaacagaaacagccgctgcccgaacctctgtgtgaagctttacgcgcacacggacaaaatgcccaaactggagcccttgcaaaaacacggcttgtggcattggcatacttgcccttacaggtggagtatcttcgtcacacatctaaatgagaaatcagtgacaacaagtctttgaaatggtgctatggatttaccattccttattatcactaatcatctaaacaactcactggaaatccaattaacaattttacaacataagatagaatggagacctgaataattctgtgtaatataaatggtttataactgcttttgtacctagctaggctgctattattactataatgagtaaatcataaagccttcatcactcccacatttttcttacggtcggagcatcagaacaagcgtctagactccttgggaccgtgagttcctagagcttggctgggtctaggctgttctgtgcctccaaggactgtctggcaatgacttgtattggccaccaactgtagatgtatatatggtgcccttctgatgctaagactccagaccttttgtttttgctttgcattttctgattttataccaactgtgtggactaagatgcattaaaataaacatcagagtaactcac

SEQ ID NO: 16197 - DNA, 872 bp, Homo sapiens
  ENST00000494511
gggagcaccaccagggaacatctcggggagcctggttggaagctgcaggcttagtctgtcggctgcgggtctctgactgccctgtggggagggtcttgccttaacatcccttgcatttggctgcaaagaaatctgcttggaagaaggggttacgctgtttggccggaatggctgcagtctgtccaggccaccatgatcctgtcgatcatcttcagcattctgtctctgttcctgttcttctgccaactcttcaccctcaccaaggggggcaggttttacatcactggaatcttccaaattcttgctggtctgtgcgtgatgagtgctgcggccatctacacggtgaggcacccggagtggcatctcaactcggattactcctacggtttcgcctacatcctggcctgggtggccttccccctggcccttctcagcggtgtcatctatgtgatcttgcggaaacgcgaatgaggcgcccagacggtctgtctgaggctctgagcgtacatagggaagggaggaagggaaaacagaaagcagacaaagaaaaaagagctagcccaaaatcccaaactcaaaccaaaccaaacagaaagcagtggaggtgggggttgctgttgattgaagatgtatataatatctccggtttataaaacctatttataacactttttacatatatgtacatagtattgtttgctttttatgttgaccatcagcctcgtgttgagccttaaagaagtagctaaggaactttacatcctaacagtataatccagctcagtatttttgttttgttttttgtttgtttgttttgttttacccagaaataagataactccatctcgccccttccctttcatctgaaagaa

SEQ ID NO: 16198 - DNA, 816 bp, Homo sapiens
  ENST00000395936
tcgcgcgcgcgcagccccgcagcgcagctttggcggcgccagcagcggagccaacgcacccgagtttgtgtttgaggccaccctgaggatcgggacagctgttcctttgggctgcagaaactccgctgagcagaacttgccgccagaatgctcctcctgttgctgagtatcatcgtcctccacgtcgcggtgctggtgctgctgttcgtctccacgatcgtcagccaatggatcgtgggcaatggacacgcaactgatctctggcagaactgtagcacctcttcctcaggaaatgtccaccactgtttctcatcatcaccaaacgaatggctgcagtctgtccaggccaccatgatcctgtcgatcatcttcagcattctgtctctgttcctgttcttctgccaactcttcaccctcaccaaggggggcaggttttacatcactggaatcttccaaattcttgctgaatcaaactcaagtcaaatgtgtggttaccgggattaagaacagaaagaatagaggggactcctgagtctgtgcgtgatgagtgctgcggccatctacacggtgaggcacccggagtggcatctcaactcggattactcctacggtttcgcctacatcctggcctgggtggccttccccctggcccttctcagcggtgtcatctatgtgatcttgcggaaacgcgaatgaggcgcccagacggtctgtctgaggctctgagcgtacatagggaagggaggaagggaaaacagaaagcagacaaagaaaaaagagctagcccaaaatcccaaactcaaaccaaaccaaaca

SEQ ID NO: 16199 - DNA, 428 bp, Homo sapiens
  ENST00000580584
agttacagggagcaccaccagggaacatctcggggagcctggttggaagctgcaggcttagtctgtcggctgcgggtctctgactgccctgtggggagggtcttgccttaacatcccttgcatttggctgcaaagaaatctgcttggaagaaggggttacgctgtttggccggcaatggatcgtgggcaatggacacgcaactgatctctggcagaactgtagcacctcttcctcaggaaatgtccaccactgtttctcatcatcaccaaacgaatggctgcagtctgtccaggccaccatgatcctgtcgatcatcttcagcattctgtctctgttcctgttcttctgccaactcttcaccctcaccaaggggggcaggttttacatcactggaatcttccaaattcttgctggtctgtgcgtgatg

SEQ ID NO: 16200 - DNA, 571 bp, Homo sapiens
  ENST00000426385
agctttggcggcgccagcagcggagccaacgcacccgagtttgtgtttgaggccaccctgaggatcgggacagctgttcctttgggctgcagaaactccgctgagcagaacttgccgccagaatgctcctcctgttgctgagtatcatcgtcctccacgtcgcggtgctggtgctgctgttcgtctccacgatcgtcagccaatggatcgtgggcaatggacacgcaactgatctctggcagaactgtagcacctcttcctcaggaaatgtccaccactgtttctcatcatcaccaaacgaatggctgcagtctgtccaggccaccatgatcctgtcgatcatcttcagcattctgtctctgttcctgttcttctgccaactcttcaccctcaccaaggggggcaggttttacatcactggaatcttccaaattcttgctggtaagttgtggatggtaaagtccatgtggaagcggggtgcatccaagtctgcggaatgattagtttagtagaaggatgtggcctcagaatgactgatgttcatgagtctccccactggatgctttccata

SEQ ID NO: 16201 - DNA, 576 bp, Homo sapiens
  ENST00000580497
ctcgcaggcagaaactccgctgagcagaacttgccgccagaatgctcctcctgttgctgagtatcatcgtcctccacgtcgcggtgctggtgctgctgttcgtctccacgatcgtcagccaatggatcgtgggcaatggacacgcaactgatctctggcagaactgtagcacctcttcctcaggaaatgtccaccactgtttctcatcatcaccaaacggtgaggctggttttgtgctccatgagcttgtcctcagacgcctgtaacacgtttctcagcccagagctggaaacgcttattggaagacacaagccagaatgtcgttgctggggtggggtgggatgtgacagggagccatgagtccagggaaaatgggaggggtggtgatctcgctggggaagctgagatcctgggcatcattgtgattcactctacctagagacatgcccttagtgccctcctgatcacttaggataatgctttttgtgattgaaaaaaatatcgacctgggagctgtgaaggtggtatgatagctaagcctttggcagacccccttgggacattggatcaaacgtg

SEQ ID NO: 16202 - DNA, 637 bp, Homo sapiens
  ENST00000471150
cagggaacatctcggggagcctggttggaagctgcaggcttagtctgtcggctgcgggtctctgactgccctgtggggagggtcttgccttaacatcccttgcatttggctgcaaagaaatctgcttggaagaaggggttacgctgtttggccgggcagaaactccgctgagcagaacttgccgccagaatgctcctcctgttgctgagtatcatcgtcctccacgtcgcggtgctggtgctgctgttcgtctccacgatcgtcagcgtgagtgcctggcggggaggctccctgcgcggcccgcccttccccatctgggttcccagcccgtgctcctgctggttcaggactgtgttatttgcagacagttggaagtctcagacgtcccagggaagtttctggcaatctgcccccttccagttgctttgagaaaacgagagcagattcagtgataggaaccaagcgagcgctgggctgggttagctgcgcaggtctctatttaagccaagtaacttcagagccgatctagggtccccgaccttcatttgacaagattgtttaacttttttttttcttgatgcagcctcgttgaagaagaggagtatttatgatttttttttctccaaaccatagtcag

SEQ ID NO: 16203 - DNA, 1822 bp, Homo sapiens
  ENST00000612492
tgttcccgttaaaggggaacgccaggagcctcccactgcccccttgcttcgcgcgcgcgcagccccgcagcgcagctttggcggcgccagcagcggagccaacgcacccgagtttgtgtttgaggccaccctgaggatcgggacagctgttcctttgggctgtaagcagaaactccgctgagcagaacttgccgccagaatgctcctcctgttgctgagtatcatcgtcctccacgtcgcggtgctggtgctgctgttcgtctccacgatcgtcagccaatggatcgtgggcaatggacacgcaactgatctctggcagaactgtagcacctcttcctcaggaaatgtccaccactgtttctcatcatcaccaaacgaatggctgcagtctgtccaggccaccatgatcctgtcgatcatcttcagcattctgtctctgttcctgttcttctgccaactcttcaccctcaccaaggggggcaggttttacatcactggaatcttccaaattcttgctggtctgtgcgtgatgagtgctgcggccatctacacggtgaggcacccggagtggcatctcaactcggattactcctacggtttcgcctacatcctggcctgggtggccttccccctggcccttctcagcggtgtcatctatgtgatcttgcggaaacgcgaatgaggcgcccagacggtctgtctgaggctctgagcgtacatagggaagggaggaagggaaaacagaaagcagacaaagaaaaaagagctagcccaaaatcccaaactcaaaccaaaccaaacagaaagcagtggaggtgggggttgctgttgattgaagatgtatataatatctccggtttataaaacctatttataacactttttacatatatgtacatagtattgtttgctttttatgttgaccatcagcctcgtgttgagccttaaagaagtagctaaggaactttacatcctaacagtataatccagctcagtatttttgttttgttttttgtttgtttgttttgttttacccagaaataagataactccatctcgccccttccctttcatctgaaagaagatacctccctcccagtccacctcatttagaaaaccaaagtgtgggtagaaaccccaaatgtccaaaagcccttttctggtgggtgacccagtgcatccaacagaaacagccgctgcccgaacctctgtgtgaagctttacgcgcacacggacaaaatgcccaaactggagcccttgcaaaaacacggcttgtggcattggcatacttgcccttacaggtggagtatcttcgtcacacatctaaatgagaaatcagtgacaacaagtctttgaaatggtgctatggatttaccattccttattatcactaatcatctaaacaactcactggaaatccaattaacaattttacaacataagatagaatggagacctgaataattctgtgtaatataaatggtttataactgcttttgtacctagctaggctgctattattactataatgagtaaatcataaagccttcatcactcccacatttttcttacggtcggagcatcagaacaagcgtctagactccttgggaccgtgagttcctagagcttggctgggtctaggctgttctgtgcctccaaggactgtctggcaatgacttgtattggccaccaactgtagatgtatatatggtgcccttctgatgctaagactccagaccttttgtttttgctttgcattttctgattttataccaactgtgtggactaagatgcattaaaataaacatcagagtaactcact

SEQ ID NO: 16204 - DNA, 1280 bp, Homo sapiens
  ENST00000368467
gaaggttctgggcggggctggactgttctaagtgagttcgggtgggggagcttcacgaggggaggctgctctgtgaaggaaccgcctttctctccgcgtgtctcacccttttctccccatatctgtttggacatgagctgagggcacggtcgcgggcggtcagccctgttcgcagctacggcgaggaggggcgcgattgttccttgttgccgctccgcttagtggccgcgtccattccgcgcggtgtcccgattttaggggtagggagaagtgtcagcttcaggcatcgcgaggcgtggcggccccatggccccgctgggaggcgccccgcggctggtactgctgttcagcggcaagaggaaatccgggaaggacttcgtgaccgaggcgctgcagagcagacttggagctgatgtctgtgctgtcctccggctctctggtccactcaaggaacagtatgctcaggagcatggcttgaacttccagagactcctggacaccagcacctacaaggaggcctttcggaaggacatgatccgctggggagaggagaaacgccaggctgacccaggcttcttttgcaggaagattgtggagggcatctcccagcccatctggctggtgagtgacacacggagagtgtctgacatccagtggtttcgggaggcctatggggccgtgacgcagacggtccgcgttgtagcgttggagcagagccgacagcagcggggctgggtgttcacgccaggggtggacgatgctgagtcagaatgtggcctggacaacttcggggactttgactgggtcatcgagaaccatggagttgaacagcgcctggaggagcagttggagaacctgatagaatttatccgctccagactttagtcactaggttctaggagtgagctggggcctgctgaggtgggggtggggctgactctgcaaaatgggggtgtcccccgatcctggccgaggtgaggaacagacagggggggtctagattctgagggggttggtggatattgggcaaggcaggaaacctctggagacctcattttctccatggggaagacagccatgctcttcaggaggagactccaagggcaaaggagggtgtcttggctgtgcttgaaggcgaaaccctgccatatccccagtgccagtcccctcagcctgtggtggccttgcatcctgactggatgttctcagccccttgttctgggcaagaacccagagctccccagtgtggatactaataaacctcttggagcacactctca

SEQ ID NO: 16205 - DNA, 1483 bp, Homo sapiens
  ENST00000369221
gcgtgtggaacctgacggaactgccacgatgctgccactttggactctttcactgctgctgggagcagtagcaggaaaagaagtttgctacgaaagactcggctgcttcagtgatgactccccatggtcaggaattacggaaagacccctccatatattgccttggtctccaaaagatgtcaacacccgcttcctcctatatactaatgagaacccaaacaactttcaagaagttgccgcagattcatcaagcatcagtggctccaatttcaaaacaaatagaaaaactcgctttattattcatggattcatagacaagggagaagaaaactggctggccaatgtgtgcaagaatctgttcaaggtggaaagtgtgaactgtatctgtgtggactggaaaggtggctcccgaactggatacacacaagcctcgcagaacatcaggatcgtgggagcagaagtggcatattttgttgaatttcttcagtcggcgttcggttactcaccttccaatgtgcatgtcattggccacagcctgggtgcccacgctgctggggaggctggaaggagaaccaatgggaccattggacgcatcacagggttggacccagcagaaccttgctttcagggcacacctgaattagtccgattggaccccagcgatgccaaatttgtggatgtaattcacacggatggtgcccccatagtccccaatttggggtttggaatgagccaagtcgtgggccacctagatttctttccaaatggaggagtggaaatgcctggatgtaaaaagaacattctctctcagattgtggacatagacggaatctgggaagggactcgagactttgcggcctgtaatcacttaagaagctacaaatattacactgatagcatcgtcaaccctgatggctttgctggattcccctgtgcctcttacaacgtcttcactgcaaacaagtgtttcccttgtccaagtggaggctgcccacagatgggtcactatgctgatagatatcctgggaaaacaaatgatgtgggccagaaattttatctagacactggtgatgccagtaattttgcacgttggaggtataaggtatctgtcacactgtctggaaaaaaggttacaggacacatactagtttctttgttcggaaataaaggaaactctaagcagtatgaaattttcaagggcactctcaaaccagatagtactcattccaatgaatttgactcagatgtggatgttggggacttgcagatggttaaatttatttggtataacaatgtgatcaacccaactttacctagagtgggagcatccaagattatagtggagacaaatgttggaaaacagttcaacttctgtagtccagaaaccgtcagggaggaagttctgctcaccctcacaccgtgttaggagactactgttatttgaccaatgaattgacttctaataaaatctagtggtgatgca

SEQ ID NO: 16206 - DNA, 515 bp, Homo sapiens
  ENST00000470562
atgctgccactttggactctttcactgctgctgggagcagtagcaggaaaagaagtttgctacgaaagactcggctgcttcagtgatgactccccatggtcaggaattacggaaagacccctccatatattgccttggtctccaaaagatgtcaacacccgcttcctcctatatactaatgagaacccaaacaactttcaagaagttgccgcagattcatcaagcatcagtggctccaatttcaaaacaaatagaaaaactcgctttattattcatggattcatagacaagggagaagaaaactggctggccaatgtgtgcaagaatctgttcaaggtggaaagtgtgaactgtatctgtgtggactggaaaggtggctcccgaactggatacacacaagcctcgcagaacatcaggatcgtgggagcagaagtggcatattttgttgaatttcttcaggtaattactcccggattgcataaaagcctgtacacatggttttccagattatcttt

SEQ ID NO: 16207 - DNA, 4965 bp, Homo sapiens
  ENST00000522362
gctcggggaagcggcaaagttggatctgggagggcgtccgctgcggctgcgggagccgaaaggctgccagttcccggcagcgctgggaggagggaggcgcgggcggggcgcggcgccggggaggggagcggtgctcaggggagggctggaggggagggaaggagagagagaggggagggcggcaccgcccctagccccgcgctccggaagtgaagcggccagaccaccagctaatggatgcggagcggagggcccgctgaccgctctccgcgcctggagcagcttggcttggctggagctaagagccagacacaccactgtgtggaggtgggtgatgtcttcctgtgctaaaaggtgaataaataagctcctcacctctcgcggaacactcgggaacacatcaacaggggtccaagccgccctgctgggaggcttctcttcaagagttctgggtcccagagtggaaggcattttcccatcaactggagagagacgaaacatcagagaccaggaggctgtggagaaagcagctgtcccaggtgcctcaactatcagagaagggtcagcgtcacgtggctgccagcatctttgagaaaatcactggcaatcggacttcagagctgcgggcacaggtgtggttagaactgagatacgacctgcccacctgggtcaggcctaaagacaagaagtcctgagttcttgccactgagtaggccagggtcatttgtccagaaaactttgtgactgtctttgagtgacctagtctgggacccattcattggtgggttctaaggttagaagctcatccaggatattttcaatattaagtcagtgcatagctgcaccactaacaaattggtgcctgtagagtcagagtgggtcaattcttaggacaatggcgctggcactgttagaggactggtgcaggataatgagtgtggatgagcagaagtcactgatggttacggggataccggcggactttgaggaggctgagattcaggaggtccttcaggagactttaaagtctctgggcaggtatagactgcttggcaagatattccggaagcaggagaatgccaatgctgtcttactagagcttctggaagatactgatgtctcggccattcccagtgaggtccagggaaaggggggtgtctggaaggtgatctttaagacccctaatcaggacactgagtttcttgaaagattgaacctgtttctagaaaaagaggggcagacggtctcgggtatgtttcgagccctggggcaggagggcgtgtctccagccacagtgccctgcatctcaccagaattactggcccatttgttgggacaggcaatggcacatgcgcctcagcccctgctacccatgagataccggaaactgcgagtattctcagggagtgctgtcccagccccagaggaagagtcctttgaggtctggttggaacaggccacggagatagtcaaagagtggccagtaacagaggcagaaaagaaaaggtggctggcggaaagcctgcggggccctgccctggacctcatgcacatagtgcaggcagacaacccgtccatcagtgtagaagagtgtttggaggcctttaagcaagtgtttgggagcctagagagccgcaggacagcccaggtgaggtatctgaagacctatcaggaggaaggagagaaggtctcagcctatgtgttacggctagaaaccctgctccggagagcggtggagaaacgcgccatccctcggcgtattgcggaccaggtccgcctggagcaggtcatggctggggccactcttaaccagatgctgtggtgccggcttagggagctgaaggatcagggcccgccccccagcttccttgagctaatgaaggtaatacgggaagaagaggaggaagaggcctcctttgagaatgagagtatcgaagagccagaggaacgagatggctatggccgctggaatcatgagggagacgactgaaaaccacctgggggcaggacccacagccagtgggctaagacctttaaaaaatttttttctttaatgtatgggactgaaatcaaaccatgaaagccaattattgaccttccttccttccttccttccctcccttcctccttctctccttctctcctcctctctcctctcctctcctctctttccttccttccttccttttttctttttctctttcttctttatttcttgggtctcactctcatcacccaggctagagtgcagtggcacaaaaatctcggctcactgcagccttgacttcccaggctcaggctcaggtgatcctcacaccttagcctcccaagtacctgggactacaggcacgcaccaccatgcctagctattcttttgtatttttggtagagacagggttttgctgtgttgctcaggctggtctggaacccctaggctcaaatgatgtgcccaactcggcctcccaaagtgctgggattacaggcatgaaccgccatgcctggcccttgatttttctttttaagaaaaaaatatctaggagtttcttagaccctatgtagattattaatgaacaaaagattaaactccaaatattaaatagtaagcctgaaggaatctgaaacacttgtacttccaattttctttaaataatcccaaatagaccagaattggcccataccatagaagaaagaattggcagtcaaaaaaaaaaataccttttgtaatgtttgaaaaataaagctgtttgacttgtcaggtgttttcctttctcaaatcagcaaattctctctgagtgcctggctttgtgagacactgtacaaggagttacaagactacagctataacctgcagttgagcagttataaacctacaaaatgggccctgccctcagagaggttccagtctagatgaggagctgatctagacaggtaaaaggctaactaaccctttgtgtaaataagttcatcaccccagtaaaagtgtcatcacccagtgaataggaccacctctgcctgcagatttttgttgttgttgttgtcattgttgttgttgttttaacctgggaagtgttcttcctgcctttctgctaggtgtcagatagatggtcccagagctaggtgctgtgtcaggccctgaagacacagatgactcaacctaagctttactttccagaggtccacagcctgagaggtgtccccaaagaaagggggacatgaggggactgcatgcttgagagcagggttgtttagggcaggtttggatttagtgagcaggctggtttgcttagagaaggcttttagtggcaacaaaggatgaagaggagagaaaaggaactcacatttattgagggcctactgtgtgcaaagtgtttcatgtatatctcattgaatgtatacagccaccctgttgtggtataattttgctctttataaagagaaagaccgaagctcagatgagttaagtggtctcctcaacaccaaaatgccaagaagtgatggagcctagacagaagcccagaactttctgactcacactagtccatcctctaccatcacgatgactttcaaattgtgctctgcagttctgcagattttctagcagtgccatctccaaaatgtgttttaaactctttatttttttaattattattagtattattttgagactgagtcttgctctatcacccaggctggagtgcagtggtgcaatctcagctcactgcaacctccgcctcccaggttcaagcgatttcgtgcctcagcctcccgagtagctgggattacaggcacccaccaccacgcccagctaatttttgtatttttagtagaaatggggtttcaccatgttggccaggctggtctcgaactcctgacctcaagtgatccactcacctcggcctcccaaagtgctgggattacaggtgtgagccaccatgcctgggctaaactctttaagtctctagtaaatgcagctagattcaaatgggctgataaccaaattttaacacatcagcattcaccaccaggtttacttttattttcagattggctcattttgtgcagaccttagagcaaagtttcctttatggtatctgtgtacgtatccaaacttcttttaattgttcacagattttaaaagcggtagcaccacatggttgtgtagatcagacctgtgtatttagatcagacctgtgtatcacgtaagtgtgtgagtgcagtgcagatgagcaccatttagttatatgtgctaggcaaatctccaacacagttgatgtgtagtcttgtggtagatttgtgcatactgtaagcaaattgcttagcttctctagacatcagtttccacatctgaaaaataagaagatgagagtacacggttgttatgaacaaatgacttaatgctttttaagcacgttgcatgacatctggaacacagaaagccctcaatacattgaagctcttaggattttcacgatgttcctgtctgctcaatgcatgctttctttattgttctgacagttgtgtggtaacaagctaatatgcttccagttgacttccagtctaccctggtgttagaaaccgtttcatctcttattgtaaatttgagtgcttgttgttttttatatttgtgatgactcttccagcagttgttgacaattgttagaggtttgacttttaaataattacttattttttctgattgtggttcagtttaactgaagaatatcctgagattgtaagaaaagcattttttaaaaggtatcacttgtgatcatttatctttctaaattctatttttaatactgttccaccaaagtgatgcagtggttaccatgacaccctaatttcatgtgtttttgtatttatgaaaatagtttcattgtcatttattggcggtatacaaagtaaaatgttataaatgtgaagttataaaataaatatatgctaataaaatcctgagtttttctg

SEQ ID NO: 16208 - DNA, 576 bp, Homo sapiens
  ENST00000521740
gtgaagcggccagaccaccagctaatggatgcggagcggagggcccgctgaccgctctccgcgcctggagcagcttggcttggctggagctaagagccagacacaccactgtgtggaggtgggtgatgtcttcctgtgctaaaaggggtccaagccgccctgctgggaggcttctcttcaagagttctgggtcccagagtggaaggcattttcccatcaactggagagagacgaaacatcagagaccaggaggctgtggagaaagcagctgtcccaggtgcctcaactatcagagaagggtcagcgtcacgtggctgccagcatctttgagaaaatcactggcaatcggacttcagagctgcgggcacaggtgtggttagaactgagatacgacctgcccacctgggtcaggcctaaagacaagaagtcctgagttcttgccactgagtaggccagggtcatttgtccagaaaactttgtgactgtctttgagtgacctagtctgggacccattcattggtgggttctaaggttagaagctcatccaggatattttcaatattaagtcagtgcata

SEQ ID NO: 16209 - DNA, 595 bp, Homo sapiens
  ENST00000518212
agccccgcgctccggaagtgaagcggccagaccaccagctaatggatgcggagcggagggcccgctgaccgctctccgcgcctggcttggcttggctggagctaagagccagacacaccactgtgtggaggtgggtgatgtcttcctgtgctaaaaggtgaataaataagctcctcacctctcgcggaacactcgggaacacatcaacaggggtccaagccgccctgctgggaggcttctcttcaagagttctgggtcccagagtggaaggcattttcccatcaactggagagagacgaaacatcagagaccaggaggctgtggagaaagcagctgtcccaggtgcctcaactatcagagaagggtcagcgtcacgtggctgccagcatctttgagaaaatcactggcaatcggacttcagagctgcgggcacaggtgtggttagaactgagatacgacctgcccacctgggtcaggcctaaagacaagaagtcctgagttcttgccactgagtaggccagggtcatttgtccagaaaactttgtgactgtctttgagtgacctagtctgggacccattcattggtgggttctaa

SEQ ID NO: 16210 - DNA, 590 bp, Homo sapiens
  ENST00000521875
acagtcgcagcgtttcccgggttaccagatgccacgtgtttggggagtaagtgcgggtgcgcatctggtgcggagtaggagagcagcttggcttggctggagctaagagccagacacaccactgtgtggaggtgggtgatgtcttcctgtgctaaaaggtgaataaataagctcctcacctctcgcggaacactcgggaacacatcaacaggggtccaagccgccctgctgggaggcttctcttcaagagttctgggtcccagagtggaaggcattttcccatcaactggagagagacgaaacatcagagaccaggaggctgtggagaaagcagctgtcccaggtgcctcaactatcagagaagggtcagcgtcacgtggctgccagcatctttgagaaaatcactggcaatcggacttcagagctgcgggcacaggtgtggttagaactgagatacgacctgcccacctgggtcaggcctaaagacaagaagtcctgagttcttgccactgagtaggccagggtcatttgtccagaaaactttgtgactgtctttgagtgacctagtctgggacccattcattggtggg

SEQ ID NO: 16211 - DNA, 625 bp, Homo sapiens
  ENST00000523244
aagtgcgggtgcgcatctggtgcggagtaggaggtaggatgtgggctgtgagtgccatgaattgtgtggggccaagcaggggaaaggtgtgtaggaacttggtgtgtgtgtgcagtagctgagccacggccaccgggttgagcagcttggcttggctggagctaagagccagacacaccactgtgtggaggtgggtgatgtcttcctgtgctaaaaggtgaataaataagctcctcacctctcgcggaacactcgggaacacatcaacaggggtccaagccgccctgctgggaggcttctcttcaagagttctgggtcccagagtggaaggcattttcccatcaactggagagagacgaaacatcagagaccaggaggctgtggagaaagcagctgtcccaggtgcctcaactatcagagaagggtcagcgtcacgtggctgccagcatctttgagaaaatcactggcaatcggacttcagagctgcgggcacaggtgtggttagaactgagatacgacctgcccacctgggtcaggcctaaagacaagaagtcctgagttcttgccactgagtaggccagggtcatttgtccagaaaactttgtgactgtctttgagtgaccta

SEQ ID NO: 16212 - DNA, 587 bp, Homo sapiens
  ENST00000522450
agaccaccagctaatggatgcggagcggagggcccgctgaccgctctccgcgcctggacagagtctcacactgtcacccaggctggaatgcaatggtgcaaacgcaactcactgtagccttgacccactcggctcaagcagtcctccctcctcagcctcccaagtagttgggactacagcttggcttggctggagctaagagccagacacaccactgtgtggaggtgggtgatgtcttcctgtgctaaaaggtgaataaataagctcctcacctctcgcggaacactcgggaacacatcaacaggggtccaagccgccctgctgggaggcttctcttcaagagttctgggtcccagagtggaaggcattttcccatcaactggagagagacgaaacatcagagaccaggaggctgtggagaaagcagctgtcccaggtgcctcaactatcagagaagggtcagcgtcacgtggctgccagcatctttgagaaaatcactggcaatcggacttcagagctgcgggcacaggtgtggttagaactgagatacgacctgcccacctgggtcaggcctaaagacaagaagt

SEQ ID NO: 16213 - DNA, 761 bp, Homo sapiens
  ENST00000522764
gctcggggaagcggcaaagttggatctgggagggcgtccgctgcggctgcgggagccgaaaggctgccagttcccggcagcgctgggaggagggaggcgcgggcggggcgcggcgccggggaggggagcggtgctcaggggagggctggaggggagggaaggagagagagaggggagggcggcaccgcccctagccccgcgctccggaagtgaagcggccagaccaccagctaatggatgcggagcggagggcccgctgaccgctctccgcgcctggacagagtctcacactgtcacccaggctggaatgcaatggtgcaaacgcaactcactgtagccttgacccactcggctcaagcagtcctccctcctcagcctcccaagtagttgggactacagagcagcttggcttggctggagctaagagccagacacaccactgtgtggaggtgggtgatgtcttcctgtgctaaaaggtgaataaataagctcctcacctctcgcggaacactcgggaacacatcaacaggggtccaagccgccctgctgggaggcttctcttcaagagttctgggtcccagagtggaaggcattttcccatcaactggagagagacgaaacatcagagaccaggaggctgtggagaaagcagctgtcccaggtgcctcaactatcagagaagggtcagcgtcacgtggctgccagcatctttgagaaaatcactggcaatcggacttcagagctgcgggcacaggtgtggt

SEQ ID NO: 16214 - DNA, 563 bp, Homo sapiens
  ENST00000523616
agaccaccagctaatggatgcggagcggagggcccgctgaccgctctccgcgcctggagcagcttggcttggctggagctaagagccagacacaccactgtgtggaggtgggtgatgtcttcctgtgctaaaaggtgaataaataagctcctcacctctcgcggaacactcgggaacacatcaacaggtatttagccacatctcctgatttcatctttcaatggcaaagaccttgaatcctgtccttaactggggctcagacattaatcaacaggtctgatgagcatatggtggggacaccagatttcattggagtccccaagagaaaaaaaagtcacagtgagcaaagaaggggtctgacagagtgggacaaatgcaagcgcagtgtaaagcagaaccgccatctgcccccagttccattccagattagagtatggatgcttccaaggaaagagagtgctgtgtagtaaaactgaacattgtttcaccaggggtccaagccgccctgctgggaggcttctcttcaagagttctgggtcccagagtggaaggcattttcccat

SEQ ID NO: 16215 - DNA, 557 bp, Homo sapiens
  ENST00000553418
cgacccagcttcccttgtccagggagcaactcagacacagtctcgcttcatttttattctggggttgtacaatctaagggccggcccgcgtgctcgcttgccattggctggggactccagggcaagggatataagccagagcctagaccagtgagccaactgtgcgaaccagacccggcagccttgctcagttcagcatagcggagcggatccgatcggatcggagcggatcggagcacaccggagcaggctcatcgagaaggcgtctgcgagaccatggagaacggatacacctatgaagattataagaacactgcagaatggcttctgtctcacactaagcaccgacctcaagttgcaataatctgtggttctggattaggaggtctgactgataaattaactcaggcccagatctttgactacggtgaaatccccaactttccccgaagtacagtgccaggtcatgctggccgactggtgtttgggttcctgaatggcagggcctgtgtgatgatgcagggcaggttccacatgtatgaagggtacccactctg

SEQ ID NO: 16216 - DNA, 1509 bp, Homo sapiens
  ENST00000361505
ataagccagagcctagaccagtgagccaactgtgcgaaccagacccggcagccttgctcagttcagcatagcggagcggatccgatcggatcggagcggatcggagcacaccggagcaggctcatcgagaaggcgtctgcgagaccatggagaacggatacacctatgaagattataagaacactgcagaatggcttctgtctcacactaagcaccgacctcaagttgcaataatctgtggttctggattaggaggtctgactgataaattaactcaggcccagatctttgactacggtgaaatccccaactttccccgaagtacagtgccaggtcatgctggccgactggtgtttgggttcctgaatggcagggcctgtgtgatgatgcagggcaggttccacatgtatgaagggtacccactctggaaggtgacattcccagtgagggttttccaccttctgggtgtggacaccctggtagtcaccaatgcagcaggagggctgaaccccaagtttgaggttggagatatcatgctgatccgtgaccatatcaacctacctggtttcagtggtcagaaccctctcagagggcccaatgatgaaaggtttggagatcgtttccctgccatgtctgatgcctacgaccggactatgaggcagagggctctcagtacctggaaacaaatgggggagcaacgtgagctacaggaaggcacctatgtgatggtggcaggccccagctttgagactgtggcagaatgtcgtgtgctgcagaagctgggagcagacgctgttggcatgagtacagtaccagaagttatcgttgcacggcactgtggacttcgagtctttggcttctcactcatcactaacaaggtcatcatggattatgaaagcctggagaaggccaaccatgaagaagtcttagcagctggcaaacaagctgcacagaaattggaacagtttgtctccattcttatggccagcattccactccctgacaaagccagttgacctgccttggagtcgtctggcatctcccacacaagacccaagtagctgctaccttctttggccccttgctggagtcatgtgcctctgtccttaggttgtagcagaaaggaaaagattcctgtccttcacctttcccactttcttctaccagacccttctggtgccagatcctcttctcaaagctgggattacaggtgtgagcatagtgagaccttggcgctacaaaataaagctgttctcattcctgttctttcttacacaagagctggagcccgtgccctaccacacatctgtggagatgcccaggatttgactcgggccttagaactttgcatagcagctgctactagctctttgagataatacattccgaggggctcagttctgccttatctaaatcaccagagaccaaacaaggactaatccaatacctcttggattttatttaatgtcataatgttgtcagaataaagagaaagatgaaataatttca

SEQ ID NO: 16217 - DNA, 1023 bp, Homo sapiens
  ENST00000556293
aactgtgcgaaccagacccggcagccttgctcagttcagcatagcggagcggatccgatcggatcggagcggatcggagcacaccggagcaggctcatcgagaaggcgtctgcgagaccatggagaacggatacacctatgaagattataagaacactgcagaatggcttctgtctcacactaagcaccgacctcaagttgcaataatctgtggttctggattaggaggtctgactgataaattaactcaggcccagatctttgactacggtgaaatccccaactttccccgaagtacaggtactggcaagggaaagtggggaatgggactgagggatgttcttggaattctgtggaacacaaccaaggaggccaatgtttctactccttgacctagcatttcactgaagacaaatgttgtaagagaggagaaaagcccaccatgagtcagagtgactttaggagatgcctctagcagacatcccataagagacaggacatgtgtgtgtcagtggactgaggctaagactcagaagagggccaggtgacaggggccaagtaaagggcaagggttgtttatttggtttacgtaatttctcaaataactaacttctgttggtttatttattaatttttaagatttctatcttcttttccctggagagttaagaatttttttttaagacctgtcagcaggaaaagacctttaatagctatttttttaaactctttaacacaagactggaagagcagagggagaaggtgagggaaatattaacagagggtgtgtgaagggcatacttctctaagggagatagtagtgacgctggctccactggccactcctacccccagtgagaagggcactgcattaaatgataagtgggttagtttttttaagcttatcaacatgtttattttttatactccacttgggtttcctttgtcaactttattactgtttttgttttgtttttttgcataagctcctctatctttgagaatttctcagctcttcctctt

SEQ ID NO: 16218 - DNA, 992 bp, Homo sapiens
  ENST00000557229
aactgtgcgaaccagacccggcagccttgctcagttcagcatagcggagcggatccgatcggatcggagcggatcggagcacaccggagcaggctcatcgagaaggcgtctgcgagaccatggagaacggatacacctatgaagattataagaacactgcagaatggcttctgtctcacactaagcaccgacctcaagttgcaataatctgtggttctggattaggaggtctgactgataaattaactcaggcccagatctttgactacggtgaaatccccaactttccccgaagtacagtgccaggtcatgctggccgactggtgtttgggttcctgaatggcagggcctgtgtgatgatgcagggcaggttccacatgtatgaagggtacccactctggaaggtaagtcagagggataggtccggttggatctggaagaggcaggagagaactatctagcctctttcactacctagctatctgggctaggtggatttttggtcctctccttccttttctttcacgatgtatgtcatgcatttcagtgtagctgaattaatgaaattttgtaaatttttttcggattgtttgcttcgaaggtgacattcccagtgagggttttccaccttctgggtgtggacaccctggtagtcaccaatgcagcaggagggctgaaccccaagtttgaggttggagatatcatgctgatccgtgaccatatcaacctacctggtttcagtggtcagaaccctctcagagggcccaatgatgaaaggtatgtatgttactccgttttttttaggtgggtaggatttaaagacttctctaggagctgtgggagaatttttaaaattccgtttatgtgagataattcaacctgtgtcctaggtttggagatcgtttccctgccatgtctgatgcctacgaccggactatgaggcagagggctctcagtacctggaaacaaatgggggagcaacgtgagctaca

SEQ ID NO: 16219 - DNA, 1635 bp, Homo sapiens
  ENST00000554056
gaaccagacccggcagccttgctcagttcagcatagcggagcggatccgatcggatcggagcggatcggagcacaccggagcaggctcatcgagaaggcgtctgcgagaccatggagaacggatacacctatgaagattataagaacactgcagaatggcttctgtctcacactaagcaccgacctcaagttgcaataatctgtggttctggattaggaggtctgactgataaattaactcaggcccagatctttgactacggtgaaatccccaactttccccgaagtacagtgccaggtcatgctggccgactggtgtttgggttcctgaatggcagggcctgtgtgatgatgcagggcaggttccacatgtatgaagggtacccactctggaaggtaagtcagagggataggtccggttggatctggaagaggcaggagagaactatctagcctctttcactacctagctatctgggctaggtggatttttggtcctctccttccttttctttcacgatgtatgtcatgcatttcagtgtagctgaattaatgaaattttgtaaatttttttcggattgtttgcttcgaaggtgacattcccagtgagggttttccaccttctgggtgtggacaccctggtagtcaccaatgcagcaggagggctgaaccccaagtttgaggttggagatatcatgctgatccgtgaccatatcaacctacctggtttcagtggtcagaaccctctcagagggcccaatgatgaaaggtttggagatcgtttccctgccatgtctgatgcctacgaccggactatgaggcagagggctctcagtacctggaaacaaatgggggagcaacgtgagctacaggaaggcacctatgtgatggtggcaggccccagctttgagactgtggcagaatgtcgtgtgctgcagaagctgggagcagacgctgttggcatgagtacagtaccagaagttatcgttgcacggcactgtggacttcgagtctttggcttctcactcatcactaacaaggtcatcatggattatgaaagcctggagaaggccaaccatgaagaagtcttagcagctggcaaacaagctgcacagaaattggaacagtttgtctccattcttatggccagcattccactccctgacaaagccagttgacctgccttggagtcgtctggcatctcccacacaagacccaagtagctgctaccttctttggccccttgctggagtcatgtgcctctgtccttaggttgtagcagaaaggaaaagattcctgtccttcacctttcccactttcttctaccagacccttctggtgccagatcctcttctcaaagctgggattacaggtgtgagcatagtgagaccttggcgctacaaaataaagctgttctcattcctgttctttcttacacaagagctggagcccgtgccctaccacacatctgtggagatgcccaggatttgactcgggccttagaactttgcatagcagctgctactagctctttgagataatacattccgaggggctcagttctgccttatctaaatcaccagagaccaaacaaggactaatccaatacctcttggattttatttaatgtcataa

SEQ ID NO: 16220 - DNA, 770 bp, Homo sapiens
  ENST00000553591
gagggcaccaggcccgcaggacccttggggaggggcaggtgctgtgacccgggaacctggcacactgggcccagagggagctggcggagggagcgagcgcccaggggatgcagagaggcctggcactgagcctagtgtcgggagcaaggcggcagagtcatgcggcagccagcgcgggcagggacgcacgcgggaatcgagctggggtggcgccaccggagcaggaaggggacagatacacctatgaagattataagaacactgcagaatggcttctgtctcacactaagcaccgacctcaagttgcaataatctgtggttctggattaggaggtctgactgataaattaactcaggcccagatctttgactacggtgaaatccccaactttccccgaagtacagtgccaggtcatgctggccgactggtgtttgggttcctgaatggcagggcctgtgtgatgatgcagggcaggttccacatgtatgaagggtacccactctggaaggtgacattcccagtgagggttttccaccttctgggtgtggacaccctggtagtcaccaatgcagcaggagggctgaaccccaagtttgaggttggagatatcatgctgatccgtgaccatatcaacctacctggtttcagtggtcagaaccctctcagagggcccaatgatgaaaggtttggagatcgtttccctgccatgtctgatgcctacgaccggactatgaggcagagggctctcagtacctggaaacaaatgggg

SEQ ID NO: 16221 - DNA, 554 bp, Homo sapiens
  ENST00000554065
ttggttagttgtgttcagctctgtcacacctcattgccacctctgaaagcaacgtttggtcttcccagatggatgtgagagaactggacttggaactgggagaaaagtaacacgggttgattcttgctagtgtaggggttctggatacacctatgaagattataagaacactgcagaatggcttctgtctcacactaagcaccgacctcaagttgcaataatctgtggttctggattaggaggtctgactgataaattaactcaggcccagatctttgactacggtgaaatccccaactttccccgaagtacagtgccaggtcatgctggccgactggtgtttgggttcctgaatggcagggcctgtgtgatgatgcagggcaggttccacatgtatgaagggtacccactctggaaggtgacattcccagtgagggttttccaccttctgggtgtggacaccctggtagtcaccaatgcagcaggagggctgaaccccaagtttgaggttggagatatcatgctgatccgtgaccatatcaacctacctggtt

SEQ ID NO: 16222 - DNA, 2573 bp, Homo sapiens
  ENST00000556754
cttgcatgcgttcaaattctttcccccttgttcagtagcctcttctttaagaagccagagtaagtatactatgagcttgcttgctggactgaggaggcaggtaattaagttagggcaatagataagaatacatgttttgagaactttgaaaaatttgaagaggtctataattactgcattcactgtactcactttattttgaaacagagtctcgctctgtcacccaggctcgagtgtagtgttgtgatctcggctcactgcaacctccacctcccaagttcaagagattctcccacctcagcctcccgagtagctgggattacaggcatgtgccaccacacctggctaatttttgtatttttagtagagatgaggtttcaccatgttggccagggtggtcttgaactcctggcctgttgatccgcctgtcttgggctcccgaagtgctgggactacaggtgtgagacaccgcacctggcctatttttaattttaatttttatagatttacaggggtacaatgcagttttgttatatggatatactgcgtggtggtgacgtctgtgctttagtgtaaccatcacctgagcagtgaacattgtacttattaggtaatttctcatccctcatccccatcccactttctcacctttccgagtccccagtgtctattatttcactctgtaggtccatatgtacacatttggttcccacttataagtgagaacatgtagtatttaatcttccatttctgagtatctactttttttgctcactttttactctctggcagtatggcttgtattatcttgaaatttctttaaaaagcccttccttctttgtgtgttcatgctgaacatgctgaacgcaccccatatctctaatcttgggttgtatttgtataattattagtaatgcctggctctctcaccagacttaaactttctgaaagcagagataataatgagtcttttacttaattacaacctaacattttgagcagagcgagtaactcacagtaggtgcttaatggatatgtgttgcatgaaaatataatcccattcatttctctttctgttttgtatacagtgccaggtcatgctggccgactggtgtttgggttcctgaatggcagggcctgtgtgatgatgcagggcaggttccacatgtatgaagggtacccactctggaaggtaagtcagagggataggtccggttggatctggaagaggcaggagagaactatctagcctctttcactacctagctatctgggctaggtggatttttggtcctctccttccttttctttcacgatgtatgtcatgcatttcagtgtagctgaattaatgaaattttgtaaatttttttcggattgtttgcttcgaaggtgacattcccagtgagggttttccaccttctgggtgtggacaccctggtagtcaccaatgcagcaggagggctgaaccccaagtttgaggttggagatatcatgctgatccgtgaccatatcaacctacctggtttcagtggtcagaaccctctcagagggcccaatgatgaaaggtatgtatgttactccgttttttttaggtgggtaggatttaaagacttctctaggagctgtgggagaatttttaaaattccgtttatgtgagataattcaacctgtgtcctaggtttggagatcgtttccctgccatgtctgatgcctacgaccggactatgaggcagagggctctcagtacctggaaacaaatgggggagcaacgtgagctacaggaaggcacctatgtgatggtggcaggccccagctttgagactgtggcagaatgtcgtgtgctgcagaagctgggagcagacgctgttggcatgagtacagtaccagaagttatcgttgcacggcactgtggacttcgagtctttggcttctcactcatcactaacaaggtcatcatggattatgaaagcctggagaaggccaaccatgaagaagtcttagcagctggcaaacaagctgcacagaaattggaacagtttgtctccattcttatggccagcattccactccctgacaaagccagttgacctgccttggagtcgtctggcatctcccacacaagacccaagtagctgctaccttctttggccccttgctggagtcatgtgcctctgtccttaggttgtagcagaaaggaaaagattcctgtccttcacctttcccactttcttctaccagacccttctggtgccagatcctcttctcaaagctgggattacaggtgtgagcatagtgagaccttggcgctacaaaataaagctgttctcattcctgttctttcttacacaagagctggagcccgtgccctaccacacatctgtggagatgcccaggatttgactcgggccttagaactttgcatagcagctgctactagctctttgagataatacattccgaggggctcagttctgccttatctaaatcaccagagaccaaacaaggactaatccaatacctcttggattttatttaatgtcataatgttgtcagaataaagagaaagatgaaat

SEQ ID NO: 16223 - DNA, 2805 bp, Homo sapiens
  ENST00000216180
atggtccgaggggggcggggctgacgtcgcgctgggaatgccctggccgagacactgaggcagggtagagagcgcttgcgggcgccgggcggagctgctgcggatcaggacccgagccgattcccgatcccgacccagatcctaacccgcgcccccgccccgccgccgccgccatgtacgacgcagagcgcggctggagcttgtccttcgcgggctgcggcttcctgggcttctaccacgtcggggcgacccgctgcctgagcgagcacgccccgcacctcctccgcgacgcgcgcatgttgttcggcgcttcggccggggcgttgcactgcgtcggcgtcctctccggtatcccgctggagcagactctgcaggtcctctcagatcttgtgcggaaggccaggagtcggaacattggcatcttccatccatccttcaacttaagcaagttcctccgacagggtctctgcaaatgcctcccggccaatgtccaccagctcatctccggcaaaataggcatctctcttaccagagtgtctgatggggaaaacgttctggtgtctgactttcggtccaaagacgaagtcgtggatgccttggtatgttcctgcttcatccccttctacagtggccttatccctccttccttcagaggcgtgcgatatgtggatggaggagtgagtgacaacgtacccttcattgatgccaaaacaaccatcaccgtgtcccccttctatggggagtacgacatctgccctaaagtcaagtccacgaactttcttcatgtggacatcaccaagctcagtctacgcctctgcacagggaacctctaccttctctcgagagcttttgtccccccggatctcaaggtgctgggagagatatgccttcgaggatatttggatgcattcaggttcttggaagagaagggcatctgcaacaggccccagccaggcctgaagtcatcctcagaagggatggatcctgaggtcgccatgcccagctgggcaaacatgagtctggattcttccccggagtcggctgccttggctgtgaggctggagggagatgagctgctagaccacctgcgtctcagcatcctgccctgggatgagagcatcctggacaccctctcgcccaggctcgctacagcactgagtgaagaaatgaaagacaaaggtggatacatgagcaagatttgcaacttgctacccattaggataatgtcttatgtaatgctgccctgtaccctgcctgtggaatctgccattgcgattgtccagagactggtgacatggcttccagatatgcccgacgatgtcctgtggttgcagtgggtgacctcacaggtgttcactcgagtgctgatgtgtctgctccccgcctccaggtcccaaatgccagtgagcagccaacaggcctccccatgcacacctgagcaggactggccctgctggactccctgctcccccaagggctgtccagcagagaccaaagcagaggccaccccgcggtccatcctcaggtccagcctgaacttcttcttgggcaataaagtacctgctggtgctgaggggctctccacctttcccagtttttcactagagaagagtctgtgagtcacttgaggaggcgagtctagcagattctttcagaggtgctaaagtttcccatctttgtgcagctacctccgcattgctgtgtagtgacccctgcctgtgacgtggaggatcccagcctctgagctgagttggttttatgaaaagctaggaagcaacctttcgcctgtgcagcggtccagcacttaactctaatacatcagcatgcgttaattcagctggttgggaaatgacaccaggaagcccagtgcagagggtcccttactgactgtttcgtggccctattaatggtcagactgttccagcatgaggttcttagaatgacaggtgtttggatgggtgggggccttgtgatggggggtaggctggcccatgtgtgatcttgtggggtggagggaagagaatagcatgatcccacttccccatgctgtgggaaggggtgcagttcgtccccaagaacgacactgcctgtcaggtggtctgcaaagatgataaccttgactactaaaaacgtctccatggcgggggtaacaagatgataatctacttaattttagaacacctttttcacctaactaaaataatgtttaaagagttttgtataaaaatgtaaggaagcgttgttacctgttgaattttgtattatgtgaatcagtgagatgttagtagaataagccttaaaaaaaaaaaaatcggttgggtgcagtggcacacggctgtaatcccagcactttgggaggccaaggttggcagatcacctgaggtcaggagttcaagaccagtctggccaacatagcaaaaccctgtctctactaaaaatacaaaaattatctgggcatggtggtgcatgcctgtaatcccagctattcggaaggctgaggcaggagaatcacttgaacccaggaggcggaggttgcggtgagctgagattgcaccatttcattccagcctgggcaacatgagtgaaagtctgactcaaaaaaaaaaaatttaaaaaacaaaataatctagtgtgcagggcattcacctcagccccccaggcaggagccaagcacagcaggagcttccgcctcctctccactggagcacacaacttgaacctggcttattttctgcagggaccagccccacatggtcagtgagtttctccccatgtgtggcgatgagagagtgtagaaataaagac

SEQ ID NO: 16224 - DNA, 1480 bp, Homo sapiens
  ENST00000406117
actgaggcagggtagagagcgcttgcgggcgccgggcggagctgctgcggatcaggacccgagccgattcccgatcccgacccagatcctaacccgcgcccccgccccgccgccgccgccatgtacgacgcagagcgcggctggagcttgtccttcgcgggctgcggcttcctgggcttctaccacgtcggggcgacccgctgcctgagcgagcacgccccgcacctcctccgcgacgcgcgcatgttgttcggcgcttcggccggggcgttgcactgcgtcggcgtcctctccggtatcccgctggactctgcaggtcctctcagatcttgtgcggaaggccaggagtcggaacattggcatcttccatccatccttcaacttaagcaagttcctccgacagggtctctgcaaatgcctcccggccaatgtccaccagctcatctccggcaaaataggcatctctcttaccagagtgtctgatggggaaaacgttctggtgtctgactttcggtccaaagacgaagtcgtggatgccttggtatgttcctgcttcatccccttctacagtggccttatccctccttccttcagaggcgtgcgatatgtggatggaggagtgagtgacaacgtacccttcattgatgccaaaacaaccatcaccgtgtcccccttctatggggagtacgacatctgccctaaagtcaagtccacgaactttcttcatgtggacatcaccaagctcagtctacgcctctgcacagggaacctctaccttctctcgagagcttttgtccccccggatctcaaggtgctgggagagatatgccttcgaggatatttggatgcattcaggttcttggaagagaagggcatctgcaacaggccccagccaggcctgaagtcatcctcagaagggatggatcctgaggtcgccatgcccagctgggcaaacatgagtctggattcttccccggagtcggctgccttggctgtgaggctggagggagatgagctgctagaccacctgcgtctcagcatcctgccctgggatgagagcatcctggacaccctctcgcccaggctcgctacagcactgagtgaagaaatgaaagacaaaggtggatacatgagcaagatttgcaacttgctacccattaggataatgtcttatgtaatgctgccctgtaccctgcctgtggaatctgccattgcgattgtccagagactggtgacatggcttccagatatgcccgacgatgtcctgtggttgcagtgggtgacctcacaggtgttcactcgagtgctgatgtgtctgctccccgcctccagagtttggagcctcttccatcaagtggacctgattttggaggattaggagaagaagctgaatttgttgaagttgagcctgaagctaaacaggaaattcttgaaaacaaagatgtggttgttcaacatgttcattttgatggacttggaa

SEQ ID NO: 16225 - DNA, 2222 bp, Homo sapiens
  ENST00000423180
gtagagagcgcttgcgggcgccgggcggagctgctgcggatcaggacccgagccgattcccgatcccgacccagatcctaacccgcgcccccgccccgccgccgccgccatgtacgacgcagagcgcggctggagcttgtccttcgcgggctgcggcttcctgggcttctaccacgtcggggcgacccgctgcctgagcgagcacgccccgcacctcctccgcgacgcgcgcatgttgttcggcgcttcggccggggcgttgcactgcgtcggcgtcctctccgagcagactctgcaggtcctctcagatcttgtgcggaaggccaggagtcggaacattggcatcttccatccatccttcaacttaagcaagttcctccgacagggtctctgcaaatgcctcccggccaatgtccaccagctcatctccggcaaaataggcatctctcttaccagagtgtctgatggggaaaacgttctggtgtctgactttcggtccaaagacgaagtcgtggatgccttggtatgttcctgcttcatccccttctacagtggccttatccctccttccttcagaggcgtgcgatatgtggatggaggagtgagtgacaacgtacccttcattgatgccaaaacaaccatcaccgtgtcccccttctatggggagtacgacatctgccctaaagtcaagtccacgaactttcttcatgtggacatcaccaagctcagtctacgcctctgcacagggaacctctaccttctctcgagagcttttgtccccccggatctcaaggtgctgggagagatatgccttcgaggatatttggatgcattcaggttcttggaagagaagggcatctgcaacaggccccagccaggcctgaagtcatcctcagaagggatggatcctgaggtcgccatgcccagctgggcaaacatgagtctggattcttccccggagtcggctgccttggctgtgaggctggagggagatgagctgctagaccacctgcgtctcagcatcctgccctgggatgagagcatcctggacaccctctcgcccaggctcgctacagcactgagtgaagaaatgaaagacaaaggtggatacatgagcaagatttgcaacttgctacccattaggataatgtcttatgtaatgctgccctgtaccctgcctgtggaatctgccattgcgattgtccagagactggtgacatggcttccagatatgcccgacgatgtcctgtggttgcagtgggtgacctcacaggtgttcactcgagtgctgatgtgtctgctccccgcctccaggtcccaaatgccagtgagcagccaacaggcctccccatgcacacctgagcaggactggccctgctggactccctgctcccccaagggctgtccagcagagaccaaagcagaggccaccccgcggtccatcctcaggtccagcctgaacttcttcttgggcaataaagtacctgctggtgctgaggggctctccacctttcccagtttttcactagagaagagtctgtgagtcacttgaggaggcgagtctagcagattctttcagaggtgctaaagtttcccatctttgtgcagctacctccgcattgctgtgtagtgacccctgcctgtgacgtggaggatcccagcctctgagctgagttggttttatgaaaagctaggaagcaacctttcgcctgtgcagcggtccagcacttaactctaatacatcagcatgcgttaattcagctggttgggaaatgacaccaggaagcccagtgcagagggtcccttactgactgtttcgtggccctattaatggtcagactgttccagcatgaggttcttagaatgacaggtgtttggatgggtgggggccttgtgatggggggtaggctggcccatgtgtgatcttgtggggtggagggaagagaatagcatgatcccacttccccatgctgtgggaaggggtgcagttcgtccccaagaacgacactgcctgtcaggtggtctgcaaagatgataaccttgactactaaaaacgtctccatggcgggggtaacaagatgataatctacttaattttagaacacctttttcacctaactaaaataatgtttaaagagttttgtataaaaatgtaaggaagcgttgttacctgttgaattttgtattatgtgaatcagtgagatgttagtagaataagcctt

SEQ ID NO: 16226 - DNA, 730 bp, Homo sapiens
  ENST00000478713
ctgcccgggctccacgtgcggagtgggtgccccctaggccggggagcgggggatccccaggggtcgcggggccctggaggagcgggcatcggacgcggacacggcggggtgcatcccgagggccccctccgaggcagatgcttcctgcgggggcgctgttcctgggcccgggaagggggcgttggaaccccgagcggtccgggccgaagcctgggactctcagcagactctgcaggtcctctcagatcttgtgcggaaggccaggagtcggaacattggcatcttccatccatccttcaacttaagcaagttcctccgacagggtctctgcaaatgcctcccggccaatgtccaccagctcatctccggcaaaataggcatctctcttaccagagtgtctgatggggaaaacgttctggtgtctgactttcggtccaaagacgaagtcgtggatgccttggtatgttcctgcttcatccccttctacagtggccttatccctccttccttcagaggcgtgcgatatgtggatggaggagtgagtgacaacgtacccttcattgatgccaaaacaaccatcaccgtgtcccccttctatggggagtacgacatctgccctaaagtcaagtccacgaactttcttcatgtggacatcaccaagctcagtctacgcctctgcacagggaacctctaccttctctcgagagcttttgtccccccggatctcaag

SEQ ID NO: 16227 - DNA, 422 bp, Homo sapiens
  ENST00000497129
gacatcaccaagctcagtctacgcctctgcacagggaacctctaccttctctcgagagcttttgtccccccggatctcaaggtgctgggagagatatgccttcgaggatatttggatgcattcaggttcttggaagagaagggcatctgcaacaggccccagccaggcctgaagtcatcctcagaagggatggatcctgaggtcgccatgcccagctgggcaaacatgagtctggattcttccccggagtcggctgccttggctgtgaggctggagggagatgagctgctagaccacctgcgtctcagcatcctgccctgggatgagagcatcctggacaccctctcgcccaggctcgctacagctatgatattggaaatggacatgtcttttcaaggaaaataaaagcaggctttctggaa

SEQ ID NO: 16228 - DNA, 4268 bp, Homo sapiens
  ENST00000426128
gcgagtcgccgctgcagccctagtgactgcggcctgcatcccggtaagaccatgaattatggcatttcttaaatgaagcgttcaagaagtgagagaatgtcatagaaaataaatgatttttaagttatgtctattaatctgactgtagatatatatatttacctccttagtaatgcaagaagtgtttgtgggaagcagagaagcaagcaactgtatttcttgttctcacctaagcattactggaggataagccacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtatgtcccgtattaaaagtactttgaactctgtttcaaaggctgtttttggcaatcaaaatgaaatgatttcacgtttagctcaatttaagccaagttcccaaattttaagaaaagtatcggatagtggctggttaaaacagaaaaacatcaaacaagccatcaaatctctgaaaaaatatagtgacaaatcagcagaaaagagtccttttccagaagagaaaagtcacattatagacaaagaagaagatataggtaaacgcagtctttttcattacacaagttctataaccacaaaatttggagactcattctactttttatcaaatcatattaattcatatttcaaacgtaaggaaaaaatgtctcaacaaaaggaaaatgaacatttccgggacaaatcagaacttgaagataaaaaggtagaagaggggaaattaagatctccagatcctggcatcctggcttataagccaggctcagaatctgtacatacggtggacaagcctacaagtccttctgcgatacctgatgttcttcaagtttcaactaaacaaagtattgctaactttctttctcgtcccacggaaggtgtacaagctttagtaggtggttatattggtggacttgtccccaaattaaagtatgattcaaagagtcagtcagaagaacaggaagagcctgctaaaactgatcaggctgtcagcaaagacagaaatgcagaggagaaaaagcgtttatctcttcagcgagaaaagattatcgcaagggtgagtattgataacaggacccgggcattagttcaggcattaagaagaacaactgacccaaagctctgcattactagggttgaagaactgacttttcatcttctagaatttcctgaaggaaaaggagtggctgtcaaggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaacattcttaaggataggatgggatctgcactgatgattgaaacagcaagaaaccccacatgtcctaaggtagctgctgatggaggtttgcttctgaataacccttcggcattagctatgcatgagtgtaaatgtctttggccagatgtgccgttagagtgcatagtatccctgggcactggacgttatgagagtgatgtgagaaacacggtaacatacacaagcttgaaaactaaactttctaatgttatcaacagtgctacagatacagaagaagtccatataatgcttgatggcctgttacctcctgacacctattttagattcaatcctgtaatgtgtgaaaacatacctctagatgaaagtcgaaatgaaaagctggatcagctgcagttggaagggttgaaatacatagaaagaaatgaacaaaaaatgaaaaaagttgcaaaaatattaagtcaagaaaaaacaactctgcagaaaattaatgattggataaaattaaaaactgatatgtatgaaggacttccattcttttcaaaattgtgatgagtatatgcttatgttctcataaatgaaggtctgtttagaagatcaaccacattcaataaggaattgtggggttcgacatgagttaactttgaaatacgtatgaattctggagaatcctgaaaaagacggtgcttcaaccagcttgcatagcacagagaatattcttggttacagaattcatatgggaactaggcttttaagatgttaataattagctaagctttagtaacccttactgtgctagtagattttagtagatattggtgttatattgtttgatgtttgaaaatatattaatatatgtgccgaacaagaaaccgaaagctatattgtactgtgtatttttactttagtcctcataatcatgttgaatttatgtgatcattgattttatttcatatggaaaagctaatttcttcttaaatttacattacctaatattctcactagctatgttctccaatccacactgccttttattgtaatatcatctaaatagatgcagaaaaatggaattttctctattaaagtattttacatttgacataaaaaagaaccagatacagttttctattcagatatgtttattttaacattgtttggttaaaaaaggtgaagttccagtcaaccactttttacccctgaaatttcaagataatgctatattaacttttccagatctaacactagcttattcttccctgttataaaatggtttgaacttactgaggagatattcctatcattaacaaaaataaactatttaaataatctgttgttaaaaggctaatgtcattttaaaattaatttttgttcataatgtagctcccctttagcctttgaatacacctggcagcagtatgcttaaaaataagaagttagttgcctggcgcagtagctcacacctgtaatcccagcactttgggaggccgaggcaggcagatcacctgacgtcaggagtccaagaccagcctggccaacacggtgaaacctcgtctctaataaaaatacaaacattagcccggcatggtggtgcacacctatagtcccagctactcgggaggctaaggcaggagaatggcttgaacctgagagacggaggttgcagtgagccaaatagcgccagtgcactccagcctaggcgacacagcgagactccatctcaaaaaaaaaaaaaaaaaaaagaagaagttaggcttgttttaccttattaactcctttgaactgtctggatttcatggaagttggtaagatgcacttacatggaacattgttcatgccaaacaaactcatctttattgtatctatttgtcacataaatccttacatggaatgttttgatttcttaagaaaaatgaaacaaaggttagcgccccttgttttagacatacaaactaaagctagaccctgttgcccagatagtcatattgcttctttgcaatatcaattcacagaggctgtgagatgtggttcaaagagtggagtcgagagtctggatgctaatcctgcctttgctgcaagaacccttctgtttgttaccttgaggaaggcaaatgtctgtaggctttgcatatctcatttgtaaaatgaggaaaggtagctgtaaaattttctaacatccgaattatataaactttagacatagtataaaataggaaactaccaatgatttctaaagataatatagttctttcagaccacaaataatacataataacatgcaactaagaacaacttgtaaatgcaagaaaaaaacaaataattggaaatcagaatatttctgggaattcttcgtaataaagcaaatttcaagcacaataaagtaatatttatgcatatttacatatttgcacctcatcataaggtcactctagtcctaaactgatgtagttcatctgttttacagctgaagttaagtatgtcccttatttgtgcttggcttatttctttcttaaataatacattacacaagtgaa

SEQ ID NO: 16229 - DNA, 3490 bp, Homo sapiens
  ENST00000257694
acttccgctgggggcggagcggggcggggctgagtgggtggcgacctagctgctgcgccagtgtttgtgttggaagctcagctgatgcaggccggttggagtggacgtcattgccgggaacgagcgagtcgccgctgcagccctagtgactgcggcctgcatcccgattgtcttctcctccaaggtctacatgattacctgaagtttaataagtaagaccatgaattatggcatttcttaaatgaagcgttcaagaagtgagagaatgtcatagaaaataaatgatttttaagttatgtctattaatctgactgtagatatatatatttacctccttagtaatgcaagaagtgtttgtgggaagcagagaagcaagcaactgtatttcttgttctcacctaagcattactggaggataagccacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtatgtcccgtattaaaagtactttgaactctgtttcaaaggctgtttttggcaatcaaaatgaaatgatttcacgtttagctcaatttaagccaagttcccaaattttaagaaaagtatcggatagtggctggttaaaacagaaaaacatcaaacaagccatcaaatctctgaaaaaatatagtgacaaatcagcagaaaagagtccttttccagaagagaaaagtcacattatagacaaagaagaagatataggtaaacgcagtctttttcattacacaagttctataaccacaaaatttggagactcattctactttttatcaaatcatattaattcatatttcaaacgtaaggaaaaaatgtctcaacaaaaggaaaatgaacatttccgggacaaatcagaacttgaagataaaaaggtagaagaggggaaattaagatctccagatcctggcatcctggcttataagccaggctcagaatctgtacatacggtggacaagcctacaagtccttctgcgatacctgatgttcttcaagtttcaactaaacaaagtattgctaactttctttctcgtcccacggaaggtgtacaagctttagtaggtggttatattggtggacttgtccccaaattaaagtatgattcaaagagtcagtcagaagaacaggaagagcctgctaaaactgatcaggctgtcagcaaagacagaaatgcagaggagaaaaagcgtttatctcttcagcgagaaaagattatcgcaagggtgagtattgataacaggacccgggcattagttcaggcattaagaagaacaactgacccaaagctctgcattactagggttgaagaactgacttttcatcttctagaatttcctgaaggaaaaggagtggctgtcaaggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaacattcttaaggataggatgggatctgcactgatgattgaaacagcaagaaaccccacatgtcctaaggtagctgctgtaagtaccatagtaaatagagggataacacccaaagcttttgtgttcagaaactatggtcattttcctggaatcaactctcattatttgggaggctgtcagtataaaatgtggcaggccattagagcctcatctgctgctccaggctactttgcagaatatgcattgggaaatgatcttcatcaagatggaggtttgcttctgaataacccttcggcattagctatgcatgagtgtaaatgtctttggccagatgtgccgttagagtgcatagtatccctgggcactggacgttatgagagtgatgtgagaaacacggtaacatacacaagcttgaaaactaaactttctaatgttatcaacagtgctacagatacagaagaagtccatataatgcttgatggcctgttacctcctgacacctattttagattcaatcctgtaatgtgtgaaaacatacctctagatgaaagtcgaaatgaaaagctggatcagctgcagttggaagggttgaaatacatagaaagaaatgaacaaaaaatgaaaaaagttgcaaaaatattaagtcaagaaaaaacaactctgcagaaaattaatgattggataaaattaaaaactgatatgtatgaaggacttccattcttttcaaaattgtgatgagtatatgcttatgttctcataaatgaaggtctgtttagaagatcaaccacattcaataaggaattgtggggttcgacatgagttaactttgaaatacgtatgaattctggagaatcctgaaaaagacggtgcttcaaccagcttgcatagcacagagaatattcttggttacagaattcatatgggaactaggcttttaagatgttaataattagctaagctttagtaacccttactgtgctagtagattttagtagatattggtgttatattgtttgatgtttgaaaatatattaatatatgtgccgaacaagaaaccgaaagctatattgtactgtgtatttttactttagtcctcataatcatgttgaatttatgtgatcattgattttatttcatatggaaaagctaatttcttcttaaatttacattacctaatattctcactagctatgttctccaatccacactgccttttattgtaatatcatctaaatagatgcagaaaaatggaattttctctattaaagtattttacatttgacataaaaaagaaccagatacagttttctattcagatatgtttattttaacattgtttggttaaaaaaggtgaagttccagtcaaccactttttacccctgaaatttcaagataatgctatattaacttttccagatctaacactagcttattcttccctgttataaaatggtttgaacttactgaggagatattcctatcattaacaaaaataaactatttaaataatctgttgttaaaaggctaatgtcattttaaaattaatttttgttcataatgtagctcccctttagcctttga

SEQ ID NO: 16230 - DNA, 3530 bp, Homo sapiens
  ENST00000422087
acttccgctgggggcggagcggggcggggctgagtgggtggcgacctagctgctgcgccagtgtttgtgttggaagctcagctgatgcaggccggttggagtggacgtcattgccgggaacgagcgagtcgccgctgcagccctagtgactgcggcctgcatcccgattgtcttctcctccaaggtctacatgattacctgaagtttaataattttgcctttctagagtgttatacagctggaatcatactgctatggtccgaatgtttgtgcctctcaaaattcatgtggaaatcataaccgctaaagtgatggtattaagaggtaagaccatgaattatggcatttcttaaatgaagcgttcaagaagtgagagaatgtcatagaaaataaatgatttttaagttatgtctattaatctgactgtagatatatatatttacctccttagtaatgcaagaagtgtttgtgggaagcagagaagcaagcaactgtatttcttgttctcacctaagcattactggaggataagccacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtatgtcccgtattaaaagtactttgaactctgtttcaaaggctgtttttggcaatcaaaatgaaatgatttcacgtttagctcaatttaagccaagttcccaaattttaagaaaagtatcggatagtggctggttaaaacagaaaaacatcaaacaagccatcaaatctctgaaaaaatatagtgacaaatcagcagaaaagagtccttttccagaagagaaaagtcacattatagacaaagaagaagatataggtaaacgcagtctttttcattacacaagttctataaccacaaaatttggagactcattctactttttatcaaatcatattaattcatatttcaaacgtaaggaaaaaatgtctcaacaaaaggaaaatgaacatttccgggacaaatcagaacttgaagataaaaaggtagaagaggggaaattaagatctccagatcctggcatcctggcttataagccaggctcagaatctgtacatacggtggacaagcctacaagtccttctgcgatacctgatgttcttcaagtttcaactaaacaaagtattgctaactttctttctcgtcccacggaaggtgtacaagctttagtaggtggttatattggtggacttgtccccaaattaaagtatgattcaaagagtcagtcagaagaacaggaagagcctgctaaaactgatcaggctgtcagcaaagacagaaatgcagaggagaaaaagcgtttatctcttcagcgagaaaagattatcgcaagggtgagtattgataacaggacccgggcattagttcaggcattaagaagaacaactgacccaaagctctgcattactagggttgaagaactgacttttcatcttctagaatttcctgaaggaaaaggagtggctgtcaaggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaacattcttaaggataggatgggatctgcactgatgattgaaacagcaagaaaccccacatgtcctaaggtagctgctgtaagtaccatagtaaatagagggataacacccaaagcttttgtgttcagaaactatggtcattttcctggaatcaactctcattatttgggaggctgtcagtataaaatgtggcaggccattagagcctcatctgctgctccaggctactttgcagaatatgcattgggaaatgatcttcatcaagatggaggtttgcttctgaataacccttcggcattagctatgcatgagtgtaaatgtctttggccagatgtgccgttagagtgcatagtatccctgggcactggacgttatgagagtgatgtgagaaacacggtaacatacacaagcttgaaaactaaactttctaatgttatcaacagtgctacagatacagaagaagtccatataatgcttgatggcctgttacctcctgacacctattttagattcaatcctgtaatgtgtgaaaacatacctctagatgaaagtcgaaatgaaaagctggatcagctgcagttggaagggttgaaatacatagaaagaaatgaacaaaaaatgaaaaaagttgcaaaaatattaagtcaagaaaaaacaactctgcagaaaattaatgattggataaaattaaaaactgatatgtatgaaggacttccattcttttcaaaattgtgatgagtatatgcttatgttctcataaatgaaggtctgtttagaagatcaaccacattcaataaggaattgtggggttcgacatgagttaactttgaaatacgtatgaattctggagaatcctgaaaaagacggtgcttcaaccagcttgcatagcacagagaatattcttggttacagaattcatatgggaactaggcttttaagatgttaataattagctaagctttagtaacccttactgtgctagtagattttagtagatattggtgttatattgtttgatgtttgaaaatatattaatatatgtgccgaacaagaaaccgaaagctatattgtactgtgtatttttactttagtcctcataatcatgttgaatttatgtgatcattgattttatttcatatggaaaagctaatttcttcttaaatttacattacctaatattctcactagctatgttctccaatccacactgccttttattgtaatatcatctaaatagatgcagaaaaatggaattttctctattaaagtattttacatttgacataaaaaagaaccagatacagttttctattcagatatgtttattttaacattgtttggttaaaaaaggtgaagttccagtcaaccactttttacccctgaaatttcaagataatgctatattaacttttccagatctaacactagcttattcttccctgttataaaatggtttgaacttactgaggagatattcctatcattaacaaaaataaactatttaaataa

SEQ ID NO: 16231 - DNA, 3366 bp, Homo sapiens
  ENST00000453144
atgctctattgcgcatatctcggggcgggggaggaacggagattgacaaggaggcagaggcctgagcgaggcggaaaatcctcaccccggcccgcgggtagacccaaacttctagcgcgtcacttccgctgggggcggagcggggcggggctgagtgggtggcgacctagctgctgcgccagtgtttgtgttggaagctcagctgatgcaggccggttggagtggacgtcattgccgggaacgagcgagtcgccgctgcagccctagtgactgcggcctgcatcccgtaatgcaagaagtgtttgtgggaagcagagaagcaagcaactgtatttcttgttctcacctaagcattactggaggataagccacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtatgtcccgtattaaaagtactttgaactctgtttcaaaggctgtttttggcaatcaaaatgaaatgatttcacgtttagctcaatttaagccaagttcccaaattttaagaaaagtatcggatagtggctggttaaaacagaaaaacatcaaacaagccatcaaatctctgaaaaaatatagtgacaaatcagcagaaaagagtccttttccagaagagaaaagtcacattatagacaaagaagaagatataggtaaacgcagtctttttcattacacaagttctataaccacaaaatttggagactcattctactttttatcaaatcatattaattcatatttcaaacgtaaggaaaaaatgtctcaacaaaaggaaaatgaacatttccgggacaaatcagaacttgaagataaaaaggtagaagaggggaaattaagatctccagatcctggcatcctggcttataagccaggctcagaatctgtacatacggtggacaagcctacaagtccttctgcgatacctgatgttcttcaagtttcaactaaacaaagtattgctaactttctttctcgtcccacggaaggtgtacaagctttagtaggtggttatattggtggacttgtccccaaattaaagtatgattcaaagagtcagtcagaagaacaggaagagcctgctaaaactgatcaggctgtcagcaaagacagaaatgcagaggagaaaaagcgtttatctcttcagcgagaaaagattatcgcaagggtgagtattgataacaggacccgggcattagttcaggcattaagaagaacaactgacccaaagctctgcattactagggttgaagaactgacttttcatcttctagaatttcctgaaggaaaaggagtggctgtcaaggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaacattcttaaggataggatgggatctgcactgatgattgaaacagcaagaaaccccacatgtcctaaggtagctgctgtaagtaccatagtaaatagagggataacacccaaagcttttgtgttcagaaactatggtcattttcctggaatcaactctcattatttgggaggctgtcagtataaaatgtggcaggccattagagcctcatctgctgctccaggctactttgcagaatatgcattgggaaatgatcttcatcaagatggaggtttgcttctgaataacccttcggcattagctatgcatgagtgtaaatgtctttggccagatgtgccgttagagtgcatagtatccctgggcactggacgttatgagagtgatgtgagaaacacggtaacatacacaagcttgaaaactaaactttctaatgttatcaacagtgctacagatacagaagaagtccatataatgcttgatggcctgttacctcctgacacctattttagattcaatcctgtaatgtgtgaaaacatacctctagatgaaagtcgaaatgaaaagctggatcagctgcagttggaagggttgaaatacatagaaagaaatgaacaaaaaatgaaaaaagttgcaaaaatattaagtcaagaaaaaacaactctgcagaaaattaatgattggataaaattaaaaactgatatgtatgaaggacttccattcttttcaaaattgtgatgagtatatgcttatgttctcataaatgaaggtctgtttagaagatcaaccacattcaataaggaattgtggggttcgacatgagttaactttgaaatacgtatgaattctggagaatcctgaaaaagacggtgcttcaaccagcttgcatagcacagagaatattcttggttacagaattcatatgggaactaggcttttaagatgttaataattagctaagctttagtaacccttactgtgctagtagattttagtagatattggtgttatattgtttgatgtttgaaaatatattaatatatgtgccgaacaagaaaccgaaagctatattgtactgtgtatttttactttagtcctcataatcatgttgaatttatgtgatcattgattttatttcatatggaaaagctaatttcttcttaaatttacattacctaatattctcactagctatgttctccaatccacactgccttttattgtaatatcatctaaatagatgcagaaaaatggaattttctctattaaagtattttacatttgacataaaaaagaaccagatacagttttctattcagatatgtttattttaacattgtttggttaaaaaaggtgaagttccagtcaaccactttttacccctgaaatttcaagataatgctatattaacttttccagatctaacactagcttattcttccctgttataaaatggtttgaacttactgaggagatattcctatcattaacaaaaataaactatttaaataa

SEQ ID NO: 16232 - DNA, 3462 bp, Homo sapiens
  ENST00000436062
gtcatgctctattgcgcatatctcggggcgggggaggaacggagattgacaaggaggcagaggcctgagcgaggcggaaaatcctcaccccggcccgcgggtagacccaaacttctagcgcgtcacttccgctgggggcggagcggggcggggctgagtgggtggcgacctagctgctgcgccagtgtttgtgttggaagctcagctgatgcaggccggttggagtggacgtcattgccgggaacgagcgagtcgccgctgcagccctagtgactgcggcctgcatcccggtaagaccatgaattatggcatttcttaaatgaagcgttcaagaagtgagagaatgtcatagaaaataaatgatttttaagttatgtctattaatctgactgtagatatatatatttacctccttagtaatgcaagaagtgtttgtgggaagcagagaagcaagcaactgtatttcttgttctcacctaagcattactggaggataagccacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtatgtcccgtattaaaagtactttgaactctgtttcaaaggctgtttttggcaatcaaaatgaaatgatttcacgtttagctcaatttaagccaagttcccaaattttaagaaaagtatcggatagtggctggttaaaacagaaaaacatcaaacaagccatcaaatctctgaaaaaatatagtgacaaatcagcagaaaagagtccttttccagaagagaaaagtcacattatagacaaagaagaagatataggtaaacgcagtctttttcattacacaagttctataaccacaaaatttggagactcattctactttttatcaaatcatattaattcatatttcaaacgtaaggaaaaaatgtctcaacaaaaggaaaatgaacatttccgggacaaatcagaacttgaagataaaaaggtagaagaggggaaattaagatctccagatcctggcatcctggcttataagccaggctcagaatctgtacatacggtggacaagcctacaagtccttctgcgatacctgatgttcttcaagtttcaactaaacaaagtattgctaactttctttctcgtcccacggaaggtgtacaagctttagtaggtggttatattggtggacttgtccccaaattaaagtatgattcaaagagtcagtcagaagaacaggaagagcctgctaaaactgatcaggctgtcagcaaagacagaaatgcagaggagaaaaagcgtttatctcttcagcgagaaaagattatcgcaagggtgagtattgataacaggacccgggcattagttcaggcattaagaagaacaactgacccaaagctctgcattactagggttgaagaactgacttttcatcttctagaatttcctgaaggaaaaggagtggctgtcaaggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaacattcttaaggataggatgggatctgcactgatgattgaaacagcaagaaaccccacatgtcctaaggtagctgctgtaagtaccatagtaaatagagggataacacccaaagcttttgtgttcagaaactatggtcattttcctggaatcaactctcattatttgggaggctgtcagtataaaatgtggcaggccattagagcctcatctgctgctccaggctactttgcagaatatgcattgggaaatgatcttcatcaagatggaggtttgcttctgaataacccttcggcattagctatgcatgagtgtaaatgtctttggccagatgtgccgttagagtgcatagtatccctgggcactggacgttatgagagtgatgtgagaaacacggtaacatacacaagcttgaaaactaaactttctaatgttatcaacagtgctacagatacagaagaagtccatataatgcttgatggcctgttacctcctgacacctattttagattcaatcctgtaatgtgtgaaaacatacctctagatgaaagtcgaaatgaaaagctggatcagctgcagttggaagggttgaaatacatagaaagaaatgaacaaaaaatgaaaaaagttgcaaaaatattaagtcaagaaaaaacaactctgcagaaaattaatgattggataaaattaaaaactgatatgtatgaaggacttccattcttttcaaaattgtgatgagtatatgcttatgttctcataaatgaaggtctgtttagaagatcaaccacattcaataaggaattgtggggttcgacatgagttaactttgaaatacgtatgaattctggagaatcctgaaaaagacggtgcttcaaccagcttgcatagcacagagaatattcttggttacagaattcatatgggaactaggcttttaagatgttaataattagctaagctttagtaacccttactgtgctagtagattttagtagatattggtgttatattgtttgatgtttgaaaatatattaatatatgtgccgaacaagaaaccgaaagctatattgtactgtgtatttttactttagtcctcataatcatgttgaatttatgtgatcattgattttatttcatatggaaaagctaatttcttcttaaatttacattacctaatattctcactagctatgttctccaatccacactgccttttattgtaatatcatctaaatagatgcagaaaaatggaattttctctattaaagtattttacatttgacataaaaaagaaccagatacagttttctattcagatatgtttattttaacattgtttggttaaaaaaggtgaagttccagtcaaccactttttacccctgaaatttcaagataatgctatattaacttttccagatctaacactagcttattcttccctgttataaaatggtttgaacttactgaggagatat

SEQ ID NO: 16233 - DNA, 2326 bp, Homo sapiens
  ENST00000453085
aaggatgaaagcctgaactagagcagtggaaatgcgaatgtggagcagaggaacgattcaagaaattctgcggtaaaactcatcagacttcatgactgattaaagattgtcttctcctccaaggtctacatgattacctgaagtttaataataatgcaagaagtgtttgtgggaagcagagaagcaagcaactgtatttcttgttctcacctaagcattactggaggataagccacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtatgtcccgtattaaaagtactttgaactctgtttcaaaggctgtttttggcaatcaaaatgaaatgatttcacgtttagctcaatttaagccaagttcccaaattttaagaaaagtatcggatagtggctggttaaaacagaaaaacatcaaacaagccatcaaatctctgaaaaaatatagtgacaaatcagcagaaaagagtccttttccagaagagaaaagtcacattatagacaaagaagaagatataggtaaacgcagtctttttcattacacaagttctataaccacaaaatttggagactcattctactttttatcaaatcatattaattcatatttcaaacgtaaggaaaaaatgtctcaacaaaaggaaaatgaacatttccgggacaaatcagaacttgaagataaaaaggtagaagaggggaaattaagatctccagatcctggcatcctggcttataagccaggctcagaatctgtacatacggtggacaagcctacaagtccttctgcgatacctgatgttcttcaagtttcaactaaacaaagtattgctaactttctttctcgtcccacggaaggtgtacaagctttagtaggtggttatattggtggacttgtccccaaattaaagtatgattcaaagagtcagtcagaagaacaggaagagcctgctaaaactgatcaggctgtcagcaaagacagaaatgcagaggagaaaaagcgtttatctcttcagcgagaaaagattatcgcaagggtgagtattgataacaggacccgggcattagttcaggcattaagaagaacaactgacccaaagctctgcattactagggttgaagaactgacttttcatcttctagaatttcctgaaggaaaaggagtggctgtcaaggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaacattcttaaggataggatgggatctgcactgatgattgaaacagcaagaaaccccacatgtcctaaggtagctgctgtaagtaccatagtaaatagagggataacacccaaagcttttgtgttcagaaactatggtcattttcctggaatcaactctcattatttgggaggctgtcagtataaaatgtggcaggccattagagcctcatctgctgctccaggctactttgcagaatatgcattgggaaatgatcttcatcaagatggaggtttgcttctgaataacccttcggcattagctatgcatgagtgtaaatgtctttggccagatgtgccgttagagtgcatagtatccctgggcactggacgttatgagagtgatgtgagaaacacggtaacatacacaagcttgaaaactaaactttctaatgttatcaacagtgctacagatacagaagaagtccatataatgcttgatggcctgttacctcctgacacctattttagattcaatcctgtaatgtgtgaaaacatacctctagatgaaagtcgaaatgaaaagctggatcagctgcagttggaagggttgaaatacatagaaag

SEQ ID NO: 16234 - DNA, 711 bp, Homo sapiens
  ENST00000483879
gagtgggtggcgacctagctgctgcgccagtgtttgtgttggaagctcagctgatgcaggccggttggagtggacgtcattgccgggaacgagcgagtcgccgctgcagccctagtgactgcggcctgcatcccggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaacattcttaagtaagttacaattactctttttaaatcttctgattatataggtagtatgtgcatattataatttgaaaaatgtcaatattaaattatattcttgcatattataatttgaaaaatatcaagaatattaaattatttgactaattagagataaccactg

SEQ ID NO: 16235 - DNA, 660 bp, Homo sapiens
  ENST00000476592
agctcagctgatgcaggccggttggagtggacgtcattgccgggaacgagcgagtcgccgctgcagccctagtgactgcggcctgcatcccgattatcgcaagggtgagtattgataacaggacccgggcattagttcaggcattaagaagaacaactgacccaaagctctgcattactagggttgaagaactgacttttcatcttctagaatttcctgaaggaaaaggagtggctgtcaaggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaacattctta

SEQ ID NO: 16236 - DNA, 557 bp, Homo sapiens
  ENST00000462466
aatctgtcttataagattactgagaaagtaatgaacactgtcaccttggttgtcatgtggtgaactgcatgtattggttaataataatcatacattttcagtcttgatttgacaaaagcaacaaagtatcttttctctcaatataggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaac

SEQ ID NO: 16237 - DNA, 426 bp, Homo sapiens
  ENST00000489738
aggggctcgagaggcctggacctgtggcgcatcctcagtgaggagggccgccctgcatccgtcgccggccccggtctccaggggcctcacccgagtcatgccccgctattgcgcagcgatttgttgtaagaaccgccggggacgaaacaataaagaccggaagctgagtttttatccgaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggt

SEQ ID NO: 16238 - DNA, 735 bp, Homo sapiens
  ENST00000427008
ggaagctcagctgatgcaggccggttggagtggacgtcattgccgggaacgagcgagtcgccgctgcagccctagtaagaccatgaattatggcatttcttaaatgaagcgttcaagaagtgagagaatgtcatagaaaataaatgatttttaagttatgtctattaatctgactgtagatatatatatttacctccttagtaatgcaagaagtgtttgtgggaagcagagaagcaagcaactgtatttcttgttctcacctaagcattactggaggataagccacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtatgtcccgtattaaaagtactttgaactctgtttcaaaggctgtttttggcaatcaaaatgaaatgatttcacgtttagctcaatttaagccaagttcccaaattttaagaaaagtatcggatagtggctggttaaaacagaaaaacatcaaacaagccatcaaatctctgaaaaaatatagtgacaaatcagcagaaaagagtccttttccagaagagaaaagtcacattatagacaaagaagaagatataggtaaacgcagtctttttcattacac

SEQ ID NO: 16239 - DNA, 568 bp, Homo sapiens
  ENST00000415498
aggggatgaaagagcataagcggagagggaatggtggtgctctctccttgaccatactttagttaggctcctctgagccctcttcccaactaggcctcatccttgggcccctgtcttaggcctgctgagtccagttttagcaagaatcttgcaaagtcagtttagagagtatctcctagccttgataattgatcatctccgcctgtcttcagcaagaatcttagtgttatacagctggaatcatactgctatggtccgaatgtttgtgcctctcaaaattcatgtggaaatcataaccgctaaagtgatggtattaagaggtaagaccatgaattatggcatttcttaaatgaagcgttcaagaagtgagagaatgtcatagaaaataaatgatttttaagttatgtctattaatctgactgtagatatatatatttacctccttagtaatgcaagaagtgtttgtgggaagcagagaagcaagcaactgtatttcttgttctcacctaagcattactggaggataagccacatcagtctacaaagaggttttcatacaaacataata

SEQ ID NO: 16240 - DNA, 6751 bp, Homo sapiens
  ENST00000617998
gctcagaagcgccgagagcgcggccgggacggttggagaagaaggcggctcccggaagggggagagacaaactgccgtaacctctgccgttcaggaacccggttacttatttattcgttaccctttttcttcttcctcccccaaaaaccttttccttttcccttctttttttttcctttttgggagctgaaaaatttccggtaagggaaagaagggctcctttcgctccttatttccccgcctccttccctcccccaccttcccctcctccggctttttcctcccaactcggggaggtccttcccggtggccgccctgacgaggtctgagcacctaggcggaggcggcgcaggctttttgtagtgaggtttgcgcctgcgcagcgcgcctgcctccgccatgcacgggggtggccccccctcgggggacagcgcatgcccgctgcgcaccatcaagagagtccagttcggagtcctgagtccggatgaactgaagcgaatgtctgtgacggagggtggcatcaaatacccagagacgactgagggaggccgccccaagcttggggggctgatggacccgaggcagggggtgattgagcggactggccgctgccaaacatgtgcaggaaacatgacagagtgtcctggccactttggccacattgaactggccaagcctgtgtttcacgtgggcttcctggtgaagacaatgaaagttttgcgctgtgtctgcttcttctgctccaaactgcttgtggactctaacaacccaaagatcaaggatatcctggctaagtccaagggacagcccaagaagcggctcacacatgtctacgacctttgcaagggcaaaaacatatgcgagggtggggaggagatggacaacaagttcggtgtggaacaacctgagggtgacgaggatctgaccaaagaaaagggccatggtggctgtgggcggtaccagcccaggatccggcgttctggcctagagctgtatgcggaatggaagcacgttaatgaggactctcaggagaagaagatcctgctgagtccagagcgagtgcatgagatcttcaaacgcatctcagatgaggagtgttttgtgctgggcatggagccccgctatgcacggccagagtggatgattgtcacagtgctgcctgtgcccccgctctccgtgcggcctgctgttgtgatgcagggctctgcccgtaaccaggatgacctgactcacaaactggctgacatcgtgaagatcaacaatcagctgcggcgcaatgagcagaacggcgcagcggcccatgtcattgcagaggatgtgaagctcctccagttccatgtggccaccatggtggacaatgagctgcctggcttgccccgtgccatgcagaagtctgggcgtcccctcaagtccctgaagcagcggttgaagggcaaggaaggccgggtgcgagggaacctgatgggcaaaagagtggacttctcggcccgtactgtcatcacccccgaccccaacctctccattgaccaggttggcgtgccccgctccattgctgccaacatgacctttgcggagattgtcacccccttcaacattgacagacttcaagaactagtgcgcagggggaacagccagtacccaggcgccaagtacatcatccgagacaatggtgatcgcattgacttgcgtttccaccccaagcccagtgaccttcacctgcagaccggctataaggtggaacggcacatgtgtgatggggacattgttatcttcaaccggcagccaactctgcacaaaatgtccatgatggggcatcgggtccgcattctcccatggtctacctttcgcttgaatcttagtgtgacaactccgtacaatgcagactttgacggggatgagatgaacttgcacctgccacagtctctggagacgcgagcagagatccaggagctggccatggttcctcgcatgattgtcaccccccagagcaatcggcctgtcatgggtattgtgcaggacacactcacagcagtgcgcaaattcaccaagagagacgtcttcctggagcggggtgaagtgatgaacctcctgatgttcctgtcgacgtgggatgggaaggtcccacagccggccatcctaaagccccggcccctgtggacaggcaagcaaatcttctccctcatcatacctggtcacatcaattgtatccgtacccacagcacccatcccgatgatgaagacagtggcccttacaagcacatctctcctggggacaccaaggtggtggtggagaatggggagctgatcatgggcatcctgtgtaagaagtctctgggcacgtcagctggctccctggtccacatctcctacctagagatgggtcatgacatcactcgcctcttctactccaacattcagactgtcattaacaactggctcctcatcgagggtcatactattggcattggggactccattgctgattctaagacttaccaggacattcagaacactattaagaaggccaagcaggacgtaatagaggtcatcgagaaggcacacaacaatgagctggagcccaccccagggaacactctgcggcagacgtttgagaatcaggtgaaccgcattcttaacgatgcccgagacaagactggctcctctgctcagaaatccctgtctgaatacaataacttcaagtctatggtcgtgtccggagctaaaggttccaagattaacatctcccaggtcattgctgtcgttggacagcagaacgtcgagggcaagcggattccatttggcttcaagcaccggactctgcctcacttcatcaaggatgactacgggcctgagagccgtggctttgtggagaactcctacctagccggcctcacacccactgagttctttttccacgccatggggggtcgtgaggggctcattgacacggctgtcaagactgctgagactggatacatccagcggcggctgatcaagtccatggagtcagtgatggtgaagtacgacgcgactgtgcggaactccatcaaccaggtggtgcagctgcgctacggcgaagacggcctggcaggcgagagcgttgagttccagaacctggctacgcttaagccttccaacaaggcttttgagaagaagttccgctttgattataccaatgagagggccctgcggcgcactctgcaggaggacctggtgaaggacgtgctgagcaacgcacacatccagaacgagttggagcgggaatttgagcggatgcgggaggatcgggaggtgctcagggtcatcttcccaactggagacagcaaggtcgtcctcccctgtaacctgctgcggatgatctggaatgctcagaaaatcttccacatcaacccacgccttccctccgacctgcaccccatcaaagtggtggagggagtcaaggaattgagcaagaagctggtgattgtgaatggggatgacccactaagtcgacaggcccaggaaaatgccacgctgctcttcaacatccacctgcggtccacgttgtgttcccgccgcatggcagaggagtttcggctcagtggggaggccttcgactggctgcttggggagattgagtccaagttcaaccaagccattgcgcatcccggggaaatggtgggggctctggctgcgcagtcccttggagaacctgccacccagatgaccttgaataccttccactatgctggtgtgtctgccaagaatgtgacgctgggtgtgccccgacttaaggagctcatcaacatttccaagaagccaaagactccttcgcttactgtcttcctgttgggccagtccgctcgagatgctgagagagccaaggatattctgtgccgtctggagcatacaacgttgaggaaggtgactgccaacacagccatctactatgaccccaacccccagagcacggtggtggcagaggatcaggaatgggtgaatgtctactatgaaatgcctgactttgatgtggcccgaatctccccctggctgttgcgggtggagctggatcggaagcacatgactgaccggaagctcaccatggagcagattgctgaaaagatcaatgctggttttggtgacgacttgaactgcatctttaatgatgacaatgcagagaagctggtgctccgtattcgcatcatgaacagcgatgagaacaagatgcaagaggaggaagaggtggtggacaagatggatgatgatgtcttcctgcgctgcatcgagtccaacatgctgacagatatgaccctgcagggcatcgagcagatcagcaaggtgtacatgcacttgccacagacagacaacaagaagaagatcatcatcacggaggatggggaattcaaggccctgcaggagtggatcctggagacggacggcgtgagcttgatgcgggtgctgagtgagaaggacgtggaccccgtacgcaccacgtccaatgacattgtggagatcttcacggtgctgggcattgaagccgtgcggaaggccctggagcgggagctgtaccacgtcatctcctttgatggctcctatgtcaattaccgacacttggctctcttgtgtgataccatgacctgtcgtggccacttgatggccatcacccgacacggagtcaaccgccaggacacaggaccactcatgaagtgttcctttgaggaaacggtggacgtgcttatggaagcagccgcacacggtgagagtgaccccatgaagggggtctctgagaatatcatgctgggccagctggctccggccggcactggctgctttgacctcctgcttgatgcagagaagtgcaagtatggcatggagatccccaccaatatccccggcctgggggctgctggacccaccggcatgttctttggttcagcacccagtcccatgggtggaatctctcctgccatgacaccttggaaccagggtgcaacccctgcctatggcgcctggtcccccagtgttgggagtggaatgaccccaggggcagccggcttctctcccagtgctgcgtcagatgccagcggcttcagcccaggttactcccctgcctggtctcccacaccgggctccccggggtccccaggtccctcaagcccctacatcccttcaccaggtggtgccatgtctcccagctactcgccaacgtcacctgcctacgagccccgctctcctgggggctacacaccccagagtccctcttattcccccacttcaccctcctactcccctacctctccatcctattctccaaccagtcccaactatagtcccacatcacccagctattcgccaacgtcacccagctactcaccgacctctcccagctactcacccacctctcccagctactcgcccacctctcccagctactcgcccacctctcccagctactcacccacttcccctagctactcgcccacttcccctagctactcgccaacgtctcccagctactcgccgacatctcccagctactcgccaacttcacccagctattctcccacttctcccagctactcacctacctctccaagctattcacccacctcccccagctactcacccacttccccaagttactcacccaccagcccgaactattctccaaccagtcccaattacaccccaacatcacccagctacagcccgacatcacccagctattcacctactagtcccaactacacacctaccagccctaactacagcccaacctctccaagctactctccaacatcacccagctattccccgacctcaccaagttactccccttccagcccacgatacacaccacagtctccaacctataccccaagctcacccagctacagccccagctcgcccagctacagcccaacctcacccacaagtacaccccaaccagtccttcttacagtcccagctccccagagtataccccaacctctcccaagtactcacctaccagtcccaaatattcacccacctctcccaagtactcgcctaccagtcccacctattcacccaccaccccaaaatactccccaacatctcctacttattccccaacctctccagtctacaccccaacctctcccaagtactcacctactagccccacttactcgcccacttcccccaagtactcgcccaccagccccacctactcgcccacctcccccaaaggctcaacctactctcccacttcccctggttactcgcccaccagccccacctacagtctcacaagcccggctatcagcccggatgacagtgacgaggagaactgagggcacgtggggtgcggcagcgggctagggcccagggcagcttgcccgtgctgctgtgcagttcttgcctccctcacggggcgtcacccccagcccagctccgttgtacataaatgccttgtggcagagctcccggtgaacttctggatcccgtttctgatgcagactcttgtcttgttctccacttgtgctgttagaactcactggcccagtggtgttctcactcctaccccacccaccccctgcctgtccccaaattgaagatccttccttgcctgtggcttgatgcggggcgggtaaagggtattttaacttaggggtagttcctgctgtgagtggttacagctgatcctcgggaagaacaaagctaaagctgccttttgtctgttattttatttttttgaagtttaaataaagtttactaattttgaccaaaa

SEQ ID NO: 16241 - DNA, 2083 bp, Homo sapiens
  ENST00000572844
ccaccttcccctcctccggctttttcctcccaactcggggaggtccttcccggtggccgccctgacgaggtctgagcacctaggcggaggcggcgcaggctttttgtagtgaggtttgcgcctgcgcagcgcgcctgcctccgccatgcacgggggtggccccccctcgggggacagcgcatgcccgctgcgcaccatcaagagagtccagttcggagtcctgagtccggatgaactgaagcgaatgtctgtgacggagggtggcatcaaatacccagagacgactgagggaggccgccccaagcttggggggctgatggacccgaggcagggggtgattgagcggactggccgctgccaaacatgtgcaggaaacatgacagagtgtcctggccactttggccacattgaactggccaagcctgtgtttcacgtgggcttcctggtgaagacaatgaaagttttgcgctgtgtctgcttcttctgctccaaactgcttgtggactctaacaacccaaagatcaaggatatcctggctaagtccaagggacagcccaagaagcggctcacacatgtctacgacctttgcaagggcaaaaacatatgcgagggtggggaggagatggacaacaagttcggtgtggaacaacctgagggtgacgaggatctgaccaaagaaaagggccatggtggctgtgggcggtaccagcccaggatccggcgttctggcctagagctgtatgcggaatggaagcacgttaatgaggactctcaggagaagaagatcctgctgagtccagagcgagtgcatgagatcttcaaacgcatctcagatgaggagtgttttgtgctgggcatggagccccgctatgcacggccagagtggatgattgtcacagtgctgcctgtgcccccgctctccgtgcggcctgctgttgtgatgcagggctctgcccgtaaccaggatgacctgactcacaaactggctgacatcgtgaagatcaacaatcagctgcggcgcaatgagcagaacggcgcagcggcccatgtcattgcagaggatgtgaagctcctccagttccatgtggccaccatggtggacaatgagctgcctggcttgccccgtgccatgcagaagtctgggcgtcccctcaagtccctgaagcagcggttgaagggcaaggaaggccgggtgcgagggaacctgatgggcaaaagagtggacttctcggcccgtactgtcatcacccccgaccccaacctctccattgaccaggttggcgtgccccgctccattgctgccaacatgacctttgcggagattgtcacccccttcaacattgacagacttcaagaactagtgcgcagggggaacagccagtacccaggcgccaagtacatcatccgagacaatggtgatcgcattgacttgcgtttccaccccaagcccagtgaccttcacctgcagaccggctataaggtggaacggcacatgtgtgatggggacattgttatcttcaaccggcagccaactctgcacaaaatgtccatgatggggcatcgggtccgcattctcccatggtctacctttcgcttgaatcttagtgtgacaactccgtacaatgcagactttgacggggatgagatgaacttgcacctgccacagtctctggagacgcgagcagagatccaggagctggccatggttcctcgcatgattgtcaccccccagagcaatcggcctgtcatgggtattgtgcaggacacactcacagcagtgcgcaaattcaccaagagagacgtcttcctggagcgggtgtgtggtccaaatggaaacctggcttaagtgggcagtggggctctggggtgcaaggtggaggctagagaggaagagctgtgttttttttcctgacttacccagcagtggtctgtgagattgtcttttctggtgggcgaacaaaaagggggttaggaaaactcaggccaaaaaggtgtaaggcgttaattccccatttaattccttaaaatttcatgtaataccaggtattgcctgtaaaggaaagataaagggaaaaataagtaa

SEQ ID NO: 16242 - DNA, 532 bp, Homo sapiens
  ENST00000576952
caacctctccattgaccaggttggcgtgccccgctccattgctgccaacatgacctttgcggagattgtcacccccttcaacattgacagacttcaagaactagtgcgcagggggaacagccagtacccaggcgccaagtacatcatccgagacaatggtgatcgcattgacttgcgtttccaccccaagcccagtgaccttcacctgcagaccggctataaggcacgtagcaggccagggcctctctcagccacctgagcagaaagctttccaagatagggcaggctgggttaggccatctgagtctgtctcgttcattgggatccagacttgactgtcttgttaaaggctgttgctgcccaggtgtgcagggagctgttggtctctggcattcagggtgggggtggtataaacccggggcagcttgcatatggcagggaagagggatccgtggaggaacagtgcagaaggctttatgttcagaatctctcttgcttttcttctagactgagttccttgagattggtgaat

SEQ ID NO: 16243 - DNA, 702 bp, Homo sapiens
  ENST00000575547
ttttgtattttcagtagagatggggtttcaccatgttgaccaggctggtctcaaactcctgagcttaagtgacgtgcccgcctcagcctcccaaagtgcttggattataggtgtgagccactgcactggacttgcaaaggactttaggtccattgtccttttattcttagatacctccttcactgagaccttttccttacctcacctctctaggtggaacggcacatgtgtgatggggacattgttatcttcaaccggcagccaactctgcacaaaatgtccatgatggggcatcgggtccgcattctcccatggtctacctttcgcttgaatcttagtgtgacaactccgtacaatgcagactttgacggggatgagatgaacttgcacctgccacagtctctggagacgcgagcagagatccaggagctggccatggttcctcgcatgattgtcaccccccagagcaatcggcctgtcatgggtattgtgcaggacacactcacagcagtgcgcaaattcaccaagagagacgtcttcctggagcggggtgaagtgatgaacctcctgatgttcctgtcgacgtgggatgggaaggtcccacagccggccatcctaaagccccggcccctgtggacaggcaagcaaatcttctccctcatcatacctggtcacatcaattgtatccgtacccacagcacc

SEQ ID NO: 16244 - DNA, 245 bp, Homo sapiens
  ENST00000576114
ggggctcattgacacggctgtcaagactgctgagactggatacatccagcggcggctgatcaagtccatggagtcagtgatggtgaagtacgacgcgactgtgcggaactccatcaaccaggtggtgcagctgcgctacggcgaagacggcctggcaggcgagagcgttgagttccagaacctggctacgcttaagccttccaacaaggcttttgagaagaagtgaggaggcgggcaggcgggtg

SEQ ID NO: 16245 - DNA, 548 bp, Homo sapiens
  ENST00000576718
tataaagcagatgcagaggggtgggcctgtactcaggtcccagtggcagtccttgggcctgaatttttctctgtccaggattcttgcctccaaaccactgtacttggtcggctgtgcacctttgggaaccttacagtgcgttttgtggggaccaaggtcccagagcccacctgtccactagctaccccttgcacttccaggttccgctttgattataccaatgagagggccctgcggcgcactctgcaggaggacctggtgaaggacgtgctgagcaacgcacacatccagaacgagttggagcgggaatttgagcggatgcgggaggatcgggaggtgctcagggtcatcttcccaactggagacagcaaggtcgtcctcccctgtaacctgctgcggatgatctggaatgctcagaaaatcttccacatcaacccacgccttccctccgacctgcaccccatcaaagtggtggagggagtcaaggaattgagcaagaagctggtgattgtgaatggggatgacccactaagtcgacaggcccagga

SEQ ID NO: 16246 - DNA, 461 bp, Homo sapiens
  ENST00000574158
acctgctgcggatgatctggaatgctcagaaaatcttccacatcaacccacgccttccctccgacctgcaccccatcaaagtggtggagggagtcaaggaattgagcaagaagctggtgattgtgaatggggatgacccactaagtcgacaggcccaggaaaatgccacgctgctcttcaacatccacctgcggtccacgttgtgttcccgccgcatggcagaggagtttcggctcagtggggaggccttcgactggctgcttggggagattgagtccaagttcaaccaagccattgtgagtgttgtgctcttcacagcagtcttcttttcctccttttacctgttgacttctgtggtttccaagagcagcccacttctgtccacaacctacagaataggttctgtaggttctgtcccacctaataatagctctcattcatggagagactgcttgtacctt

SEQ ID NO: 16247 - DNA, 648 bp, Homo sapiens
  ENST00000573603
ccaaggatattctgtgccgtctggagcatacaacgttgaggaaggtgactgccaacacagccatctactatgaccccaacccccagagcacggtggtggcagaggatcaggaatgggtgaatgtctactatgaaatgcctgactttgatgtggcccgaatctccccctggctgttgcgggtggagctggatcggaagcacatgactgaccggaagctcaccatggagcagattgctgaaaagatcaatgctggttttggtgacgacttgaactgcatctttaatgatgacaatgcagagaagctggtgctccgtattcgcatcatgaacagcgatgagaacaagatgcaagaggtaatgggggtcctagaagtcagcgtgtcacatgtataaaacgcatgaatcacgttagagaccaaagaaaagaagatgcaatcaacattgaggggcggccaggcgcggtggctcacgcctgtaatcccagcactttgggaggctgaggcgggtggatcacctgagctcaggagttcgagaccagcctgaccaacatggagtaaccccgtctctactaaaaataaaaattagccgggcatggtggtatgtgcctgtaatcctagctacttgggaggctgaggcaacaagagtgaaa

SEQ ID NO: 16248 - DNA, 602 bp, Homo sapiens
  ENST00000576553
tgatgcgggtgctgagtgagaaggacgtggaccccgtacgcaccacgtccaatgacattgtggagatcttcacggtgctgggcattgaagccgtgcggaaggccctggagcgggagctgtaccacgtcatctcctttgatggctcctatgtcaattaccgacacttggctctcttgtgtgataccatgacctgtcgtggccacttgatggccatcacccgacacggagtcaaccgccaggacacaggaccactcatgaagtgttcctttgaggaaacggtggacgtgcttatggaagcagccgcacacggtgagagtgaccccatgaagggggtctctgagaatatcatgctgggccagctggctccggccggcactggctgctttgacctcctgcttgatgcagagaagtgcaagtatggcatggagatccccaccaatatccccggcctgggggctgctggacgtgagtatgaggccccagctgcggtacctgcttgcgtcggcgaggcgggggggcaggccatgggtgcaagggtgtcaccagtccatgattgctgttcttgctcctcacgatttcctgtgttcctctttgcagccacc

SEQ ID NO: 16249 - DNA, 2456 bp, Homo sapiens
  ENST00000464525
ggcggacacttggggtctggacgcaacggcggcgggagcatgaacgcccctccagccttcgagtcgttcttgctcttcgagggcgagaaacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccgggtgagggcggggcctggaggggcagacggggtgggctggacactggcccgtgtgcccaggcctgggacagccctggcctgtttcttcggaggtcctcagggagaggcggcggtgatggaagaacagggacttccaccacaggctccaggacatgtggactgaggggctgtggagtctgggcctgtggctcccgtctgccccatgggacttctgtagtgctgcagggtccctcgggtgctgtgggccagatccgggcggggacctactgtcctttgggggtgctcttctacgtcccttgtcggtgattggcaaggcctggtccttccaggcctctgggaggcagctcaccccagggtggcccacacctgttcctagcagggcgcctgggaatctagaacagtttagaggggaaagagccacagcaaagaaaagccgaggcagggtgatcacgaggtcaggagttcaagaccagcctggcaaacatggtgaagccctgtttctactaaaaatacaaaaattagctaggcatggtggcatgtgctgtagtcccagctactcgggaggctgaggcaggagaatcgcttgaacccgggaggcggaggttgcagtgagccgagattgtgccactgcactccagcctaggtaacagagcaggactccatctcagtcaatcaatcaatcaatcaatctcagcggttgaactacccttgacatggttcagctctgtatccacacccaaatgtcatgtcaaattgtaattcccagtgttgtgggagggacctggtgggaggtgattggctcatgggggccgacttcccccttgctgttctcgtgatattgagtgagcgcttgtgggatctggttgtttaaaagcgtgcagccctcccacttcactctctctgtctctcctgctccaacatggccagacgtgcctgcttccccttcgccttctgccgtgattgtcagtttcctgaggcctccccagccacgcttcctgtacagcctgcagaactctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaacaaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccctgaagcttctggaccctgagagagattgtttcttttctttactatttttttttttttttttgagacggagtctcactctgtcgccaggctggcgcgatcttggctcactgcaacctctgcctcacgggttcaagcgattttcctgcttcagcctcctgagtagctgggactacaggcacacgccaccatgcccagctcatttttgtatttttagtagagatggggtttcaccatgttggccaggatggcctccgtctcttgaccttgtgatccgcccgactcggcctcccaaaatgctgggattacaggcgtgagccatcaagtctggtgagagagattgtttctagatgagggtgggggcgggtgtccttagcccaaagcttgtgccagtctctatcagaaataaatgcccccaaaacctcc

SEQ ID NO: 16250 - DNA, 2553 bp, Homo sapiens
  ENST00000489144
cggcggtggcggacacttggggtctggacgcaacggcggcgggagcatgaacgcccctccagccttcgagtcgttcttgctcttcgagggcgagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccgggtgagggcggggcctggaggggcagacggggtgggctggacactggcccgtgtgcccaggcctgggacagccctggcctgtttcttcggaggtcctcagggagaggcggcggtgatggaagaacagggacttccaccacaggctccaggacatgtggactgaggggctgtggagtctgggcctgtggctcccgtctgccccatgggacttctgtagtgctgcagggtccctcgggtgctgtgggccagatccgggcggggacctactgtcctttgggggtgctcttctacgtcccttgtcggtgattggcaaggcctggtccttccaggcctctgggaggcagctcaccccagggtggcccacacctgttcctagcagggcgcctgggaatctagaacagtttagaggggaaagagccacagcaaagaaaagccgaggcagggtgatcacgaggtcaggagttcaagaccagcctggcaaacatggtgaagccctgtttctactaaaaatacaaaaattagctaggcatggtggcatgtgctgtagtcccagctactcgggaggctgaggcaggagaatcgcttgaacccgggaggcggaggttgcagtgagccgagattgtgccactgcactccagcctaggtaacagagcaggactccatctcagtcaatcaatcaatcaatcaatctcagcggttgaactacccttgacatggttcagctctgtatccacacccaaatgtcatgtcaaattgtaattcccagtgttgtgggagggacctggtgggaggtgattggctcatgggggccgacttcccccttgctgttctcgtgatattgagtgagcgcttgtgggatctggttgtttaaaagcgtgcagccctcccacttcactctctctgtctctcctgctccaacatggccagacgtgcctgcttccccttcgccttctgccgtgattgtcagtttcctgaggcctccccagccacgcttcctgtacagcctgcagaactctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaacaaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccctgaagcttctggaccctgagagagattgtttcttttctttactatttttttttttttttttgagacggagtctcactctgtcgccaggctggcgcgatcttggctcactgcaacctctgcctcacgggttcaagcgattttcctgcttcagcctcctgagtagctgggactacaggcacacgccaccatgcccagctcatttttgtatttttagtagagatggggtttcaccatgttggccaggatggcctccgtctcttgaccttgtgatccgcccgactcggcctcccaaaatgctgggattacaggcgtgagccatcaagtctggtgagagagattgtttctagatgagggtgggggcgggtgtccttagcccaaagcttgtgccagtctctatcagaaataaatgcccccaaaacctcc

SEQ ID NO: 16251 - DNA, 1598 bp, Homo sapiens
  ENST00000379340
cgcaacggcggcgggagcatgaacgcccctccagccttcgagtcgttcttgctcttcgagggcgagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccggacgtgcctgcttccccttcgccttctgccgtgattgtcagtttcctgaggcctccccagccacgcttcctgtacagcctgcagaactctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaacaaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccctgaagcttctggaccctgagagagattgtttcttttctttactatttttttttttttttttgagacggagtctcactctgtcgccaggctggcgcgatcttggctcactgcaacctctgcctcacgggttcaagcgattttcctgcttcagcctcctgagtagctgggactacaggcacacgccaccatgcccagctcatttttgtatttttagtagagatggggtttcaccatgttggccaggatggcctccgtctcttgaccttgtgatccgcccgactcggcctcccaaaatgctgggattacaggcgtgagccatcaagtctggtgagagagattgtttctagatgagggtgggggcgggtgtccttagcccaaagcttgtgccagtctctatcagaaataaatgcccccaaaacctc

SEQ ID NO: 16252 - DNA, 1532 bp, Homo sapiens
  ENST00000486319
acagggggcgatgagccgatccttgcgcgggtttgccccgccggagtaatccggaagaggcctcttattagggctctggtggcggcggtggcggacacttggggtctggacgcaacggcggcgggagcatgaacgcccctccagccttcgagtcgttcttgctcttcgagggcgagaagatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaactctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaacaaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccctgaagcttctggaccctgagagagattgtttcttttctttactatttttttttttttttttgagacggagtctcactctgtcgccaggctggcgcgatcttggctcactgcaacctctgcctcacgggttcaagcgattttcctgcttcagcctcctgagtagctgggactacaggcacacgccaccatgcccagctcatttttgtatttttagtagagatggggtttcaccatgttggccaggatggcctccgtctcttgaccttgtgatccgcccgactcggcctcccaaaatgctgggattacaggcgtgagccatcaagtctggtgagagagattgtttctagatgagggtgggggcgggtgtccttagcccaaagcttgtgccagtctctatcagaaataaatgcccccaaaacct

SEQ ID NO: 16253 - DNA, 875 bp, Homo sapiens
  ENST00000503564
tcttccctggcaagattcttctgaattgtgctgccttggccaaaagaggaggaactaccctgccctgacagaggctggggatgaaggaggaagagacagccggtcccctggataaagagctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaacaaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccc

SEQ ID NO: 16254 - DNA, 783 bp, Homo sapiens
  ENST00000511773
cccttcgccttctgccgtgattgtcagtttcctgaggcctccccagccacgcttcctgtacagcctgcagaactgaggaactaccctgccctgacagaggctggggatgaaggaggaagagacagccggtcccctggataaagagacactgcagacggacggacagacagatggacaacagctggaggcttggcccggccatagggctctctgcgggacagtcccagctgctagtgtcgctgttgctgctactgacccgtgtccagcctgggacagacgtggctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaacaaagtggtccagcgacactcgcctgcagcaagcccaggcacttcgggctgtccccggcccccagagcccgggcaccgtggtca

SEQ ID NO: 16255 - DNA, 1030 bp, Homo sapiens
  ENST00000508848
acttggggtctggacgcaacggcggcgggagcatgaacgcccctccagccttcgagtcgttcttgctcttcgagggcgagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccggacgtgcctgcttccccttcgccttctgccgtgattgtcagtttcctgaggcctccccagccacgcttcctgtacagcctgcagaacttctggcatggaaaagcccctgtgcaactggtaaagatatcaataagcaccaggaggtatctaaatccaccaggagccataggcatcacgttgacatccatttaccagtcttccctggcaagattcttctgaattgtgctgccttggccaaaagagctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaacaaagtggtccagcgacactcgcc

SEQ ID NO: 16256 - DNA, 958 bp, Homo sapiens
  ENST00000513506
cagcccaacagggggcgatgagccgatccttgcgcgggtttgccccgccggagtaatccggaagaggcctcttattagggctctggtggcggcggtggcggacacttggggtctggacgcaacggcggcgggagcatgaacgcccctccagccttcgagtcgttcttgctcttcgagggcgagaagatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaacttctggcatggaaaagcccctgtgcaactggtaaagatatcaataagcaccaggaggtatctaaatccaccaggagccataggcatcacgttgacatccatttaccagtcttccctggcaagattcttctgaattgtgctgccttggccaaaagagctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaacaaagtggtccagcgacactcgcc

SEQ ID NO: 16257 - DNA, 727 bp, Homo sapiens
  ENST00000504677
taggcatcacgttgacatccatttaccagtcttccctggcaagattcttctgaattgtgctgccttggccaaaagaggaggaactaccctgccctgacagaggctggggatgaaggaggaagagacagccggtcccctggataaagagcacagactacagacaggggagcctctggggctgcagacactgcagacggacggacagacagatggacaacagctggaggcttggcccggccatagggctctctgcgggacagtcccagctgctagtgtcgctgttgctgctactgacccgtgtccagcctgggacagacgtggctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacc

SEQ ID NO: 16258 - DNA, 793 bp, Homo sapiens
  ENST00000506060
atgaacgcccctccagccttcgagtcgttcttgctcttcgagggcgagaagtaagtgacgccggctgcggagggccgaggatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccggacgtgcctgcttccccttcgccttctgccgtgattgtcagtttcctgaggcctccccagccacgcttcctgtacagcctgcagaactctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggaccc

SEQ ID NO: 16259 - DNA, 769 bp, Homo sapiens
  ENST00000502415
taagtgacgccggctgcggagggccgaggatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaactgaggaactaccctgccctgacagaggctggggatgaaggaggaagagacagccggtcccctggataaagagcacagcacagactacagacaggggagcctctggggctgcagacactgcagacggacggacagacagatggacaacagctggaggcttggcccggccatagggctctctgcgggacagtcccagctgctagtgtcgctgttgctgctactgacccgtgtccagcctgggacagacgtggctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgataccc

SEQ ID NO: 16260 - DNA, 532 bp, Homo sapiens
  ENST00000507355
attagggctctggtggcggcggtggcggacacttggggtctggacgcaacggcggcgggagcatgaacgcccctccagccttcgagtcgttcttgctcttcgagggcgagaagatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaactatgatccgcccaccttggccacccaaagtgctgggattacaggtgtgaaccactgcgcccggccagaagtttttcttgtgagttgaggtgaacatctgaatcccctcggggaactgagactacagacaggggagcctctggggctgcagacactgcagacggacggacagacagatggacaacagctggaggcttggcccggccatagggctctctgcgggacagtcccagctgctagtgtcg

SEQ ID NO: 16261 - DNA, 544 bp, Homo sapiens
  ENST00000608621
attagggctctggtggcggcggtggcggacacttggggtctggacgcaacggcggcgggagcatgaacgcccctccagccttcgagtcgttcttgctcttcgagggcgagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccggacgtgcctgcttccccttcgccttctgccgtgattgtcagtttcctgaggcctccccagccacgcttcctgtacagcctgcagaactgaggacaacgtgatcactgtattcagctccatcaagaatggtccaggttcttctagatgatctgcacaaatggttcctct

SEQ ID NO: 16262 - DNA, 4630 bp, Homo sapiens
  ENST00000511313
attagggctctggtggcggcggtggcggacacttggggtctggacgcaacggcggcgggagcatgaacgcccctccagccttcgagtcgttcttgctcttcgagggcgagaagatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaactgtgagtcaattaaacctcttttcttcataaattacccagtttctcatagttctttatagcagtgtgaaaacagactaatggacccttctggttgaaggaatgcagccattctgcttgtttgactatgtcctttctattcatctctatttcctgggaggtgtttatccaagtgcaataggaggtattggtgaccgcacagtcccctcagtgttctgctagtaaatagttgaaggttgatcattgatcttctgcgttttcagtctggcatggaaaagcccctgtgcaactggtaaagatatcaataagcaccaggaggtatctaaatccaccaggagccataggcatcacgttgacatccatttaccagtcttccctggcaagattcttctgaattgtgctgccttggccaaaagaggtatgggaggggctgggcgcagtggcttgtgcctgtaatcccaacattttgggaaaccaattcaggtggatcgttagaggtcaggggttcaagaccatcctggccaacatggtgacatcccatctctactaaaaatacaataagttagctgggtttggtgttgggtgcctgtaatcccagctactcgagaggctgaggcaggataatcgcttgaacctgggaggaggaggtggcagtgagctgagatcgtgccattgcactccagcgtgggcaacaagagtgaaacgtcgtctcaaaaaataaaaaaaaggtccgggcttgatggctcacacctgtaatcccagcactttgggaggccaagacgggtggatcacgaggtcaggagttcaagaccagcctggcctagatggtgaaaccctgtctctactaaaactacaaatattagctgggcatggtggcatgcacctgtaatctcagctactcagaagtctgatgcaggagaattgctaaaacccaggagggagaggttgcagtgagccgagattgcaccactgcactctagcctgggcgacagagcaagactccgtctcgaaagaaagaaagaaagaaaggaaattccccagggaagtacctcggctgatttcataaacaggtaccgaaggaagcagaggcatgtggaggacttccccacctcatgcagctatttgggccatggcgtctgaaatttattatttcagagtcacccctttgatgaccttggcagtgaactgcagtcatctgtttaggcctttccatggcccacgtcaatgccgttatttctgtttgttgcacatttgatttccttgttgttggcatttagaaggccccctgcttcccagatcacaccacgggcatggaccacagagattgcatcttgtgagtctgtagaaatggtcaaggccttgtcctctcttaggtccagagctcaggtgaatgcagattttcccggccatctgtgctgaagtccctgtggggaggctcctggctggtttcctgtaggtagacagctacacgtcctgcccttcattggcttcttttcatgaagctcctgccatctacaaaacatgtctcccttcttgaatcacatctctgttattgaaactctagaagtcaaccgggcatggtggctatgcctataatcccagcattttgggatgccaaggcgggtggatcacctgaggtcaggagttcaagaccagcctgaccaacatggcgaaaccccgtctctaatacaaatacaaaaattagccaagcatggtggtcactgtactccagcctgggtgacagagcaagactccgtctcaaaaaaaaaaaagagaaagaaagtatcatgcttttctgcattctgtgaattgttttagtgagttatcgaacttgagggcatggtgggaacctccaaatttgcagccagttggtgagaagtacatgtggtctgaggacacccaagcctgcaggtgtgtctaaagcgagggcagcctagtggggactggtggccttaacctgtggcatttgaggtaacatcagggagttgacatcagaattgcatcacataggctgggcgcggtggctcacgcctgtaatcctagcactttgggaggccaaggcgggcagatcacgaggtcaggagatcgagaccatcctggctaagacagtgaaatcccgtctctactaaaaattcaaaaaattagccaggcatggtggcgggcgcctgtagtcccagctactcgggaggctgaggcaggagaatggcgtgaacccaggaggcagagcttgcattgagccaagatcacgccaccgcactccagcctgggtgacagagcgagactccatcccccccaaaaagaaaaaagacaaaaaaaaaattgtgtcacacaggccagatgcagtggctcatgcttataatcccagcaatttgaaaggcaaggtaagaggatcgcttgagcttgagtctgaggccgcagtgagctatgaccacaccactgcaccccagtctgggtgacagcgcaagaccccaactccaaaaaggaaaaagaaaaatcacaaggaattgcatgtcagagtgcctgtctttcacagctttaactgctgcaggaacgaactttttttttttttttttttttgagagggggtgaggagacacaatctctgctagtgattctcctgcctcagcctcccaaatagctgggattataggcgtgcaccaccacgcctgcctaatttttgtatttttagtagagacagggtttcaccatgttggccaggctggtctcaaactcctgctgggatcatgggcgtgagccaccacgcccggccacctttagagttttcttaccacctggttttcctctctcaatatctttctctcatttcctgccttaaaactctagcttggcatctgggcgcagtagctcatgcctgtaatcccagcactttgggaggccgaggtaggtggatcacttgaagtcaggagttcgagaccagcctggccaacatggtgaaaccttgtctctactatttttacaaaagttagtcggacgtacagacgggtgcctgtagtcccagctacttgggaggctgaggcaggagaatttgtttgaacccagaggtgaaagttgcagggagccgaggttgtgccactgcactccagcctgggagacagagcaagactctgtctccaaaacaaacaaacaaacaaaaaaaccctgtagcttgggatcagccttctcttctattgtttttctttaaaaaataaaaattaaaaatagatgtagatgctatgttgctgaggctggcctcaaactcctggcctcaggtgatcctcccgccatgacctccaaaaccacagggattgtaggtgtgagcactgcacccagccttatgtttttttctacataaaaaacagcacaggattatcttccagagctaataaatatgttcaaataaccacaaccccattaaggaaaaatatcactgggcagcaaataatcaatccagaccaatatgatcacaattgctgtgaaggtgagaaaagttcatttttattatgtttccccaagagacgcactctattgttctcttgaaaacacacagctcatgtcctcctttagaacacacatcctctttaaagtaacatacaaacatgccaaaacaaggtaaaaaattacatctgaattctcacatttcaaatatatatgaaatatcaaataaaaatttatttttacaagaatttaggggaactactacatagctataaatgtaatatatatgttaactaagtatcatagataaaaaccatgctcccttcagcagcacgtgtaataatagatacaaagattgaaaggtaaaagatttaggatgaaaagaatcctctcttaaaaaggaaaacaaaattatatgtatgtgtatataacagttataatatccatcacacagctttatagaaacagcatctattcaaaaataccagtatttccaaaatatttaaaataatatttaaagtaataataatatttaaataaataaatatatttaataaatatttaaataaataaaataatatttaaataattctatacccatgtttttcaaaataaaccaataaaatagatagtatatattagacgtgttagtatatatatctgaggcatgttaaaaatcacaactgaattctcacaattcagtcacaaacctaaacagcaaataaaaatttctatcaccagaattatgtttttttctggtggggaactaccaatagctataaatagaagagattattatggaagtatcatagataaaaagagtgctcgcttcaggagcacatgtaataatacagaaacaaatttaaagataataaaatatttaggataaaaagaattgtctcttaaaaa

SEQ ID NO: 16263 - DNA, 2211 bp, Homo sapiens
  ENST00000504157
ggcggacacttggggtctggacgcaacggcggcgggagcatgaacgcccctccagccttcgagtcgttcttgctcttcgagggcgagaagtaagtgacgccggctgcggagggccgaggtgcgcgggcctgcggctgtcgcattctggggtgtctcctgcccatctcttgccccgggagggaaacagcttttgcttgatcgtctgctcggcctgtgtcagccaaatttaaggccgttccgcgaggcagtcgcgagtgtgttcattttgcagatgaggacactgaggcttggaggcgagcaagttgccccggacacaggaagtggcggcgcttgtattcgaacccagagtgtctggttctccatagcccttttcctctgggatctggcagcttcctctttttgtctctcgcccgccacctccatccttcatcccctccgatctgtcagcggcctgcgtaaaagccgcagtggctcctcgctgcctgcgggttgaaggagtccaggggagagagcttgggctcactctgtatctgtgggcgagtggcttgatctgtcggaggccctgtttcctcatctggaaaatgagtttattactgtacttaaacgtgggattcaggccgggtgcggtggctgacacctgtaatcccagcactttgggagcccgaggcgggcggatcacctgaggtcgggagttcaagaccagcctgaccaacatggagaaaccctgtctctactaaaaatacaaaattagccgggcgtggtggcagatgcctgtaatcccagctactcagaaggctgaggcaggagaatcacttgaacctgggaagtggaggttgaggatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccggacgtgcctgcttccccttcgccttctgccgtgattgtcagtttcctgaggcctccccagccacgcttcctgtacagcctgcagaactgtgagtcaattaaacctcttttcttcataaattacccagtttctcatagttctttatagcagtgtgaaaacagactaatggacccttctggttgaaggaatgcagccattctgcttgtttgactatgtcctttctattcatctctatttcctgggaggtgtttatccaagtgcaataggaggtattggtgaccgcacagtcccctcagtgttctgctagtaaatagttgaaggttgatcattgatcttctgcgttttcagtctggcatggaaaagcccctgtgcaactggtaaagatatcaataagcaccaggaggtatctaaatccaccaggagccataggcatcacgttgacatccatttaccagtcttccctggcaagattcttctgaattgtgctgccttggccaaaagaggtatgggaggggctgggcgcagtggcttgtgcctgtaatcccaacattttgggaaaccaattcaggtggatcgttagaggtcaggggttcaagaccatcctggccaacatggtgacatcccatctctactaaaaatacaataagttagctgggtttggtgttgggtgcctgtaatcccagctactcgagaggctgaggcaggataatcgcttgaacctgggaggaggaggtggcagtgagctgagatcgtgccattgcactccagcgtgggcaacaagagtgaaacgtcgtctcaaaaaataaaaaaaaggtccgggcttgatggctcacacctgtaatcccagcactttgggaggccaagacgggtggatcacgaggtcaggagttcaagaccagcctggcctagatggtgaaaccctgtctctactaaaactacaaatattagctgggcatggtggcatgcacctgtaatctcagctactcagaagtctgatgcaggagaattgctaaaacccaggagggagaggttgcagtgagccgagattgcaccactgcactctagcctgggcgacagagcaagactccgtctcgaaagaaagaaagaaa

SEQ ID NO: 16264 - DNA, 575 bp, Homo sapiens
  ENST00000508910
acacttggggtctggacgcaacggcggcgggagcatgaacgcccctccagccttcgagtcgttcttgctcttcgagggcgagaagtaagtgacgccggctgcggagggccgaggatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccggacgtgcctgcttccccttcgccttctgccgtgattgtcagtttcctgaggcctccccagccacgcttcctgtacagcctgcagaacttctggcatggaaaagcccctgtgcaactggtaaagatatcaataagcaccaggaggtatctaaatccaccaggagccataggcatcacgttgacatccatttaccagtct

SEQ ID NO: 16265 - DNA, 348 bp, Homo sapiens
  ENST00000621093
atgaacgcccctccagccttcgagtcgttcttgctcttcgagggcgagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccggacgtgcctgcttccccttcgccttctgccgtga

SEQ ID NO: 16266 - DNA, 932 bp, Homo sapiens
  ENST00000443430
attagggctctggtggcggcggtggcggacacttggggtctggacgcaacggcggcgggagcatgaacgcccctccagccttcgagtcgttcttgctcttcgagggcgagaagtaagtgacgccggctgcggagggccgaggatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccgggtgagggcggggcctggaggggcagacggggtgggctggacactggcccgtgtgcccaggcctgggacagccctggcctgtttcttcggaggtcctcagggagaggcggcggtgatggaagaacagggacttccaccacaggctccaggacatgtggactgaggggctgtggagtctgggcctgtggctcccgtctgccccatgggacttctgtagtgctgcagggtccctcgggtgctgtgggccagatccgggcggggacctactgtcctttgggggtgctcttctacgtcccttgtcggtgattggcaaggcctggtccttccaggcctctgggaggcagctcaccccagggtggcccacacctgttcctagcagggcgcctgggaatctagaacagtttagaggggaaagagccacagcaaagaaaagccgaggcagggtgatcacgaggtcaggagttcaagaccagcctggcaaacatggtgaagccctgtttctactaaaaatacaaaaattagctagg

SEQ ID NO: 16267 - DNA, 546 bp, Homo sapiens
  ENST00000513438
attagggctctggtggcggcggtggcggacacttggggtctggacgcaacggcggcgggagcatgaacgcccctccagccttcgagtcgttcttgctcttcgagggcgagaagatcaccattaacaaggacaccaaggtacccaatgcctgtttattcaccatcaacaaagaagaccacacactgggaaacatcattaaatcgctggagtgcaatggcacgatcttgctcactgcaacctccgcctcccgggttcaagtgattctcctgcttcagccttcctagtagctgggactacaggcccacgccacgatgcccggctaatttttgtgtttttagtagagacggggattcactgtgttggccaggctggtctcgaactcctgacctcaggtgatccacctgctggcttcccaaagtgctgggattagagacgtgagctactgcgcccggccttacattcaccattaagtgcacattctgtaaatgaacgagcagcagattccagcacagtaggcctgtttgttattcatgctgagggacattg

SEQ ID NO: 16268 - DNA, 729 bp, Homo sapiens
  ENST00000504101
agggctctggtggcggcggtggcggacacttggggtctggacgcaacggcggcgggagcatgaacgcccctccagccttcgagtcgttcttgctcttcgagggcgagaagatcaccattaacaaggacaccaaggtacccaatgcctgtttattcaccatcaacaaagaagaccacacactgggaaacatcattaaatcgtaagtttcccgtcacaggctctcaggggctatgtttaatgggcccctctgggcaaagcacaagttccaagtcttcctcagtctctctgagctacaggaagtccttctgggggcttgctctgggcattttataatcttggtacctttttatcaaaatgacaccgacctccatgtcttcacataagccacacttctgtagtggcttattctgtagatgaacacgtgcatttacattcactgtttgtttgtttgtttgtttttgagatggaattttctctctttgttgcccaggctggagtgcaatggcacgatcttgctcactgcaacctccgcctcccgggttcaagtgattctcctgcttcagccttcctagtagctgggactacaggcccacgccacgatgcccggctaatttttgtgtttttagtagagacggggattcactgtgttggccaggctggtctcgaactcctgacctcaggtgatccacctgctggcttcccaaagtgctgggattagagacgtgagct

SEQ ID NO: 16269 - DNA, 2096 bp, Homo sapiens
  ENST00000613744
agggctctggtggcggcggtggcggacacttggggtctggacgcaacggcggcgggagcatgaacgcccctccagccttcgagtcgttcttgctcttcgagggcgagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccgggtgagggcggggcctggaggggcagacggggtgggctggacactggcccgtgtgcccaggcctgggacagccctggcctgtttcttcggaggtcctcagggagaggcggcggtgatggaagaacagggacttccaccacaggctccaggacatgtggactgaggggctgtggagtctgggcctgtggctcccgtctgccccatgggacttctgtagtgctgcagggtccctcgggtgctgtgggccagatccgggcggggacctactgtcctttgggggtgctcttctacgtcccttgtcggtgattggcaaggcctggtccttccaggcctctgggaggcagctcaccccagggtggcccacacctgttcctagcagggcgcctgggaatctagaacagtttagaggggaaagagccacagcaaagaaaagccgaggcagggtgatcacgaggtcaggagttcaagaccagcctggcaaacatggtgaagccctgtttctactaaaaatacaaaaattagctaggcatggtggcatgtgctgtagtcccagctactcgggaggctgaggcaggagaatcgcttgaacccgggaggcggaggttgcagtgagccgagattgtgccactgcactccagcctaggtaacagagcaggactccatctcagtcaatcaatcaatcaatcaatctcagcggttgaactacccttgacatggttcagctctgtatccacacccaaatgtcatgtcaaattgtaattcccagtgttgtgggagggacctggtgggaggtgattggctcatgggggccgacttcccccttgctgttctcgtgatattgagtgagcgcttgtgggatctggttgtttaaaagcgtgcagccctcccacttcactctctctgtctctcctgctccaacatggccagacgtgcctgcttccccttcgccttctgccgtgattgtcagtttcctgaggcctccccagccacgcttcctgtacagcctgcagaactgtgagtcaattaaacctcttttcttcataaattacccagtttctcatagttctttatagcagtgtgaaaacagactaatggacccttctggttgaaggaatgcagccattctgcttgtttgactatgtcctttctattcatctctatttcctgggaggtgtttatccaagtgcaataggaggtattggtgaccgcacagtcccctcagtgttctgctagtaaatagttgaaggttgatcattgatcttctgcgttttcagtctggcatggaaaagcccctgtgcaactggtaaagatatcaataagcaccaggaggtatctaaatccaccaggagccataggcatcacgttgacatccatttaccagtcttccctggcaagattcttctgaattgtgctgccttggccaaaagaggtatgggaggggctgggcgcagtggcttgtgcctgtaatcccaacattttgggaaaccaattcaggtggatcgttagaggtcaggggttcaagaccatcctggccaacatggtgacatcccatctctactaaaaatacaataagttagctgggtttggtgttgggtgcctgtaatcccagctactcgagaggctgaggcaggataatcgcttgaacctgggaggaggaggtggcagtgagctgagatcgtgccattgcactccagcgtgggcaacaagagtgaaacgtcgtctc

SEQ ID NO: 16270 - DNA, 1515 bp, Homo sapiens
  ENST00000455123
ggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataacgtattttgatgttttgtacttacatctttgtttaccattaaaaagttggagttatattaaagactaactaaaa

SEQ ID NO: 16271 - DNA, 1726 bp, Homo sapiens
  ENST00000433091
aagtttcacatcatgagcctaatgtaaggcgtgtccgggccgtcccgaaggtatctggggaaataggtttgtgaggacaaagaccagggccaggcccagggcggagcctccgcggccccgacgcagggactcggcctaggcggaggacggggcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataacgtattttgatgttttgtacttacatctttgtttaccattaaaaagttggagttatattaa

SEQ ID NO: 16272 - DNA, 1745 bp, Homo sapiens
  ENST00000222572
aagtttcacatcatgagcctaatgtaaggcgtgtccgggccgtcccgaaggtatctggggaaataggtttgtgaggacaaagaccagggccaggcccagggcggagcctccgcggccccgacgcagggactcggcctaggcggaggacggggcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataacgtattttgatgttttgtacttacatctttgtttaccattaaaa

SEQ ID NO: 16273 - DNA, 1876 bp, Homo sapiens
  ENST00000633192
tgctttctatgtaagtttctcactggaatagcgagtgagaaatgtgtttgaagactagggaaacgagaaaggtatgcgggctgctagagggtttcgggtgggttgtttgaaaaaggaagtgaaggaattcaaagtttcacatcatgagcctaatgtaaggcgtgtccgggccgtcccgaaggtatctggggaaataggtttgtgaggacaaagaccagggccaggcccagggcggagcctccgcggccccgacgcagggactcggcctaggcggaggacggggcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataacgtattttgatgttttgtacttacatctttgtttaccattaaaa

SEQ ID NO: 16274 - DNA, 699 bp, Homo sapiens
  ENST00000483292
agaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaagattttgacaatttctcatttggaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaa

SEQ ID NO: 16275 - DNA, 1099 bp, Homo sapiens
  ENST00000446142
aggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgtgtggtgagtgtcttcttccttccccaaattcagcagaggagatacaagggtatttgatgagggctgcagaacaggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgt

SEQ ID NO: 16276 - DNA, 627 bp, Homo sapiens
  ENST00000459842
ctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatggccccttatagaatatcttcatttttcttcagttgtggtgctggccaaattctttactttgctttctttgtcaatgtgaaaatagttttcttgacatttatggtatattatacatataatatatagatacactatatatataattatatatgttttgtatatatatttacatatacttagtcacatgtatttatatgcaaatacaataccatatttaagtaaactatataatacagtaatatatatgtatttatatataatatataaagtttggaatacatcattgtcaaatttaattttataaatataaattttaaagtgtgatcatactgatgcatacatattgaagtatcaggtatttccttttaaataaatgtattatttttatt

SEQ ID NO: 16277 - DNA, 645 bp, Homo sapiens
  ENST00000469926
agctgctggccaggccggagcgaggcagcgcgcccggctcccgcgccatggggcggctggtggctgtgggcttgctggggatcgcgctggcgctcctgggcgagaggcttctggcactcagaagctggctctgaagatattgacatacttcccaatggtctggctttttttagtgtggtgagtgtcttcttccttccccaaattcagcagaggagatacaagggtatttgatgagggctgcagaacaggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttaca

SEQ ID NO: 16278 - DNA, 566 bp, Homo sapiens
  ENST00000491069
atggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtggtgagtgtcttcttccttccccaaattcagcagaggagatacaagggtatttgatgagggctgcagaacaggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaaggt

SEQ ID NO: 16279 - DNA, 694 bp, Homo sapiens
  ENST00000490778
gaggacaaagaccagggccaggcccagggcggagcctccgcggccccgacgcagggactcggcctaggcggaggacggggcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtggtgagtgtcttcttccttccccaaattcagcagaggagatacaagggtatttgatgagggctgcagaacagactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctg

SEQ ID NO: 16280 - DNA, 570 bp, Homo sapiens
  ENST00000632034
ccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtggtgagtgtcttcttccttccccaaattcagcagaggagatacaagggtatttgatgagggctgcagaacaggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagc

SEQ ID NO: 16281 - DNA, 550 bp, Homo sapiens
  ENST00000493290
accgcccacggagctgctggccaggccggagcgaggcagcgcgcccggctcccgcgccatggggcggctggtggctgtgggcttgctggggatcgcgctggcgctcctgggcgagaggcttctggcactcagggaagcctgaagccagaatgccagacagcgcagacactattccatctcgcattttagttttaatgaaaatctctgaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaataca

SEQ ID NO: 16282 - DNA, 555 bp, Homo sapiens
  ENST00000478801
atggggcggctggtggctgtgggcttgctggggatcgcgctggcgctcctgggcgagaggcttctggcactcagggaagcctgaagccagaatgccagacagcgcagacactattccatctcgcattttagttttaatgaaaatctctgaaatcgacttaaagcctccagagaagtagaatctgtagaccttccacactgccacctgattaaaggaattgaagctggctctgaagatattgacatacttcccaatggtctggctttttttagtgtgataaggggacagatgaggaggttctgaccacctacctccctggcttgggcagacataggagttcttggcatcttcataggtccagtttttctggaggaagaagtaaccaactctgacacctgactggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactt

SEQ ID NO: 16283 - DNA, 569 bp, Homo sapiens
  ENST00000460873
atggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtgagacagagtcttgctatgttgcccaggctggtctcaaactgctggcctcaagcagtcctcccacgtcagcctcccaaagtgctggaattataggcatgagccaccaggcctgacctaaagctgtagtaatttaaaaagtgttatattggcacaggaatagacatgagacattaaaataacaaaacagagagtccctaaatagaccaatatgtaaatgtcagagatctagcacatgataaaggtgatattttgaatcagtgggagaaggatggactgtatgccaggcactgttccaggcactgggatctagcagtgaacaaatttccacagtcagtatgtagatgtcacttttctccaccctcagctct

SEQ ID NO: 16284 - DNA, 579 bp, Homo sapiens
  ENST00000493469
ggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtggtgagtgtcttcttccttccccaaattcagcagaggagatacaagggtatttgatgagggctgcagaacagtaagttgcttttaaaattcattttccaaaatgcattctgaagaaaagagaggtcaaacaagatcttggaaaacttcctccagcttttctaaatgtagagatgaagactctttgcccattgagatagtgttctttatttccccattgcattgcactaaaatattccaatgcaatctgtgttttgttttgttttttcttttttaattttttttattttttgagacggagtcttgttctggttgccccggctggagtgcagtggcatgatctcagcttactgcaacctccgcctcccg

SEQ ID NO: 16285 - DNA, 451 bp, Homo sapiens
  ENST00000471883
ccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgtcagagcaaaggctttgagtcccagcttcccagtttgtgaccttgagcaattgcttaacttttccaaagcctccaatagtcttcactctaaaataaaagataatcatatgagatattgtatgcagggtatttacaaggagcctggtacttggtgtacctaatgtatgttagttattattattaaattagaggagcaaaaatttctctagcattgactgctcctgaca

SEQ ID NO: 16286 - DNA, 573 bp, Homo sapiens
  ENST00000469716
atcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattggtatgtatatgaaaatgcttgttgggcacattgcattttttggccattaacattaaaacactcattaatggcattttagcatgaaattactgcttttcagtggataaatcacattagatcaacaaaaacctctttggtcaacctcttgatctgatgaaccctgtatttattcttctttcctaccctcactgtaaattattcttttttgtgtgtaattctatgtttagcatttgatttcttgcttgttttgtgacttctctgaactatttttgttgcgtctgtattgtttgtcaggtatggccgctgcagtctgtgttctgtgagccttgtggtcagctagtgaaggaagct

SEQ ID NO: 16287 - DNA, 1653 bp, Homo sapiens
  ENST00000633531
ggactcggcctaggcggaggacggggcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataacgtattttgatgttttgtacttacatctttgtttaccattaaaaagttggagttatattaaagactaactaaaatccc

SEQ ID NO: 16288 - DNA, 498 bp, Homo sapiens
  ENST00000453773
agaccgccctcagcacaggacctgccctggctggtcagccctgcctggggcacccacagccccagctgtccagtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatgg

SEQ ID NO: 16289 - DNA, 625 bp, Homo sapiens
  ENST00000439963
agcaaggagaccggaagaaggtctggggaagttatttggacaatgaagagagccagtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgtttggtcttgggaacaagacctacgagcacttcaatgccatgggca

SEQ ID NO: 16290 - DNA, 2522 bp, Homo sapiens
  ENST00000461988
acgcccccacccccgcggccggcgaaggcggtggtagcgcctcagtggtgtgggcctgagccctgcccaggtgcccgcagagagcagccgggctgccagcgtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgtttggtcttgggaacaagacctacgagcacttcaatgccatgggcaagtacgtggacaagcggctggagcagctcggcgcccagcgcatctttgagctggggttgggcgacgacgatgggaacttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagcccccctttgatgccaagaatccgttcctggctgcagtcaccaccaaccggaagctgaaccagggaaccgagcgccacctcatgcacctggaattggacatctcggactccaaaatcaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggctggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtctacgtccagcacctgctaaagcaagaccgagagcacctgtggaagttgatcgaaggcggtgcccacatctacgtctgtggggatgcacggaacatggccagggatgtgcagaacaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctccctcccgtagtctcctgggtgtgtttggcttggccttggcatgggcgcaggcccagtgacaaagactcctctgggcctggggtgcatcctcctcagcccccaggccaggtgaggtccaccggcccctggcagcacagcccagggcctgcatgggggcaccgggctccatgcctctggaggcctctggccctcggtggctgcacagaagggctctttctctctgctgagctgggcccagcccctccacgtgatttccagtgagtgtaaataattttaaataacctctggcccttggaataaagttctgttttctgta

SEQ ID NO: 16291 - DNA, 1104 bp, Homo sapiens
  ENST00000448410
gtgcccgcagagagcagccgggctgccagcgtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggtgagtttcctgcatgtctttactcttctcaggaagcctcggccccgatgggcatgtaatcaagtctagcagacggctggcgtcaccgcatagaggatgtcccggtggccaggagagggaacgcagcccggctcgcttgggagtcattcttgcctaaccaaagccctgaagcagctctgctgttgctgggacagtttgtttccttgaatctttactttttgaacaaaccaaagtctaagaacagaccctccctctaactcacgaagcttctcccgtctggccctggcctgtccaggagcagaggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgagtcacccagagactgctatgggctcccggtggcctgcggtgcctccctggggactccagatccatgtatctgaaaggcagccctccagacccccaccctgtcctcagcagccagggcaggccacttgtgagaccctctcctctgccccagaccccagcactacgagaatgtcccctccctgtccccagccccagtcggctccagggggcattgggtgctggagactaaaggcaagaaaggtctggc

SEQ ID NO: 16292 - DNA, 631 bp, Homo sapiens
  ENST00000421059
agagagcagccgggctgccagcggtgagtgctatctttcgcggcgacggcggggtgggtgaggtcgggccccaagactcggggtttgccgggcgcctcagttcaccgcggccgcctggctctctgcgtcggggtgggccctcgggcctgggcactgcgcgtctggcccgacgctcgggcggaaggcatggctcccaccccggccctcctccgcgtcgcccttcccctagagctgatctcccgcggcggcctgagggtcgacttttccacagcttgggccgagagagcccggcaggccctcggctgagggttagggctcggtatctcagggctcggggtccagtccccgcgccgccgccccccacgggctaagccactttaactctccgagcctcagtttccccatctgtacgatgaatgggcctcgggaggcagcgaattctgggggtacctaacgtgagaggcgctcgatgcatgctcatgggacccgaatctaaccctgcagcatcagtttcatgatcaacatgggagactcccacgtggacaccagctccaccgtgtccgaggcggtggccgaagaagtatctcttttcagcatgacggacatgattctgttttcgctcatcgtgggt

SEQ ID NO: 16293 - DNA, 600 bp, Homo sapiens
  ENST00000471238
agagagcagccgggctgccagcgtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggtaagctgccaccgcgtgctggccccagatggaggcagtgggtaggacagggagcaggtctgtagggcgcccctcagcagggggaggccggcagggagtggggtcctgggaagacgtcctcggaagttgccttcccgtgagggtcattgccatccctgcccgggctgactgacggaagggccattcctgcagttgcagccacgtgcc

SEQ ID NO: 16294 - DNA, 2532 bp, Homo sapiens
  ENST00000394893
agccgggctgccagcgtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgtttggtcttgggaacaagacctacgagcacttcaatgccatgggcaagtacgtggacaagcggctggagcagctcggcgcccagcgcatctttgagctggggttgggcgacgacgatgggaacttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagcccccctttgatgccaagaatccgttcctggctgcagtcaccaccaaccggaagctgaaccagggaaccgagcgccacctcatgcacctggaattggacatctcggactccaaaatcaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggctggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtctacgtccagcacctgctaaagcaagaccgagagcacctgtggaagttgatcgaaggcggtgcccacatctacgtctgtgggtgagtgagtggggtcactggaatagggggcagggaggacaaggccctgcctgccacagttggcccagcccccagcaccccctcttcctgcccagggatgcacggaacatggccagggatgtgcagaacaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctccctcccgtagtctcctgggtgtgtttggcttggccttggcatgggcgcaggcccagtgacaaagactcctctgggcctggggtgcatcctcctcagcccccaggccaggtgaggtccaccggcccctggcagcacagcccagggcctgcatgggggcaccgggctccatgcctctggaggcctctggccctcggtggctgcacagaagggctctttctctctgctgagctgggcccagcccctccacgtgatttccagtgagtgtaaataattttaaataacctctggcccttggaataaagttctgttttctgta

SEQ ID NO: 16295 - DNA, 586 bp, Homo sapiens
  ENST00000412521
ccagcggtgagtgctatctttcgcggcgacggcgggcatcaggtgggctgagtcgatggatcacgggagccccccagcccggcctgcatccctgagggcagtgcccctcgcagtcaggtgtctcggcggcccccacaacacagtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggag

SEQ ID NO: 16296 - DNA, 548 bp, Homo sapiens
  ENST00000414186
gagtgctatctttcgcggcgacggcgggtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcg

SEQ ID NO: 16297 - DNA, 561 bp, Homo sapiens
  ENST00000432753
gcacttgagaactctcacagggagggaagcaagcatacaattcaacaagaatggcacgtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctct

SEQ ID NO: 16298 - DNA, 283 bp, Homo sapiens
  ENST00000449920
gacttcctgggccctgaagctccaaggacaaaagactcctgtcccttttcccttcctctccattctgggtctcccaccaccaccaagtccttttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacatt

SEQ ID NO: 16299 - DNA, 736 bp, Homo sapiens
  ENST00000418341
aagaaaagttgctatattttgcaaaagacataaatctacagattcaagaaactgagtgaaccccacagaaggtataaagaagaaactcagagattaaagactctttcagggcagaaggctcacacaggcttccagaacctcctcggagcgattgtagggactgcctgacccggaagagagttgtcagtcaagaccgccagagttttcccatcagagtatttggcatagcagaggtggctcccaaactgtgccagggcactgcagcaaactcacaagtgatcattctcaatgcggcggacgctcaagtctgttgaactccatgcgaagtgctagcttgggacagttcacggttccaacgtgagatccttgctgcattccttcttaggattttacatctttgcgaagctgggtttgcagtggttgttcagacctaactatacgtggaactgttaggcatttttttttggcctacggataccattaaaaatttgctgagataccagggactccacaaacgaaggacatttgggatctgtccagacagtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacatt

SEQ ID NO: 16300 - DNA, 1044 bp, Homo sapiens
  ENST00000412064
tttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgtttggtcttgggaacaagacctacgagcacttcaatgccatgggcaaatgcggccaaggtgtacatgggggagatgggccggctgaagagctacgagaaccagaagcccccctttgatgccaagaatccgttcctggctgcagtcaccaccaaccggaagctgaaccagggaaccgagcgccacctcatgcacctggaattggacatctcggactccaaaatcagtcccacaaggtctacgtccagcacctgctaaagcaagaccgagagcacctgtggaagttgatcgaaggcggtgcccacatctacgtctgtggggatgcacggaacatggccagggatgtgcagaacaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctcc

SEQ ID NO: 16301 - DNA, 2295 bp, Homo sapiens
  ENST00000454934
tttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcgcttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagcccccctttgatgccaagaatccgttcctggctgcagtcaccaccaaccggaagctgaaccagggaaccgagcgccacctcatgcacctggaattggacatctcggactccaaaatcaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggctggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtctacgtccagcacctgctaaagcaagaccgagagcacctgtggaagttgatcgaaggcggtgcccacatctacgtctgtggggatgcacggaacatggccagggatgtgcagaacaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctccctcccgtagtctcctgggtgtgtttggcttggccttggcatgggcgcaggcccagtgacaaagactcctctgggcctggggtgcatcctcctcagcccccaggccaggtgaggtccaccggcccctggcagcacagcccagggcctgcatgggggcaccgggctccatgcctctggaggcctctggccctcggtggctgcacagaagggctctttctctctgctgagctgggcccagcccctccacgtgatttccagtgagtgtaaataattttaaataacctctggcccttggaataaagttctgttttctgt

SEQ ID NO: 16302 - DNA, 2332 bp, Homo sapiens
  ENST00000447222
gacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgagtcacccagagactgctatgggctcccggtggcctgcggtgcctccctggggactccagatccatgtatctgaaaggcagccctccagacccccaccctgtcctcagcagccagggcaggccacttgtgagaccctctcctctgccccagaccccagcactacgagaatgtcccctccctgtccccagccccagtcggctccagggggcattgggtgctggagactaaaggtgtttggtcttgggaacaagacctacgagcacttcaatgccatgggcaagtacgtggacaagcggctggagcagctcggcgcccagcgcatctttgagctggggttgggcgacgacgatgggaacttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagcccccctttgatgccaagaatccgttcctggctgcagtcaccaccaaccggaagctgaaccagggaaccgagcgccacctcatgcacctggaattggacatctcggactccaaaatcaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggctggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtctacgtccagcacctgctaaagcaagaccgagagcacctgtggaagttgatcgaaggcggtgcccacatctacgtctgtggcaccccctcttcctgcccagggatgcacggaacatggccagggatgtgcagaacaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctccctcccgtagtctcctgggtgtgtttggcttggccttggcatgggcgcaggcccagtgac

SEQ ID NO: 16303 - DNA, 565 bp, Homo sapiens
  ENST00000426184
agatgttgcagagttcttgggctcatgggggcagacgcaggcaggagctcagggaaattccgagaggactttggggtgtccaggagcactttgaggccacgggcccaggcaacttcctcaccagtacggaacaggggatgcacagggccgaactttccatctgctggcccctgctggtgtccaggagagagctgtgaccctcctttttccttaagtcctggagctgagagtgagaagccatggggtgcacgtactcgtctccacctgaggagcccgctctgagaaggacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttcta

SEQ ID NO: 16304 - DNA, 569 bp, Homo sapiens
  ENST00000439297
atgttgcagagttcttgggctcatgggggcagacgcaggcaggagctcagggaaattccgagaggactttggggtgtccaggagcactttgaggccacgggcccaggcaacttcctcaccagtacggaacaggggatgcacagggccgaactttccatctgctggcccctgctggtgtccaggagagagctgtgaccctcctttttccttaagtcctggagctgagagtgagaagccatggggtgcacgtactcgtctccacctgaggagcccgctctgagaaggtcagttcctgacactgtccctggcggcagactgccctcatgccccttggccaggggacgcctgcaccctcactcgagtgtgggagacttcctcctggcggggacctgctggaggcctgaagatgcggctgcctggagttaacagcaaggacctcctctgtcagagagagcagctttgtggaaaagatgaagaaaacggggaggaacatcatcgtgttctacggctcccagacggggactgcagaggagtttgccaaccgcctgtccaaggacgcccaccgctac

SEQ ID NO: 16305 - DNA, 590 bp, Homo sapiens
  ENST00000475509
atgttgcagagttcttgggctcatgggggcagacgcaggcaggagctcagggaaattccgagaggactttggggtgtccaggagcactttgaggccacgggcccaggcaacttcctcaccagtacggaacaggggatgcacagggccgaactttccatctgctggcccctgctggtgtccaggagagagctgtgaccctcctttttccttaagtcctggagctgagagtgagaagccatggggtgcacgtactcgtctccacctgaggagcccgctctgagaagattctcactctgttgcccaggctggagtacagtggcgtgatctcggctcactgcaacctccgcctccctagttcaagtgattctcctgcctcagcctcccgagtaggacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccag

SEQ ID NO: 16306 - DNA, 603 bp, Homo sapiens
  ENST00000460892
tgcaggtgttgccagcagctcagccagtgctgtggggcctcccgccctgcccccatggcccctcccactggtcaggtcgagggccaggcctcagagcggcccctgtgtccacgcaggtgtttggtcttgggaacaagacctacgagcacttcaatgccatgggcaagtacgtggacaagcggctggagcagctcggcgcccagcgcatctttgagctggggttgggcgacgacgatgggaacttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagcccccctttgatgccaagaatccgttcctggctgcagtcaccaccaaccggaagctgaaccagggaaccgagcgccacctcatgcacctggaattggacatctcggactccaaaatcaggtatgaatctggggaccacgtggctgtgtacccagccaacgactctgctctcgtca

SEQ ID NO: 16307 - DNA, 1858 bp, Homo sapiens
  ENST00000439269
ataacgttcctctctgtgcccttgatggcccctgggtgctgcccgggcttccttaccttctcccagatggaagcctgcccagccctgccccggcttctgggcgtctggcccccggcagctccacgccgcctccctccttgctccctcgcctgccctccttgtgcatctgcagcaggggctcccctgcttcttgtccattcgccagtacgagcttgtggtccacaccgacatagatgcggccaaggtgtacatgggggagatgggccggctgaagagctacgagaaccagaagcccccctttgatgccaagaatccgttcctggctgcagtcaccaccaaccggaagctgaaccagggaaccgagcgccacctcatgcacctggaattggacatctcggactccaaaatcaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggctggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtctacgtccagcacctgctaaagcaagaccgagagcacctgtggaagttgatcgaaggcggtgcccacatctacgtctgtggggatgcacggaacatggccagggatgtgcagaacaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctccctcccgtagtctcctgggtgtgtttggcttggccttggcatgggcgcaggcccagtgacaaagactcctctgggcctggggtgcatcctcctcagcccccaggccaggtgaggtccaccggcccctggcagcacagcccagggcctgcatgggggcaccgggctccatgcctctggaggcctctggccctcggtggctgcacagaagggctctttctctctgctgagctgggcccagcccctccacgtgatttccagtgagtgtaaataattttaaataacctctggccctt

SEQ ID NO: 16308 - DNA, 939 bp, Homo sapiens
  ENST00000496888
gggtggcagagcgaaactctgtctcaaaaaaaaaaaagagaactgcattggaccaggctgggagagcccttgatgtaaccggtgagatttcctcatggagatctctgagattccctgtgctttgtgcaaccagaagcgtccttggagacggagactcagatcaaagccccggccgctcactgtgcttctctcctccccacccagcccctttgatgccaagaatccgttcctggctgcagtcaccaccaaccggaagctgaaccagggaaccgagcgccacctcatgcacctggaattggacatctcggactccaaaatcaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggctggccgcatcaacaagggcgtggccaccaactggctgcgggccaaggagcctgccggggagaacggcggccgtgcgctggtgcccatgttcgtgcgcaagtcccagttccg

SEQ ID NO: 16309 - DNA, 853 bp, Homo sapiens
  ENST00000487247
tttgtgcaaccagaagcgtccttggagacggagactcagatcaaagccccggccgctcactgtgcttctctcctccccacccagcccctttgatgccaagaatccgttcctggctgcagtcaccaccaaccggaagctgaaccagggaaccgagcgccacctcatgcacctggaattggacatctcggactccaaaatcaggtaccagctgccactgtcaccccctgaaccctcactctgggcctcctgacctggggcagggccagccttccgcccctcccgagcctcacatctccctccaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtgagggccggcactgccctgccagccacacgctggaggcccagccctgctcacagcaggcagagtgcaaggcggcacaggagctccgagatctgagccc

SEQ ID NO: 16310 - DNA, 559 bp, Homo sapiens
  ENST00000495770
cgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtgagggccggcactgccctgccagccacacgctggaggcccagccctgctcacagcaggcagagtgcaaggcggcacaggagctccgagatctgagccctgagctccagttccagccccagcgcagctccaaatgcctccccaggctgtggactcagt

SEQ ID NO: 16311 - DNA, 1028 bp, Homo sapiens
  ENST00000493973
tccccacaggtccaccccaactctgtgcacatctgtgcggtggttgtggagtacgagaccaaggctggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtctacgtccagcacctgctaaagcaagaccgagagcacctgtggaagttgatcgaaggcggtgcccacatctacgtctgtggggatgcacggaacatggccagggatgtgcagaacaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctccctcccgtagtctcctgggtgtgtttggcttggccttggcatgggcgcaggcccagtgacaaagactcctctgggcctggggtgcatcctcctcagcccccaggccaggtgaggtccaccggcccctggcagcacagcccagggcctgcatgggggcaccgggctccatgcctctggaggcctctggccctcggtggctgcacagaagggctctttctctctgctgagctgggcccagcccctccacgtgatttccagtgagtgtaaataattttaaataacctctggcccttggaataaagttctgttttctgta

SEQ ID NO: 16312 - DNA, 4879 bp, Homo sapiens
  ENST00000328345
gggagaggggggagcgccgagctagtcagagagtgagcgagagcgagaaggagggagaggaggagaaagagagcgagggcgggcgggaggcggcggcggcggcagcagcagcagtaatagcaggagcagcaacagaaggcgtcggagcgggcgtcggagctgcccgctgtgggagagagaggagacagaaagagcgagcgaggagagggagcccgaggcgaaaaagtaactgtcaaatgcgcggctcctttaaccggagcgctcagtccggctccgagagtcatggcgaccgcagcgtctaaccactacagcctgctcacctccagcgcctccatcgtgcacgccgagccgcccggcggcatgcagcagggcgcggggggctaccgcgaagcgcagagcctggtgcagggcgactacggcgctctgcagagcaacggacacccgctcagccacgctcaccagtggatcaccgcgctgtcccacggcggcggcggcgggggcggtggcggcggcggggggggcgggggcggcggcgggggcggcggcgacggctccccgtggtccaccagccccctgggccagccggacatcaagccctcggtggtggtgcagcagggcggccgcggagacgagctgcacgggccaggcgccctgcagcagcagcatcagcagcagcaacagcaacagcagcagcaacagcagcaacagcagcagcagcagcagcaacagcggccgccgcatctggtgcaccacgccgctaaccaccacccgggacccggggcatggcggagcgcggcggctgcagcgcacctcccaccctccatgggagcgtccaacggcggcttgctctactcgcagcccagcttcacggtgaacggcatgctgggcgccggcgggcagccggccggtctgcaccaccacggcctgcgggacgcgcacgacgagccacaccatgccgaccaccacccgcacccgcactcgcacccacaccagcagccgccgcccccgccgcccccgcagggtccgcctggccacccaggcgcgcaccacgacccgcactcggacgaggacacgccgacctcggacgacctggagcagttcgccaagcagttcaagcagcggcggatcaaactgggatttacccaagcggacgtggggctggctctgggcaccctgtatggcaacgtgttctcgcagaccaccatctgcaggtttgaggccctgcagctgagcttcaagaacatgtgcaagctgaagcctttgttgaacaagtggttggaggaggcggactcgtcctcgggcagccccacgagcatagacaagatcgcagcgcaagggcgcaagcggaaaaagcggacctccatcgaggtgagcgtcaagggggctctggagagccatttcctcaaatgccccaagccctcggcccaggagatcacctccctcgcggacagcttacagctggagaaggaggtggtgagagtttggttttgtaacaggagacagaaagagaaaaggatgacccctcccggagggactctgccgggcgccgaggatgtgtacggggggagtagggacactccaccacaccacggggtgcagacgcccgtccagtgaactcgagctgggggaggggcagagcgcggggctccccctccccttcggtccttggccctttcccggccctcttgttccctctctaacttctgattgttcttttatttttaattattatttccccgtcccttaaaaagacaaaaaaaataaggcaaaaggaaagcaactaagacactggactatcctttaaaggtagcaggtgtaatgatgtgttttgacctttgcaggcgagtaaccaggcaatggagtggagtgtctcctggagagagtgaggagagtgtgtgatagctagaaagagagagagacagagagatggcaagcactgagataaatacctggcaaaactaaataaattaccaaaaaggaaaaaaaatccaccaaaccatgataaacacaaaatgcagcttcctgatgcttagagttggcacatgctgctgtgtttatttattgtggattcccatcaggaaagaggaaaaaatacacatgttctttcatataggcaaaatttaaccacataaatttgcactgcaagaaaattgaagtttacgtgaacaaattcatgagcatattttctctttctccccaccgttaatttgggagttgccgttttgggggattttgttttgctttgctttattcatcggagagagttgaagccagctcttggccactctccatttctaatgttcttgtgttgccccttcttcgtactgtttgtgaactttggttaccttcacattccccttacgagggtgtaacatctatttgttcctcttaccaaagcaaaaggattggcttcatacaaaatagacaattctctgatttcaggaaatgtgcatggtctacccgctttatcgaaggcaagaatccggtttggaatataaaaataagcattggttgttcttaccagccacaaagtaaacttcattttcaggcagtgtttctgggggaggttatggagggaagaaaaaagaaaaatcgatagtgagtgactgattgcttcattttatcaggcgggcccattgtgaaagagctcaggggaaatgtggaggttaaatatatttccagagttgtccagcagaaagaaagtggcactttgaagagaactagggaagtacatatcttcagatatccctatatagttctctaccttcagttttagtaacaattatgaagaattatttgtgctgacagcagcagttaaactttgtttctctaatagctttttttttacataaaaaaagacccaggaacttaatagtgtatgcataagactgtgttttttagcacacagatacccacagcatacactgacgatctccacgcagtagacaggttttgtcttcactagctcatttgtttatcaagtcatatttagggtcccacaccctcttttcctgtaatttattgcagaatacaccactttgacttggacagctttctgccccctctttcactaaggaaggcaaatgaagtgaaaaaaaaaaatgccattttcaatccttcctttctcccctttgttaatagttttaagtgaatttttgaccttatcttaatggaaaacggttaactccaaacacaaaagactctactggaaagtgtaggtgaaaaaacttgtaactgtattgaaaataaataccattaaactgtgatcagttaaaatttaaaagaaaaatcagcacaaaagggcgctaaaagggaaaacactttttattaatcttaaaagtttgggggtttttttccagttaggtattagataaatttttattttaaaaaatgaaagtctcactaccataaaattatggttcagcatcagattagcattgcactcagtagtctttaaggttttaggaaatatgctttatattgtcttttcaaacacctgtgattgtttcattttccatgtttttgcaagataaatggtgacttataatgggcatatttatttgcctgtatttcatttcccccaatgaatgtcacaaggagatgggcacggagctgcttcgggtgcatcacgctgctcgttcctgaggtatgggaactggcctttagtgaagctatccagagcagggcaaatagccactggtaaagggaggaaatgaatttccagatacttattaccaagtaggtaaggtcagaagctggagttcagagaatgtgtctacagcttctctgactcttataggtttactaagatgaaagttaccactgaaccttaccactatgtatatatgtttaatatctgtcttttgaaatgcagaaatagtttaaatgtttctttgtctatttttctttttttttaatgctacccagggaaatattttcatatcatttttaagtggcctgcctcaatgtatatttatttcttttgaaacaaaaaggttctggaaactgtttttctgtagctttaaatgaataggtgagcaaaatctatatgggatgtaatttttttgttcagtctcttaaaaaatactttgttttggtacatttggttgtgcttgtggggaaaataaaaacgcagagatccttatatatttatgttaaagtaatattttattatctacataaaacagaaatgcacaataccttcatagtttgttctaattattgaaatatctttattttatttttaaagatagtgccaagttttaaggggggaaaaccctagaccttaaattgactgagttgagttgtgtgtaaaacacttcccttcctttatacttcataaagttttggaataaattttatgcatatactgccagatttgatgttcataactttcagaggctttttttttttttaatggagactactggtctaattcactttactttgcaaaaactatcagtcccaaatctttcagtcactatgcctgtagcattaaattgaaatggtcattgggtttgagcttcaatttgcttgccatttcatggtcctacaaagagatgtttgtcccctttaaacatatgcagatatgcctgcatcttctttccaggttaactataccttattcgattgtgctgttttggagaacatcagtggaactaggtggactttgatctctacccataggtcctcaaataatttgggatctacagaaaagcaggatttagtagattattatttttaataatttacaaatatctcttaacaaagaataaccctgatagtatactattgtgagtttactaaatgattagaagtagatcctatacattattcctgtttggtttgcataaaaagatgaattttacaatggtttata

SEQ ID NO: 16313 - DNA, 2017 bp, Homo sapiens
  ENST00000397010
aacttacaaacgcaaggaactctgaaagtgtgcagcaccaccgatcagaagagaaaaccaagggacccgaaatatgctttaattaaattttcttttaaaatgtcactggaaagaacatcttgggaagacggcctggccgatcgccgtgtgaagggcaagccactctggccgagagggagccccacacctcggtctccccagaccggccctggccgggggcatccccctaaacttcggatccctcctcggaaatgggaccctctctgggccgcctcccagcggtggtggcgaggagcaaacgacaccagatttgaaagaagccaacactaaaccacaaatatacaacaaggccattttctcaaacgagagtcagcctttaacgaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaatttacttttaatattaaaaattaccatattatgaaa

SEQ ID NO: 16314 - DNA, 686 bp, Homo sapiens
  ENST00000397029
tctgaaagtgtgcagcaccaccgatcagaagagaaaaccaagggacccgaaatatgctttaattaaattttcttttaaaatgtcactggaaagaacatcttgggaagacggcctggccgatcgccgtgtgaagggcaagccactctggccgagagggagccccacacctcggtctccccagaccggccctggccgggggcatccccctaaacttcggatccctcctcggaaatgggaccctctctgggccgcctcccagcggtggtggcgaggagcaaacgacaccagaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaag

SEQ ID NO: 16315 - DNA, 1870 bp, Homo sapiens
  ENST00000309576
cccgcccccgcgccgggcccggctcggcccgacccggctccgccgcgggcaggcggggcccagcgcactcggagcccgagcccgagccgcagccgccgcctggggcgcttgggtcggcctcgaggacaccggagaggggcgccacgccgccgtggccgcagatttgaaagaagccaacactaaaccacaaatatacaacaaggccattttctcaaacgagagtcagcctttaacgaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaatttacttttaatattaaaaattaccatattatgaaa

SEQ ID NO: 16316 - DNA, 1722 bp, Homo sapiens
  ENST00000397015
gccgcgggcaggcggggcccagcgcactcggagcccgagcccgagccgcagccgccgcctggggcgcttgggtcggcctcgaggacaccggagaggggcgccacgccgccgtggccgcagaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaattt

SEQ ID NO: 16317 - DNA, 428 bp, Homo sapiens
  ENST00000455517
ctttgtgggctcctgcaagtgccaggcgctgaccactcctcctgggagcctaactgaggggggtagaggcagcagaggttaacagaaatctcaggtcccttggtggaaggtgggtgtgtagtcgtggtactttacgcctcggtgtttagggaggagcctaaggtaaggagtcagaaacggggagtaaccgagctgcggcttttatataaggtcagtggtaggtaaggaaggggccttaacctctgctggtgaccagaagcctgcatttctgcattctgcttaattccctttccttagaaatgaccatggttgacacagagatgccattctggcccaccaactttgggatcagctccgtggatctctccgtaatggaagaccactcccactcctttgatatcaagcccttcactactgttgacttctcc

SEQ ID NO: 16318 - DNA, 2006 bp, Homo sapiens
  ENST00000397012
ctttgtgggctcctgcaagtgccaggcgctgaccactcctcctgggagcctaactgaggggggtagaggcagcagaggttaacagaaatctcaggtcccttggtggaaggtgggtgtgtagtcgtggtactttacgcctcggtgtttagggaggagcctaaggtaaggagtcagaaacggggagtaaccgagctgcggcttttatataaggtcagtggtaggtaaggaaggggccttaacctctgctggtgaccagaagcctgcatttctgcattctgcttaattccctttccttagatttgaaagaagccaacactaaaccacaaatatacaacaaggccattttctcaaacgagagtcagcctttaacgaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaatttacttttaatattaaaaattaccatattatgaaa

SEQ ID NO: 16319 - DNA, 2029 bp, Homo sapiens
  ENST00000397026
ccttaacctctgctggtgaccagaagcctgcatttctgcattctgcttaattccctttccttagatttgaaagaagccaacactaaaccacaaatatacaacaaggccattttctcaaacgagagtcagcctttaacgtgtttcaggatgattcttgtctctggatgtcgctgtcatgatgggagaggaattagtaaattcccaggtcagtttacactgcagagtgatcttgatctgcatgaatcagtaaggatgggctggataaacaagttggaaccacagttatgagtaccatgacattaactgaaacaaatgagaagggattgaaaaatcggcggttaagtgtcttttaaggtcatttccaacaaaactacaaaggacctatgaaaggcttttcagaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaatttacttttaatattaaaaattaccatatta

SEQ ID NO: 16320 - DNA, 1600 bp, Homo sapiens
  ENST00000497594
ttctgcttaattccctttccttagatttgaaagaagccaacactaaaccacaaatatacaacaaggccattttctcaaacgagagtcagcctttaacgaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcagttagttctcttctgctgtcttcattgggggaggcgggaagttgttttgggtttttgtttctttgagtaaatggtttactgcgctacaaatgcacacacagaatattgttcaactgttggctgttaacatattgcaggctgagtctgaaacgcaggaagtgttttcagatagcacaagtcaacattattttgaaaagggagaaaagtccataaagtttttgagaatagtgtaacaatgtattggtcatcctaactttaatgaatgaacttaagccccctgagcctatcaccctcttttaggatccatctcctttctcggcatcaaaataactggccacagcaatattcattcaagcagccttgctttcctctgggaagaacccgacctaggtttagaaaaggtattgaatcccactatttcacctttcaggagaactaccagagttacctctttttttttttttttttttttttttgagatgtcgtctcactttgtcgcccaggctggagtgcagtggcacaatctcggctcaccgcaacctccgcctcccaggttaaagcgattatcatgcctcagcatcccgagtagctgggattacaggtgtgcacgaccatgcctggctaatctttgtatttttagtagagacggggtttcaccttgttgatcaggctggtctagagttacctcttaagaagttcaacatgaggcataaaaatagattctagatattatgttacctttctttccttgtagcattcttgatt

SEQ ID NO: 16321 - DNA, 560 bp, Homo sapiens
  ENST00000438682
ttagtatacaatgaatttataaatgtaaccatacaatttcatgcttagagaacgttttctctccattctctctacctttagaccattctgcagtttaaatcttgaaccaaaatgtcatttaaccatccttctgaacgataactccataattaactcaagcaccaaataagtcatctagctcttgatgatttgaaagaagccaacactaaaccacaaatatacaacaaggccattttctcaaacgagagtcagcctttaacgaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcat

SEQ ID NO: 16322 - DNA, 1122 bp, Homo sapiens
  ENST00000397000
gaagccaacactaaaccacaaatatacaacaaggccattttctcaaacgagagtcagcctttaacgaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacc

SEQ ID NO: 16323 - DNA, 1705 bp, Homo sapiens
  ENST00000477039
actcatgggtgtattcacaaattctgttacttcaagtctttttcttttaacggattgatcttttgctagatagagacaaaatatcagtgtgaattacagcaaacccctattccatgctgttatgggtgaaactctgggagattctcctattgacccagaaagcgattccttcactgatacactgtctgcaaacatatcacaagaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcagttagttctcttctgctgtcttcattgggggaggcgggaagttgttttgggtttttgtttctttgagtaaatggtttactgcgctacaaatgcacacacagaatattgttcaactgttggctgttaacatattgcaggctgagtctgaaacgcaggaagtgttttcagatagcacaagtcaacattattttgaaaagggagaaaagtccataaagtttttgagaatagtgtaacaatgtattggtcatcctaactttaatgaatgaacttaagccccctgagcctatcaccctcttttaggatccatctcctttctcggcatcaaaataactggccacagcaatattcattcaagcagccttgctttcctctgggaagaacccgacctaggtttagaaaaggtattgaatcccactatttcacctttcaggagaactaccagagttacctctttttttttttttttttttttttttgagatgtcgtctcactttgtcgcccaggctggagtgcagtggcacaatctcggctcaccgcaacctccgcctcccaggttaaagcgattatcatgcctcagcatcccgagtagctgggattacaggtgtgcacgaccatgcctggctaatctttgtatttttagtagagacggggtttcaccttgttgatcaggctggtctagagttacctcttaagaagttcaacatgaggcataaaaatagattctagatattatgttacctttctttccttgtagcattcttgatt

SEQ ID NO: 16324 - DNA, 1850 bp, Homo sapiens
  ENST00000287820
actcatgggtgtattcacaaattctgttacttcaagtctttttcttttaacggattgatcttttgctagatagagacaaaatatcagtgtgaattacagcaaacccctattccatgctgttatgggtgaaactctgggagattctcctattgacccagaaagcgattccttcactgatacactgtctgcaaacatatcacaagaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaatttacttttaatattaaaaattaccatattatgaaattgctgatagta

SEQ ID NO: 16325 - DNA, 2002 bp, Homo sapiens
  ENST00000397023
agcaaacccctattccatgctgttatgggtgaaactctgggagattctcctattgacccagaaagcgattccttcactgatacactgtctgcaaacatatcacaagtgtttcaggatgattcttgtctctggatgtcgctgtcatgatgggagaggaattagtaaattcccaggtcagtttacactgcagagtgatcttgatctgcatgaatcagtaaggatgggctggataaacaagttggaaccacagttatgagtaccatgacattaactgaaacaaatgagaagggattgaaaaatcggcggttaagtgtcttttaaggtcatttccaacaaaactacaaaggacctatgaaaggcttttcagaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaatttacttttaatattaaaaattaccatattatgaaa

SEQ ID NO: 16326 - DNA, 1329 bp, Homo sapiens
  ENST00000396999
atgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgaggaactacaaaaggatagttattagattgccaaatcctgcagaacctccagcaggcacaagttggtttttctccctcaagaaagagaagtgagccaagcgtggtggtgcatgcctgtggtcccagctactcaggaggctgagccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggag

SEQ ID NO: 16327 - DNA, 6434 bp, Homo sapiens
  ENST00000367240
cgcgcttgggcggcggaggctgcagctacctcggcgccggctcggctctaggacgtgtcgggctgcacgggtcgggggcggctccctgctgcttccgagcctagccgcctggccttcggcatttgcagacacactgccctccagaaacgatgggtgtcgctagatccagctgggactctgccagcctccggcactcagtctaagagaagggccatcttccagccctgctgtccctgcctgtcatggccacattcggctgctgtctgcatgtctggggacacagggcacccagccccagccctgagaagttaagccaggccttctggctcagttccacaggggcactccagaccccaggcccctttcagagcaaaagcaactgatgctatgggagaagcccctgcccacctgtccactcgcctggcactgcccactctgagacccatgcactgggttcccctggaggtgccaaccctgtgagtccctccctgtcccctgacgctgagaaggccctgccaacccccaccatgtgtgaggtgatgcccacaatcaatgagggggaccgcctgggtccccctcatggcgccgatgctgacgccaacttcgagcagctgatggtgaacatgctggacgagcgggagaagttgctggagtctcttcgggagagtcaggagaccttggcggccacacagagccggctccaggatgccatacacgagcgggaccagctccagcgccaccttaactccgccctcccccaggaatttgccaccttaacccgggagctgagcatgtgtcgggagcagcttctagagcgggaggaagagatatcagaactgaaagcagaacggaataacacacggctgcttctggaacatctggagtgcctggtgtcccgccatgaacggtcactgcggatgactgtggtgaagcgccaggcccagtcaccttcgggggtctccagtgaggtggaggtgctgaaggccctcaagtcactgtttgagcaccacaaggccctggatgagaaggtgcgagagcggctccgggcagcgctggagcgagtcaccaccttggaggagcagctggcaggtgcccaccagcaggtgtctgccctgcagcagggggcaggggtgcgggatggagcggcagaagaggaggggactgtggagctggggccgaaacgcctgtggaaggaggatacgggccgggtagaggagctgcaggagctcctggagaagcagaactttgagttgagccaggcccgggagcgactggtcaccctaacaacaaccgtgactgaactcgaggaggacctgggcacggcccgccgggacctcatcaagtcggaggagctgagcagcaagcatcagcgggacctccgggaggctctggcccagaaggaggacatggaagagcggattactacactggagaagcgctacctggctgctcagcgtgaggcaacatccatccatgacctcaatgacaagctggagaatgagctggccaacaaggagtccctgcaccgccagtgtgaggagaaggcccgacacctgcaggagctgctggaggtggcagagcagaagctgcagcagacgatgcgcaaggcagagacgctgccagaggtggaggctgagctggcccagagaattgcagccctcaccaaggctgaagaacggcatggcaacattgaggagcacctgcggcagctggagggacagctggaggagaagaaccaggagctggcacgggtgcgccagcgggaaaagatgaatgaggaccacaacaagcggctgtcggacacagtggaccggctgctcagcgagtccaacgagcgtctgcagctccacctgaaggagcgcatggctgccctggaggagaagggccgcctgtctgaagagattgagaagctgcgccaagaggtggaccagctgaagggccgaggggggccgtttgtggatggcgtccactccaggtcgcacatgggcagtgcagcagacgtgcggttctccctgggcacaaccacacacgcacccccaggcgtgcatcgccgctactcggcattgagggaagagtctgccaaggactgggagacttctccactgcctgggatgctggccccggcagctggccctgcctttgacagtgaccctgagatctccgacgtggatgaggatgagccagggggtctggtgggctctgcggatgttgtctcccccagcggccactcagatgcccagaccctggccatgatgctgcaggagcagctggatgccatcaatgaggaaatcaggatgattcaggaagagaaggagtccacggagctccgcgcggaggagattgagacgcgtgtaaccagtggcagcatggaagccctaaacctgaagcagctgcgcaagcgtggttccatccccacctctctgacggccctgtccctggccagcgcgtccccaccactcagcggccgctccacacctaagctcacctcccgcagtgctgcccaggacctggaccgaatgggggtcatgaccctgcccagtgacttaagaaagcataggaggaagctgctgtcgccagtgtctcgggaagagaaccgagaggataaagccaccataaaatgtgagacttctcctccttcctcacccaggacgctgcggctagagaagcttggccacccagccctgagccaggaagaaggcaagagtgccttggaggatcagggcagcaaccccagcagcagcaacagcagccaggactccctgcacaagggcgccaagcgcaagggcatcaagtcgtccattggccgcctgtttgggaagaaggagaagggcaggctgatccagctgagtcgggatggagccacaggccatgttctgctaacagactccgaattcagtatgcaggagcctatggtgcctgccaagctggggacccaggcagagaaggaccggcggctaaagaagaaacaccagctgcttgaagatgcccgcaggaaaggaatgccctttgcccagtgggatggtcctactgtggtctcctggttggagctctgggtggggatgcctgcctggtatgtggcagcctgccgggccaacgtcaagagtggtgccatcatgtccgctctgtcggacacagagatccagcgggagatcggcatcagcaatgccctgcaccggctcaagctccgcctggccattcaggagatggtgtcattgaccagcccctctgccccacccacctccaggacttcttctgggaatgtctgggtcacccatgaagagatggaaactctggaaacatctactaaaacagacagtgaggagggcagctgggctcagaccctggcctatggggacatgaaccatgagtggattgggaatgaatggctacccagcctggggctcccgcagtaccgcagctacttcatggagtgcctggtggacgcccgcatgctggaccacctcaccaagaaggacctgcgggtccacctgaagatggtggacagcttccatcgaaccagtcttcagtatggcatcatgtgtctgaagaggctgaattatgaccggaaggagctggagaagaggcgagaggagagccagcatgagatcaaggatgtgttagtctggaccaacgaccaggtggttcattgggtccagtctattgggctccgggactacgcaggaaacctgcatgagagtggtgtgcatggagccttgctggccctggacgagaacttcgaccacaacacactggccctgatcctccagatccccacacagaacacccaggcacgccaagtgatggaaagagagttcaataacctgttggccttgggcacagaccggaagctggatgacggggatgacaaggtgtttcgccgcgcgccctcctggaggaagcgcttccggccgcgggagcaccacggtcgcggcggcatgctcagcgcttccgcggagaccctcccggcgggcttccgtgtgtccaccctggggaccctgcagcccccaccggccccgccaaagaagatcatgcctgaagctcactcccactatctctacggacacatgctctccgccttccgggactagccatggcccccagggctggcttcctccttctgggtttcacaggctcctctggccctgacccctcttgctcgttccccttccttccgcagctcctagtctcgtccgtgactttccggttgccctggatctcagaatatattcgtccaccccctcggcaccccattaccccgagtcccaccgtgtgtccgttgtaagtccggtggatgtggctggggtttcctggtattgtggaggcacccaggttgtccatgcttgggattctgggggaaggagagaagggcagctcagggtggatgtgaagccacccttcctcttctggacccagcctggtctgcactgcaacctccaccaggaccaggatcctgggccacaggctgggatggtccttccaagaaagggtcatttcagacgcagccctgcttgggctattcaatcttagggtgtctatccacgtctggctgtgccaaatggtctggcagctggttttggcatccccagcatcaccactctcccaacccatcaccgtgactgcagttcctgcccccattctcttggggtcagggaggggctgggaagggctactgaaggccccattctcccacaggatggtgaggctgggaggaggaagactgaggtagagattccaggccctggcataagctgaatcccaaatttgagtttgggaagaaccagagagaaatggatccctgagctctgagccaagggtgaggatggggaaactctaagctcccacctaataagaagcataggcagaccagccagagggagagccaatggcctctggtagccttaagcccaaagggcagtgggaatgtcccctgccccaaccatcgggtggagctcctgctgggctatggggaagggaggttgtgcggatcttgactctagggcagaacagatctaaccatgcattgctagctctgctcccagcatcccttccccttctctcctcctctgcctcacttctttagtaatcccaaccctataaaaatgaacctaatgggtggattgaatatacattgagcccaaagtcaagtttggggaaaaggcagactaaggcctcctttctctgacctcccaggaagaaaatagcttctcctacagtgattcatgtcccaggtccaggaaatccaatgttggtgaaggcagccactctcttgcttgtccccaaatcacctaaccctcatccagggctattttggtgggcagggactgcctcctcccggaattcctaagatccgcccagctgccaccattttcattgctttccccagcagcatgatgggaacccaagctgagggatacaggtcctgatttggtaggaatattattcccaagaaatacccgctcctcacctactccctcatcctaccaaggtgcctgaaaatgttcaagacttatgttcagggtgggatgatggaaccgagggcttcatcaaagtgagaggaaaggaaaagcatctggcatgtgtttcttggataggggccagtgcagtgccatcctacaggtggctggagcagctgctttgcaacctgatcaccttgagttctgagcagggactaggcttgcaggtgagataatgggccagggcacccagtccagaaggagcaatggcacctgggcagtgccagggcttaaagcccgctgctccttttcggtagaggagaggcccatcactggtgtggtggggtgggctctcccttaggcttgggcaaggcagccacctgcccttgctctcccttagtgttccctggcctccctgccatcaggttgctgggagtggagatggagggattattgagcagaaaatgagttggatggagataaacagctcccatccctgggtaatggatggtaagatgatggagattcctaagattggtggagttgggcaatgcatagccatctgactccttcagggtgctcttgatgggctggctgtaagggagactcagtcccagcctctcccctctacaactcctgccactgttggccatgtcgtaaggcagcagctgtgccaggatagctgggtccattcagagcaccttgagaagtgttgcagggaggtgttaagaagagaactctgtgcaaacagtgatggaaggctgttgtcttggtgtatcccttgcctcatagtcaatatattttttttttggcgagtcaccagtgacccgagccctccacaccagcctcctgtatctcatcaggtcccttctcagtactgtatttgctcagtgcatcaggaatgggtgtatgggtgtgtgtgggtgggtgtgagtgtgggtgtgtacgtaccaataaacaacctggttttaagacaatgta

SEQ ID NO: 16328 - DNA, 6349 bp, Homo sapiens
  ENST00000447715
atgtctgagagccccaaggacgagggctccgaagagtgtctgtttctgcagcgcctatgggagtggggggcagtggggggaactcagggaagctgcctacaacttgaggccttccccaggctggaggaggaggacagggaaggccgaggggagctgtcctccggctgccatcaccctgatgaggcggccctgccccgggctgtggtctccgcaggggctggcaaccttgcctttgtccagctctctccgtggccaggcctgccatctgcctgcccacactcctccccggcaaagccccttgcaaatgcttgctttggggactggcagctttcgcctctgaatcaggacctagcatcagtactctggggagggggtccaggtgccaaccctgtgagtccctccctgtcccctgacgctgagaaggccctgccaacccccaccatgtgtgaggtgatgcccacaatcaatgagggggaccgcctgggtccccctcatggcgccgatgctgacgccaacttcgagcagctgatggtgaacatgctggacgagcgggagaagttgctggagtctcttcgggagagtcaggagaccttggcggccacacagagccggctccaggatgccatacacgagcgggaccagctccagcgccaccttaactccgccctcccccaggaatttgccaccttaacccgggagctgagcatgtgtcgggagcagcttctagagcgggaggaagagatatcagaactgaaagcagaacggaataacacacggctgcttctggaacatctggagtgcctggtgtcccgccatgaacggtcactgcggatgactgtggtgaagcgccaggcccagtcaccttcgggggtctccagtgaggtggaggtgctgaaggccctcaagtcactgtttgagcaccacaaggccctggatgagaaggtgcgagagcggctccgggcagcgctggagcgagtcaccaccttggaggagcagctggcaggtgcccaccagcaggtgtctgccctgcagcagggggcaggggtgcgggatggagcggcagaagaggaggggactgtggagctggggccgaaacgcctgtggaaggaggatacgggccgggtagaggagctgcaggagctcctggagaagcagaactttgagttgagccaggcccgggagcgactggtcaccctaacaacaaccgtgactgaactcgaggaggacctgggcacggcccgccgggacctcatcaagtcggaggagctgagcagcaagcatcagcgggacctccgggaggctctggcccagaaggaggacatggaagagcggattactacactggagaagcgctacctggctgctcagcgtgaggcaacatccatccatgacctcaatgacaagctggagaatgagctggccaacaaggagtccctgcaccgccagtgtgaggagaaggcccgacacctgcaggagctgctggaggtggcagagcagaagctgcagcagacgatgcgcaaggcagagacgctgccagaggtggaggctgagctggcccagagaattgcagccctcaccaaggctgaagaacggcatggcaacattgaggagcacctgcggcagctggagggacagctggaggagaagaaccaggagctggcacggacggctgtgcaggtgcgccagcgggaaaagatgaatgaggaccacaacaagcggctgtcggacacagtggaccggctgctcagcgagtccaacgagcgtctgcagctccacctgaaggagcgcatggctgccctggaggagaagaacacgttgatccaggagttggagagctcccagcggcagattgaggagcagcaccaccacaagggccgcctgtctgaagagattgagaagctgcgccaagaggtggaccagctgaagggccgaggggggccgtttgtggatggcgtccactccaggtcgcacatgggcagtgcagcagacgtgcggttctccctgggcacaaccacacacgcacccccaggcgtgcatcgccgctactcggcattgagggaagagtctgccaagctggccctgcctttgacagtgaccctgagatctccgacgtggatgaggatgagccagggggtctgctgcaacttagagtaccacagttcagggaccctctgtgggtcatcaggcccgctgccagtgccggagatgattcaggaagagaaggagtccacggagctccgcgcggaggagattgagacgcgtgtaaccagtggcagcatggaagccctaaacctgaagcagctgcgcaagcgtggttccatccccacctctctgacggccctgtccctggccagcgcgtccccaccactcagcggccgctccacacctaagctcacctcccgcagtgctgcccaggacctggaccgaatgggggtcatgaccctgcccagtgacttaagaaagcataggaggaagctgctgtcgccagtgtctcgggaagagaaccgagaggataaagccaccataaaatgtgagacttctcctccttcctcacccaggacgctgcggctagagaagcttggccacccagccctgagccaggaagaaggcaagagtgccttggaggatcagggcagcaaccccagcagcagcaacagcagccaggactccctgcacaagggcgccaagcgcaagggcatcaagtcgtccattggccgcctgtttgggaagaaggagaagggcaggctgatccagctgagtcgggatggagccacaggccatgttctgctaacagactccgaattcagtatgcaggagcctatggtgcctgccaagctggggacccaggcagagaaggaccggcggctaaagaagaaacaccagctgcttgaagatgcccgcaggaaaggaatgccctttgcccagtgggatggtcctactgtggtctcctggttggagctctgggtggggatgcctgcctggtatgtggcagcctgccgggccaacgtcaagagtggtgccatcatgtccgctctgtcggacacagagatccagcgggagatcggcatcagcaatgccctgcaccggctcaagctccgcctggccattcaggagatggtgtcattgaccagcccctctgccccacccacctccaggacttcttctgggaatgtctgggtcacccatgaagagatggaaactctggaaacatctactaaaacagacagtgaggagggcagctgggctcagaccctggcctatggggacatgaaccatgagtggattgggaatgaatggctacccagcctggggctcccgcagtaccgcagctacttcatggagtgcctggtggacgcccgcatgctggaccacctcaccaagaaggacctgcgggtccacctgaagatggtggacagcttccatcgaaccagtcttcagtatggcatcatgtgtctgaagaggctgaattatgaccggaaggagctggagaagaggcgagaggagagccagcatgagatcaaggatgtgttagtctggaccaacgaccaggtggttcattgggtccagtctattgggctccgggactacgcaggaaacctgcatgagagtggtgtgcatggagccttgctggccctggacgagaacttcgaccacaacacactggccctgatcctccagatccccacacagaacacccaggcacgccaagtgatggaaagagagttcaataacctgttggccttgggcacagaccggaagctggatgacggggatgacaaggtgtttcgccgcgcgccctcctggaggaagcgcttccggccgcgggagcaccacggtcgcggcggcatgctcagcgcttccgcggagaccctcccggcgggcttccgtgtgtccaccctggggaccctgcagcccccaccggccccgccaaagaagatcatgcctgaagctcactcccactatctctacggacacatgctctccgccttccgggactagccatggcccccagggctggcttcctccttctgggtttcacaggctcctctggccctgacccctcttgctcgttccccttccttccgcagctcctagtctcgtccgtgactttccggttgccctggatctcagaatatattcgtccaccccctcggcaccccattaccccgagtcccaccgtgtgtccgttgtaagtccggtggatgtggctggggtttcctggtattgtggaggcacccaggttgtccatgcttgggattctgggggaaggagagaagggcagctcagggtggatgtgaagccacccttcctcttctggacccagcctggtctgcactgcaacctccaccaggaccaggatcctgggccacaggctgggatggtccttccaagaaagggtcatttcagacgcagccctgcttgggctattcaatcttagggtgtctatccacgtctggctgtgccaaatggtctggcagctggttttggcatccccagcatcaccactctcccaacccatcaccgtgactgcagttcctgcccccattctcttggggtcagggaggggctgggaagggctactgaaggccccattctcccacaggatggtgaggctgggaggaggaagactgaggtagagattccaggccctggcataagctgaatcccaaatttgagtttgggaagaaccagagagaaatggatccctgagctctgagccaagggtgaggatggggaaactctaagctcccacctaataagaagcataggcagaccagccagagggagagccaatggcctctggtagccttaagcccaaagggcagtgggaatgtcccctgccccaaccatcgggtggagctcctgctgggctatggggaagggaggttgtgcggatcttgactctagggcagaacagatctaaccatgcattgctagctctgctcccagcatcccttccccttctctcctcctctgcctcacttctttagtaatcccaaccctataaaaatgaacctaatgggtggattgaatatacattgagcccaaagtcaagtttggggaaaaggcagactaaggcctcctttctctgacctcccaggaagaaaatagcttctcctacagtgattcatgtcccaggtccaggaaatccaatgttggtgaaggcagccactctcttgcttgtccccaaatcacctaaccctcatccagggctattttggtgggcagggactgcctcctcccggaattcctaagatccgcccagctgccaccattttcattgctttccccagcagcatgatgggaacccaagctgagggatacaggtcctgatttggtaggaatattattcccaagaaatacccgctcctcacctactccctcatcctaccaaggtgcctgaaaatgttcaagacttatgttcagggtgggatgatggaaccgagggcttcatcaaagtgagaggaaaggaaaagcatctggcatgtgtttcttggataggggccagtgcagtgccatcctacaggtggctggagcagctgctttgcaacctgatcaccttgagttctgagcagggactaggcttgcaggtgagataatgggccagggcacccagtccagaaggagcaatggcacctgggcagtgccagggcttaaagcccgctgctccttttcggtagaggagaggcccatcactggtgtggtggggtgggctctcccttaggcttgggcaaggcagccacctgcccttgctctcccttagtgttccctggcctccctgccatcaggttgctgggagtggagatggagggattattgagcagaaaatgagttggatggagataaacagctcccatccctgggtaatggatggtaagatgatggagattcctaagattggtggagttgggcaatgcatagccatctgactccttcagggtgctcttgatgggctggctgtaagggagactcagtcccagcctctcccctctacaactcctgccactgttggccatgtcgtaaggcagcagctgtgccaggatagctgggtccattcagagcaccttgagaagtgttgcagggaggtgttaagaagagaactctgtgcaaacagtgatggaaggctgttgtcttggtgtatcccttgcctcatagtcaatatattttttttttggcgagtcaccagtgacccgagccctccacaccagcctcctgtatctcatcaggtcccttctcagtactgtatttgctcagtgcatcaggaatgggtgtatgggtgtgtgtgggtgggtgtgagtgtgggtgtgtacgtaccaataaacaacctggttttaagacaatgtacaaa

SEQ ID NO: 16329 - DNA, 558 bp, Homo sapiens
  ENST00000601609
gaagcagaactttgagttgagccaggcccgggagcgactggtcaccctaacaacaaccgtgactgaactcgaggaggacctgggcacggcccgccgggacctcatcaagtcggaggagctgagcagcaagcatcagcgggacctccgggaggctctggcccagaaggaggacatggaagagcggattactacactggagaagcgctacctggctgctcagcgtgaggcaacatccatccatgacctcaatgacaagctggagaatgagctggccaacaaggagtccctgcaccgccagtgtgaggagaaggcccgacacctgcaggagctgctggaggtggcagagcagaagctgcagcagacgatgcgcaaggcagagacgctgccagaggtggaggctgagctggcccagagaattgcagccctcaccaaggcaagtgggccaggggcctgggatctgcctctgtcccccatgttctgagctctcagggagccaggcagggaagggagcgcgtgggaggcgcactgggccaggagccagaaaactgcttcccgccg

SEQ ID NO: 16330 - DNA, 2967 bp, Homo sapiens
  ENST00000600426
cgtgactgaactcgaggaggacctgggcacggcccgccgggacctcatcaagtcggaggagctgagcagcaagcatcagcgggacctccgggaggctctggcccagaaggaggacatggaagagcggattactacactggagaagcgctacctggctgctcagcgtgaggcaacatccatccatgacctcaatgacaagctggagaatgagctggccaacaaggagtccctgcaccgccagtgtgaggagaaggcccgacacctgcaggagctgctggaggtggcagagcagaagctgcagcagacgatgcgcaaggcagagacgctgccagaggtggaggctgagctggcccagagaattgcagccctcaccaaggctgaagaacggcatggcaacattgaggagcacctgcggcagctggagggacagctggaggagaagaaccaggagctggcacgggtgcgccagcgggaaaagatgaatgaggaccacaacaagcggctgtcggacacagtggaccggctgctcagcgagtccaacgagcgtctgcagctccacctgaaggagcgcatggctgccctggaggagaagaacacgttgatccaggagttggagagctcccagcggcagattgaggagcagcaccaccacaagggccgcctgtctgaagagattgagaagctgcgccaagaggtggaccagctgaagggccgaggggggccgtttgtggatggcgtccactccaggtcgcacatgggcagtgcagcagacgtgcggttctccctgggcacaaccacacacgcacccccaggcgtgcatcgccgctactcggcattgagggaagagtctgccaaggactgggagacttctccactgcctgggatgctggccccggcagctggccctgcctttgacagtgaccctgagatctccgacgtggatgaggatgagccagggggtctggtgggctctgcggatgttgtctcccccagcggccactcagatgcccagaccctggccatgatgctgcaggagcagctggatgccatcaatgaggaaatcaggatgattcaggaagagaaggagtccacggagctccgcgcggaggagattgagacgcgtgtaaccagtggcagcatggaagccctaaacctgaagcagctgcgcaagcgtggttccatccccacctctctgacggccctgtccctggccagcgcgtccccaccactcagcggccgctccacacctaagctcacctcccgcagtgctgcccaggacctggaccgaatgggggtcatgaccctgcccagtgacttaagaaagcataggaggaagctgctgtcgccagtgtctcgggaagagaaccgagaggataaagccaccataaaatgtgagacttctcctccttcctcacccaggacgctgcggctagagaagcttggccacccagccctgagccaggaagaaggcaagagtgccttggaggatcagggcagcaaccccagcagcagcaacagcagccaggactccctgcacaagggcgccaagcgcaagggcatcaagtcgtccattggccgcctgtttgggaagaaggagaagggcaggctgatccagctgagtcgggatggagccacaggccatgttctgctaacagactccgaattcagtatgcaggagcctatggtgcctgccaagctggggacccaggcagagaaggaccggcggctaaagaagaaacaccagctgcttgaagatgcccgcaggaaaggaatgccctttgcccagtgggatggtcctactgtggtctcctggttggagctctgggtggggatgcctgcctggtatgtggcagcctgccgggccaacgtcaagagtggtgccatcatgtccgctctgtcggacacagagatccagcgggagatcggcatcagcaatgccctgcaccggctcaagctccgcctggccattcaggagatggtgtcattgaccagcccctctgccccacccacctccaggacttcttctgggaatgtctgggtcacccatgaagagatggaaactctggaaacatctactaaaacagacagtgaggagggcagctgggctcagaccctggcctatggggacatgaaccatgagtggattgggaatgaatggctacccagcctggggctcccgcagtaccgcagctacttcatggagtgcctggtggacgcccgcatgctggaccacctcaccaagaaggacctgcgggtccacctgaagatggtggacagcttccatcgaaccagtcttcagtatggcatcatgtgtctgaagaggctgaattatgaccggaaggagctggagaagaggcgagaggagagccagcatgagatcaaggatgtgttagtctggaccaacgaccaggtggttcattgggtccagtctattgggctccgggactacgcaggaaacctgcatgagagtggtgtgcatggagccttgctggccctggacgagaacttcgaccacaacacactggccctgatcctccagatccccacacagaacacccaggcacgccaagtgatggaaagagagttcaataacctgttggccttgggcacagaccggaagctggatgacggggatgacaaggtgtttcgccgcgcgccctcctggaggaagcgcttccggccgcgggagcaccacggtcgcggcggcatgctcagcgcttccgcggagaccctcccggcgggcttccgtgtgtccaccctggggaccctgcagcccccaccggccccgccaaagaagatcatgcctgaagctcactcccactatctctacggacacatgctctccgccttccgggactagccatggcccccagggctggcttcctccttctgggtttcacaggctcctctggccctgacccctcttgctcgttccccttccttccgcagctcctagtctcgtccgtg

SEQ ID NO: 16331 - DNA, 5045 bp, Homo sapiens
  ENST00000272198
attttctctggcttgtgtttctgacagtgttagggcctcctaaagcttcctaggcataggggtatgcctggcttgaattttaaccagggactcagtccagattatggggagacccgaggaaaagtgctgggtagaagaccaaaaaacaaagaccctcagagtgaaaagggcctctagacatcatcccttccaacatctcccagtgcctggagccctcctgcgccacgtgtgtcagatggccggagagcctctgctcgaatacctctttgatggggagctcaactttttaaaagccaccagttgcatcgtaagccaactcttgccattagaagatccttcttatgccagacggaaaaccgctctctggaactttctcccctggctcattctgacccctggagcaccagggcatacgtctgctctcttgcttacacggcagcccttcagacatttgtgacagctctgtgtcctgctaagatgtctcttctctgagctgaagatcccttgactctttgggcccactgggtgtgagctgggggtctcagtcctcagggcctgtcttttctctcccccatcaccgctcaaggtcgcacatgggcagtgcagcagacgtgcggttctccctgggcacaaccacacacgcacccccaggcgtgcatcgccgctactcggcattgagggaagagtctgccaaggactgggagacttctccactgcctgggatgctggccccggcagctggccctgcctttgacagtgaccctgagatctccgacgtggatgaggatgagccagggggtctggtgggctctgcggatgttgtctcccccagcggccactcagatgcccagaccctggccatgatgctgcaggagcagctggatgccatcaatgaggaaatcaggatgattcaggaagagaaggagtccacggagctccgcgcggaggagattgagacgcgtgtaaccagtggcagcatggaagccctaaacctgaagcagctgcgcaagcgtggttccatccccacctctctgacggccctgtccctggccagcgcgtccccaccactcagcggccgctccacacctaagctcacctcccgcagtgctgcccaggacctggaccgaatgggggtcatgaccctgcccagtgacttaagaaagcataggaggaagctgctgtcgccagtgtctcgggaagagaaccgagaggataaagccaccataaaatgtgagacttctcctccttcctcacccaggacgctgcggctagagaagcttggccacccagccctgagccaggaagaaggcaagagtgccttggaggatcagggcagcaaccccagcagcagcaacagcagccaggactccctgcacaagggcgccaagcgcaagggcatcaagtcgtccattggccgcctgtttgggaagaaggagaagggcaggctgatccagctgagtcgggatggagccacaggccatgttctgctaacagactccgaattcagtatgcaggagcctatggtgcctgccaagctggggacccaggcagagaaggaccggcggctaaagaagaaacaccagctgcttgaagatgcccgcaggaaaggaatgccctttgcccagtgggatggtcctactgtggtctcctggttggagctctgggtggggatgcctgcctggtatgtggcagcctgccgggccaacgtcaagagtggtgccatcatgtccgctctgtcggacacagagatccagcgggagatcggcatcagcaatgccctgcaccggctcaagctccgcctggccattcaggagatggtgtcattgaccagcccctctgccccacccacctccaggacttcttctgggaatgtctgggtcacccatgaagagatggaaactctggaaacatctactaaaacagacagtgaggagggcagctgggctcagaccctggcctatggggacatgaaccatgagtggattgggaatgaatggctacccagcctggggctcccgcagtaccgcagctacttcatggagtgcctggtggacgcccgcatgctggaccacctcaccaagaaggacctgcgggtccacctgaagatggtggacagcttccatcgaaccagtcttcagtatggcatcatgtgtctgaagaggctgaattatgaccggaaggagctggagaagaggcgagaggagagccagcatgagatcaaggatgtgttagtctggaccaacgaccaggtggttcattgggtccagtctattgggctccgggactacgcaggaaacctgcatgagagtggtgtgcatggagccttgctggccctggacgagaacttcgaccacaacacactggccctgatcctccagatccccacacagaacacccaggcacgccaagtgatggaaagagagttcaataacctgttggccttgggcacagaccggaagctggatgacggggatgacaaggtgtttcgccgcgcgccctcctggaggaagcgcttccggccgcgggagcaccacggtcgcggcggcatgctcagcgcttccgcggagaccctcccggcgggcttccgtgtgtccaccctggggaccctgcagcccccaccggccccgccaaagaagatcatgcctgaagctcactcccactatctctacggacacatgctctccgccttccgggactagccatggcccccagggctggcttcctccttctgggtttcacaggctcctctggccctgacccctcttgctcgttccccttccttccgcagctcctagtctcgtccgtgactttccggttgccctggatctcagaatatattcgtccaccccctcggcaccccattaccccgagtcccaccgtgtgtccgttgtaagtccggtggatgtggctggggtttcctggtattgtggaggcacccaggttgtccatgcttgggattctgggggaaggagagaagggcagctcagggtggatgtgaagccacccttcctcttctggacccagcctggtctgcactgcaacctccaccaggaccaggatcctgggccacaggctgggatggtccttccaagaaagggtcatttcagacgcagccctgcttgggctattcaatcttagggtgtctatccacgtctggctgtgccaaatggtctggcagctggttttggcatccccagcatcaccactctcccaacccatcaccgtgactgcagttcctgcccccattctcttggggtcagggaggggctgggaagggctactgaaggccccattctcccacaggatggtgaggctgggaggaggaagactgaggtagagattccaggccctggcataagctgaatcccaaatttgagtttgggaagaaccagagagaaatggatccctgagctctgagccaagggtgaggatggggaaactctaagctcccacctaataagaagcataggcagaccagccagagggagagccaatggcctctggtagccttaagcccaaagggcagtgggaatgtcccctgccccaaccatcgggtggagctcctgctgggctatggggaagggaggttgtgcggatcttgactctagggcagaacagatctaaccatgcattgctagctctgctcccagcatcccttccccttctctcctcctctgcctcacttctttagtaatcccaaccctataaaaatgaacctaatgggtggattgaatatacattgagcccaaagtcaagtttggggaaaaggcagactaaggcctcctttctctgacctcccaggaagaaaatagcttctcctacagtgattcatgtcccaggtccaggaaatccaatgttggtgaaggcagccactctcttgcttgtccccaaatcacctaaccctcatccagggctattttggtgggcagggactgcctcctcccggaattcctaagatccgcccagctgccaccattttcattgctttccccagcagcatgatgggaacccaagctgagggatacaggtcctgatttggtaggaatattattcccaagaaatacccgctcctcacctactccctcatcctaccaaggtgcctgaaaatgttcaagacttatgttcagggtgggatgatggaaccgagggcttcatcaaagtgagaggaaaggaaaagcatctggcatgtgtttcttggataggggccagtgcagtgccatcctacaggtggctggagcagctgctttgcaacctgatcaccttgagttctgagcagggactaggcttgcaggtgagataatgggccagggcacccagtccagaaggagcaatggcacctgggcagtgccagggcttaaagcccgctgctccttttcggtagaggagaggcccatcactggtgtggtggggtgggctctcccttaggcttgggcaaggcagccacctgcccttgctctcccttagtgttccctggcctccctgccatcaggttgctgggagtggagatggagggattattgagcagaaaatgagttggatggagataaacagctcccatccctgggtaatggatggtaagatgatggagattcctaagattggtggagttgggcaatgcatagccatctgactccttcagggtgctcttgatgggctggctgtaagggagactcagtcccagcctctcccctctacaactcctgccactgttggccatgtcgtaaggcagcagctgtgccaggatagctgggtccattcagagcaccttgagaagtgttgcagggaggtgttaagaagagaactctgtgcaaacagtgatggaaggctgttgtcttggtgtatcccttgcctcatagtcaatatattttttttttggcgagtcaccagtgacccgagccctccacaccagcctcctgtatctcatcaggtcccttctcagtactgtatttgctcagtgcatcaggaatgggtgtatgggtgtgtgtgggtgggtgtgagtgtgggtgtgtacgtaccaataaacaacctggttttaagacaatgta

SEQ ID NO: 16332 - DNA, 3178 bp, Homo sapiens
  ENST00000599966
aggggtatgcctggcttgaattttaaccagggactcagtccagattatggggagacccgaggaaaagtgctgggtagaagaccaaaaaacaaagaccctcagagtgaaaagggcctctagacatcatcccttccaacatctcccagtgcctggagccctcctgcgccacgtgtgtcagatggccggagagcctctgctcgaatacctctttgatggggagctcaactttttaaaagccaccagttgcatcgtaagccaactcttgccattagaagatccttcttatgccagacggaaaaccgctctctggaactttctcccctggctcattctgacccctggagcaccagggcatacgtctgctctcttgcttacacggcagcccttcagacatttgtgacagctctgtgtcctgctaagatgtctcttctctgagctgaagatcccttgactctttgggcccactgggtgtgagctgggggtctcagtcctcagggcctgtcttttctctcccccatcaccgctcaaggtcgcacatgggcagtgcagcagacgtgcggttctccctgggcacaaccacacacgcacccccaggcgtgcatcgccgctactcggcattgagggaagagtctgccaaggactgggagacttctccactgcctgggatgctggccccggcagctggccctgcctttgacagtgaccctgagatctccgacgtggatgaggatgagccagggggtctggtgggctctgcggatgttgtctcccccagcggccactcagatgcccagaccctggccatgatgctgcaggagcagctggatgccatcaatgaggaaatcaggatgattcaggaagagaaggagtccacggagctccgcgcggaggagattgagacgcgtgtaaccagtggcagcatggaagccctaaacctgaagcagctgcgcaagcgtggttccatccccacctctctgacggccctgtccctggccagcgcgtccccaccactcagcggccgctccacacctaagctcacctcccgcagtgctgcccaggacctggaccgaatgggggtcatgaccctgcccagtgacttaagaaagcataggaggaagctgctgtcgccagtgtctcgggaagagaaccgagaggataaagccaccataaaatgtgagacttctcctccttcctcacccaggacgctgcggctagagaagcttggccacccagccctgagccaggaagaaggcaagagtgccttggaggatcagggcagcaaccccagcagcagcaacagcagccaggactccctgcacaagggcgccaagcgcaagggcatcaagtcgtccattggccgcctgtttgggaagaaggagaagggcaggctgatccagctgagtcgggatggagccacaggccatgttctgctaacagactccgaattcagtatgcaggagcctatggtgcctgccaagctggggacccaggcagagaaggaccggcggctaaagaagaaacaccagctgcttgaagatgcccgcaggaaaggaatgccctttgcccagtgggatggtcctactgtggtctcctggttggagctctgggtggggatgcctgcctggtatgtggcagcctgccgggccaacgtcaagagtggtgccatcatgtccgctctgtcggacacagagatccagcgggagatcggcatcagcaatgccctgcaccggctcaagctccgcctggccattcaggagatggtgtcattgaccagcccctctgccccacccacctccaggacttcttctgggaatgtctgggtcacccatgaagagatggaaactctggaaacatctactaaaacaaccctggcctatggggacatgaaccatgagtggattgggaatgaatggctacccagcctggggctcccgcagtaccgcagctacttcatggagtgcctggtggacgcccgcatgctggaccacctcaccaagaaggacctgcgggtccacctgaagatggtggacagcttccatcgaaccagtcttcagtatggcatcatgtgtctgaagaggctgaattatgaccggaaggagctggagaagaggcgagaggagagccagcatgagatcaaggatgtgttagtctggaccaacgaccaggtggttcattgggtccagtctattgggctccgggactacgcaggaaacctgcatgagagtggtgtgcatggagccttgctggccctggacgagaacttcgaccacaacacactggccctgatcctccagatccccacacagaacacccaggcacgccaagtgatggaaagagagttcaataacctgttggccttgggcacagaccggaagctggatgacggggatgacaaggtgtttcgccgcgcgccctcctggaggaagcgcttccggccgcgggagcaccacggtcgcggcggcatgctcagcgcttccgcggagaccctcccggcgggcttccgtgtgtccaccctggggaccctgcagcccccaccggccccgccaaagaagatcatgcctgaagctcactcccactatctctacggacacatgctctccgccttccgggactagccatggcccccagggctggcttcctccttctgggtttcacaggctcctctggccctgacccctcttgctcgttccccttccttccgcagctcctagtctcgtccgtgactttccggttgccctggatctcagaatatattcgtccaccccctcggcaccccattaccccgagtcccaccgtgtgtccgttgtaagtccggtggatgtggctggggtttcctggtattgtggaggcacccaggttgtccatgcttgggattctgggggaaggagagaagggcagctcagggtggatgtgaagccacccttcctcttctggacccagcctggtctgcactgcaacctccaccaggaccaggatcctgggccacaggctgggatggtccttccaagaaagggtcatttcagacgcagccctgcttgggctattcaatcttagggtgtctatccacgtctggctgtgccaaatggtctggcagctggttttggcatccccagcatcaccactctcccaacccatcaccgtgactgcagttcctgcccccattctcttggggtcaggg

SEQ ID NO: 16333 - DNA, 385 bp, Homo sapiens
  ENST00000600447
agttatctgggtgtcttattacgactcctttaccctcctcctttgctaaggactgggagacttctccactgcctgggatgctggccccggcagctggccctgcctttgacagtgaccctgagatctccgacgtggatgaggatgagccagggggtctggtgggctctgcggatgttgtctcccccagcggccactcagatgcccagaccctggccatgatgctgcaggagcagctggatgccatcaatgaggaaatcaggatgattcaggaagagaaggagtccacggagctccgcgcggaggagattgagacgcgtgtaaccagtggcagcatggaagccctaaacctgaagcagctgcgcaagcgtggttccatccccacctc

SEQ ID NO: 16334 - DNA, 573 bp, Homo sapiens
  ENST00000599514
tgctaaggactgggagacttctccactgcctgggatgctggccccggcagctggccctgcctttgacagtgaccctgagatctccgacgtggatgaggatgagccagggggtctggtgggctctgcggatgttgtctcccccagcggccactcagatgcccagaccctggccatgatgctgcaggagcagctggatgccatcaatgaggaaatcaggatgattcaggaagagaaggagtccacggagctccgcgcggaggagattgagacgcgtgtaaccagtggcagcatggaagccctaaacctgaagcagctgcgcaagcgtggttccatccccacctctctgacggccctgtccctggccagcgcgtccccaccactcagcggccgctccacacctaagctcacctcccgcagtgctgcccaggacctggaccgaatgggggtcatgaccctgcccagtgacttaagaaagcataggaggaagctgctggacgctgcggctagagaagcttggccacccagccctgagccaggaagaaggcaagagtgccttggaggatcagggcagca

SEQ ID NO: 16335 - DNA, 560 bp, Homo sapiens
  ENST00000594656
tggtggaggaatggggagtgttgggagagctgggcatcttgcctggctcccagtcaagcctgggaggtgtgtgtttttgccacacacacatttgccccacctcaacgcaaacatgggtgcacacaccaaccttgtgttctctcttaaccatcctgacgagctttccccagtcacccagccagatactgggatgtctttttcctctccttgatggggcctagggtagagctgatgggtttcttgactttgcctgtttcccctaacacgctgcactcgttcctgctaggacagtgaggagggcagctgggctcagaccctggcctatggggacatgaaccatgagtggattgggaatgaatggctacccagcctggggctcccgcagtaccgcagctacttcatggagtgcctggtggacgcccgcatgctggaccacctcaccaagaaggacctgcgggtccacctgaagatggtggacagcttccatcgaaccagtcttcagtatggcatcatgtgtctgaagaggctgaattatgaccggaaggagctggagaagaggc

SEQ ID NO: 16336 - DNA, 4547 bp, Homo sapiens
  ENST00000486360
tggttggtgtccactgttgctaacttcatttatatgcttcataatgggcacattacatatagtcttatatgtatcagctattacattgtaaaagagaacaaaatagactttttctatctgaaaacatcaagtaagggtaaggaaagagtgaggtagggtcgctatgaaaactaaagctttctcaagttgggtggtcacggagcaccctgcccaggtcaggaggccacgtccacatggcacaggccctgcaggaccacacggcagggtgtgcgtgggaaagcaacagaggacctggagtgttcttggagcagaggctcaggccttagagaatgagtgctgctggctattcaggcacaggccaccaccctttatttttttcagtcttctgccaacatttaacttccttgcttcctccatgaagccagccttgtcccggagtgagacaggcttcctttgccacgctgcaggtcctctgtaacacagcctctcccctgggctcagcgggcttgaggctcactgagagtcaggaaggcacgtctgctgcacaataccgcaaatgcaacccagagtcaacaggaaggatttcatattagctgctgccgggatagctacttctgttcattagtgtagataattgatatgtgagtggaaccgtatcatttcgagatcttaaaaagttccatttaaaatcctcacctcccaccactaccagcccccttattgaagataaactgaaattgtattggactgcccttcctccctcatgggtggaggatggattcatgtgtctcccgaccagctataccagcctcagcctgctggctctaccttcctcccccataatagcctcctgcatctcatttccctagaccctggcctatggggacatgaaccatgagtggattgggaatgaatggctacccagcctggggctcccgcagtaccgcagctacttcatggagtgcctggtggacgcccgcatgctggaccacctcaccaagaaggacctgcgggtccacctgaagatggtggacagcttccatcgaaccagtcttcagtatggcatcatgtgtctgaagaggctgaattatgaccggaaggagctggagaagaggcgagaggagagccagcatgagatcaaggatgtgttagtctggaccaacgaccaggtggttcattgggtccagtctattgggctccgggactacgcaggaaacctgcatgagagtggtgtgcatggagccttgctggccctggacgagaacttcgaccacaacacactggccctgatcctccagatccccacacagaacacccaggcacgccaagtgatggaaagagagttcaataacctgttggccttgggcacagaccggaagctggatgacggggatgacaaggtgtttcgccgcgcgccctcctggaggaagcgcttccggccgcgggagcaccacggtcgcggcggcatgctcagcgcttccgcggagaccctcccggcgggcttccgtgtgtccaccctggggaccctgcagcccccaccggccccgccaaagaagatcatgcctgaaggtgagtaacaggcgggctgggcatggccgaggcccagccgagcgcgggcttcttcctggcaccccagggccgggccgggtggagaggggcgaggccgaggctggtgccccgcgctcctgcgctgcagctgcactaacgctccgcggggagcgtgtgtgcgcactaacccgccgctctgtgtgttctcccgcggctgccgacttctcccagctgggacggcggggtcgcagagactggagacctccacggttcggacctactcctgctgaccccccatcctcccgccccgggtctgacgggggagtgcccgtggctcggggtaagtgggccaggcccggggacgcgggcaccttgctgctggccctcggccccacgcacctgcccttggctgccggcctggccctgccgctccagtcccgcttaccagcactgcctggcttgccccttcctgcttcgtctggcctggggcgctttgcgcttggagcacgctgcgttgccgctgtcgcacacatcctacaacctctctcgcagatgccctgcaacctgcctcacagtgcgatgcctgtctctctctctccctcagctcactcccactatctctacggacacatgctctccgccttccgggactagccatggcccccagggctggcttcctccttctgggtttcacaggctcctctggccctgacccctcttgctcgttccccttccttccgcagctcctagtctcgtccgtgactttccggttgccctggatctcagaatatattcgtccaccccctcggcaccccattaccccgagtcccaccgtgtgtccgttgtaagtccggtggatgtggctggggtttcctggtattgtggaggcacccaggttgtccatgcttgggattctgggggaaggagagaagggcagctcagggtggatgtgaagccacccttcctcttctggacccagcctggtctgcactgcaacctccaccaggaccaggatcctgggccacaggctgggatggtccttccaagaaagggtcatttcagacgcagccctgcttgggctattcaatcttagggtgtctatccacgtctggctgtgccaaatggtctggcagctggttttggcatccccagcatcaccactctcccaacccatcaccgtgactgcagttcctgcccccattctcttggggtcagggaggggctgggaagggctactgaaggccccattctcccacaggatggtgaggctgggaggaggaagactgaggtagagattccaggccctggcataagctgaatcccaaatttgagtttgggaagaaccagagagaaatggatccctgagctctgagccaagggtgaggatggggaaactctaagctcccacctaataagaagcataggcagaccagccagagggagagccaatggcctctggtagccttaagcccaaagggcagtgggaatgtcccctgccccaaccatcgggtggagctcctgctgggctatggggaagggaggttgtgcggatcttgactctagggcagaacagatctaaccatgcattgctagctctgctcccagcatcccttccccttctctcctcctctgcctcacttctttagtaatcccaaccctataaaaatgaacctaatgggtggattgaatatacattgagcccaaagtcaagtttggggaaaaggcagactaaggcctcctttctctgacctcccaggaagaaaatagcttctcctacagtgattcatgtcccaggtccaggaaatccaatgttggtgaaggcagccactctcttgcttgtccccaaatcacctaaccctcatccagggctattttggtgggcagggactgcctcctcccggaattcctaagatccgcccagctgccaccattttcattgctttccccagcagcatgatgggaacccaagctgagggatacaggtcctgatttggtaggaatattattcccaagaaatacccgctcctcacctactccctcatcctaccaaggtgcctgaaaatgttcaagacttatgttcagggtgggatgatggaaccgagggcttcatcaaagtgagaggaaaggaaaagcatctggcatgtgtttcttggataggggccagtgcagtgccatcctacaggtggctggagcagctgctttgcaacctgatcaccttgagttctgagcagggactaggcttgcaggtgagataatgggccagggcacccagtccagaaggagcaatggcacctgggcagtgccagggcttaaagcccgctgctccttttcggtagaggagaggcccatcactggtgtggtggggtgggctctcccttaggcttgggcaaggcagccacctgcccttgctctcccttagtgttccctggcctccctgccatcaggttgctgggagtggagatggagggattattgagcagaaaatgagttggatggagataaacagctcccatccctgggtaatggatggtaagatgatggagattcctaagattggtggagttgggcaatgcatagccatctgactccttcagggtgctcttgatgggctggctgtaagggagactcagtcccagcctctcccctctacaactcctgccactgttggccatgtcgtaaggcagcagctgtgccaggatagctgggtccattcagagcaccttgagaagtgttgcagggaggtgttaagaagagaactctgtgcaaacagtgatggaaggctgttgtcttggtgtatcccttgcctcatagtcaatatattttttttttggcgagtcaccagtgacccgagccctccacaccagcctcctgtatctcatcaggtcccttctcagtactgtatttgctcagtgcatcaggaatgggtgtatgggtgtgtgtgggtgggtgtgagtgtgggtgtgtacgtaccaataaacaacctggttttaagacaatgt

SEQ ID NO: 16337 - DNA, 496 bp, Homo sapiens
  ENST00000597023
tttcccatcaatccatccccaggcccgctccctgactgagagggaggatatgggttagacagagaaagggagtaacctcgggatgggtcgcaggcaaggccctggggaaggaggagcatgaggaggctggggtgctctttgtgctggaggcagtaggtctggacatgctgtggctgatgctggatgtgagacaggtggtgtgggaatgtggccccactgaggctctggcttgggggctgtgtgcctgcagaaccagtcttcagtatggcatcatgtgtctgaagaggctgaattatgaccggaaggagctggagaagaggcgagaggagagccagcatgagatcaaggatgtgttagtctggaccaacgaccaggtggttcattgggtccagtctattgggctccgggactacgcaggaaacctgcatgagagtggtgtgcatggagccttgctggccctggacgagaacttcgaccacaacacactggccctgat

SEQ ID NO: 16338 - DNA, 576 bp, Homo sapiens
  ENST00000594572
acggttcggacctactcctgctgaccccccatcctcccgccccgggtctgacgggggagtgcccgtggctcgggctcctagtctcgtccgtgactttccggttgccctggatctcagaatatattcgtccaccccctcggcaccccattaccccgagtcccaccgtgtgtccgttgtaagtccggtggatgtggctggggtttcctggtattgtggaggcacccaggttgtccatgcttgggattctgggggaaggagagaagggcagctcagggtggatgtgaagccacccttcctcttctggacccagcctggtctgcactgcaacctccaccaggaccaggatcctgggccacaggctgggatggtccttccaagaaagggtcatttcagacgcagccctgcttgggctattcaatcttagggtgtctatccacgtctggctgtgccaaatggtctggcagctggttttggcatccccagcatcaccactctcccaacccatcaccgtgactgcagttcctgcccccattctcttggggtcagggaggggctgggaagggctactgaaggccc

SEQ ID NO: 16339 - DNA, 6395 bp, Homo sapiens
  ENST00000295706
atgtctgagagccccaaggacgagggctccgaagagtgtctgtttctgcagcgcctatgggagtggggggcagtggggggaactcagggaagctgcctacaacttgaggccttccccaggctggaggaggaggacagggaaggccgaggggagctgtcctccggctgccatcaccctgatgaggcggccctgccccgggctgtggtctccgcaggggctggcaaccttgcctttgtccagctctctccgtggccaggcctgccatctgcctgcccacactcctccccggcaaagccccttgcaaatgcttgctttggggactggcagctttcgcctctgaatcaggacctagcatcagtactctggggagggggtccaggtgccaaccctgtgagtccctccctgtcccctgacgctgagaaggccctgccaacccccaccatgtgtgaggtgatgcccacaatcaatgagggggaccgcctgggtccccctcatggcgccgatgctgacgccaacttcgagcagctgatggtgaacatgctggacgagcgggagaagttgctggagtctcttcgggagagtcaggagaccttggcggccacacagagccggctccaggatgccatacacgagcgggaccagctccagcgccaccttaactccgccctcccccaggaatttgccaccttaacccgggagctgagcatgtgtcgggagcagcttctagagcgggaggaagagatatcagaactgaaagcagaacggaataacacacggctgcttctggaacatctggagtgcctggtgtcccgccatgaacggtcactgcggatgactgtggtgaagcgccaggcccagtcaccttcgggggtctccagtgaggtggaggtgctgaaggccctcaagtcactgtttgagcaccacaaggccctggatgagaaggtgcgagagcggctccgggcagcgctggagcgagtcaccaccttggaggagcagctggcaggtgcccaccagcaggtgtctgccctgcagcagggggcaggggtgcgggatggagcggcagaagaggaggggactgtggagctggggccgaaacgcctgtggaaggaggatacgggccgggtagaggagctgcaggagctcctggagaagcagaactttgagttgagccaggcccgggagcgactggtcaccctaacaacaaccgtgactgaactcgaggaggacctgggcacggcccgccgggacctcatcaagtcggaggagctgagcagcaagcatcagcgggacctccgggaggctctggcccagaaggaggacatggaagagcggattactacactggagaagcgctacctggctgctcagcgtgaggcaacatccatccatgacctcaatgacaagctggagaatgagctggccaacaaggagtccctgcaccgccagtgtgaggagaaggcccgacacctgcaggagctgctggaggtggcagagcagaagctgcagcagacgatgcgcaaggcagagacgctgccagaggtggaggctgagctggcccagagaattgcagccctcaccaaggctgaagaacggcatggcaacattgaggagcacctgcggcagctggagggacagctggaggagaagaaccaggagctggcacggacggctgtgcaggtgcgccagcgggaaaagatgaatgaggaccacaacaagcggctgtcggacacagtggaccggctgctcagcgagtccaacgagcgtctgcagctccacctgaaggagcgcatggctgccctggaggagaagaacacgttgatccaggagttggagagctcccagcggcagattgaggagcagcaccaccacaagggccgcctgtctgaagagattgagaagctgcgccaagaggtggaccagctgaagggccgaggggggccgtttgtggatggcgtccactccaggtcgcacatgggcagtgcagcagacgtgcggttctccctgggcacaaccacacacgcacccccaggcgtgcatcgccgctactcggcattgagggaagagtctgccaaggactgggagacttctccactgcctgggatgctggccccggcagctggccctgcctttgacagtgaccctgagatctccgacgtggatgaggatgagccagggggtctggtgggctctgcggatgttgtctcccccagcggccactcagatgcccagaccctggccatgatgctgcaggagcagctggatgccatcaatgaggaaatcaggatgattcaggaagagaaggagtccacggagctccgcgcggaggagattgagacgcgtgtaaccagtggcagcatggaagccctaaacctgaagcagctgcgcaagcgtggttccatccccacctctctgacggccctgtccctggccagcgcgtccccaccactcagcggccgctccacacctaagctcacctcccgcagtgctgcccaggacctggaccgaatgggggtcatgaccctgcccagtgacttaagaaagcataggaggaagctgctgtcgccagtgtctcgggaagagaaccgagaggataaagccaccataaaatgtgagacttctcctccttcctcacccaggacgctgcggctagagaagcttggccacccagccctgagccaggaagaaggcaagagtgccttggaggatcagggcagcaaccccagcagcagcaacagcagccaggactccctgcacaagggcgccaagcgcaagggcatcaagtcgtccattggccgcctgtttgggaagaaggagaagggcaggctgatccagctgagtcgggatggagccacaggccatgttctgctaacagactccgaattcagtatgcaggagcctatggtgcctgccaagctggggacccaggcagagaaggaccggcggctaaagaagaaacaccagctgcttgaagatgcccgcaggaaaggaatgccctttgcccagtgggatggtcctactgtggtctcctggttggagctctgggtggggatgcctgcctggtatgtggcagcctgccgggccaacgtcaagagtggtgccatcatgtccgctctgtcggacacagagatccagcgggagatcggcatcagcaatgccctgcaccggctcaagctccgcctggccattcaggagatggtgtcattgaccagcccctctgccccacccacctccaggacttcttctgggaatgtctgggtcacccatgaagagatggaaactctggaaacatctactaaaacaaccctggcctatggggacatgaaccatgagtggattgggaatgaatggctacccagcctggggctcccgcagtaccgcagctacttcatggagtgcctggtggacgcccgcatgctggaccacctcaccaagaaggacctgcgggtccacctgaagatggtggacagcttccatcgaaccagtcttcagtatggcatcatgtgtctgaagaggctgaattatgaccggaaggagctggagaagaggcgagaggagagccagcatgagatcaaggatgtgttagtctggaccaacgaccaggtggttcattgggtccagtctattgggctccgggactacgcaggaaacctgcatgagagtggtgtgcatggagccttgctggccctggacgagaacttcgaccacaacacactggccctgatcctccagatccccacacagaacacccaggcacgccaagtgatggaaagagagttcaataacctgttggccttgggcacagaccggaagctggatgacggggatgacaaggtgtttcgccgcgcgccctcctggaggaagcgcttccggccgcgggagcaccacggtcgcggcggcatgctcagcgcttccgcggagaccctcccggcgggcttccgtgtgtccaccctggggaccctgcagcccccaccggccccgccaaagaagatcatgcctgaagctcactcccactatctctacggacacatgctctccgccttccgggactagccatggcccccagggctggcttcctccttctgggtttcacaggctcctctggccctgacccctcttgctcgttccccttccttccgcagctcctagtctcgtccgtgactttccggttgccctggatctcagaatatattcgtccaccccctcggcaccccattaccccgagtcccaccgtgtgtccgttgtaagtccggtggatgtggctggggtttcctggtattgtggaggcacccaggttgtccatgcttgggattctgggggaaggagagaagggcagctcagggtggatgtgaagccacccttcctcttctggacccagcctggtctgcactgcaacctccaccaggaccaggatcctgggccacaggctgggatggtccttccaagaaagggtcatttcagacgcagccctgcttgggctattcaatcttagggtgtctatccacgtctggctgtgccaaatggtctggcagctggttttggcatccccagcatcaccactctcccaacccatcaccgtgactgcagttcctgcccccattctcttggggtcagggaggggctgggaagggctactgaaggccccattctcccacaggatggtgaggctgggaggaggaagactgaggtagagattccaggccctggcataagctgaatcccaaatttgagtttgggaagaaccagagagaaatggatccctgagctctgagccaagggtgaggatggggaaactctaagctcccacctaataagaagcataggcagaccagccagagggagagccaatggcctctggtagccttaagcccaaagggcagtgggaatgtcccctgccccaaccatcgggtggagctcctgctgggctatggggaagggaggttgtgcggatcttgactctagggcagaacagatctaaccatgcattgctagctctgctcccagcatcccttccccttctctcctcctctgcctcacttctttagtaatcccaaccctataaaaatgaacctaatgggtggattgaatatacattgagcccaaagtcaagtttggggaaaaggcagactaaggcctcctttctctgacctcccaggaagaaaatagcttctcctacagtgattcatgtcccaggtccaggaaatccaatgttggtgaaggcagccactctcttgcttgtccccaaatcacctaaccctcatccagggctattttggtgggcagggactgcctcctcccggaattcctaagatccgcccagctgccaccattttcattgctttccccagcagcatgatgggaacccaagctgagggatacaggtcctgatttggtaggaatattattcccaagaaatacccgctcctcacctactccctcatcctaccaaggtgcctgaaaatgttcaagacttatgttcagggtgggatgatggaaccgagggcttcatcaaagtgagaggaaaggaaaagcatctggcatgtgtttcttggataggggccagtgcagtgccatcctacaggtggctggagcagctgctttgcaacctgatcaccttgagttctgagcagggactaggcttgcaggtgagataatgggccagggcacccagtccagaaggagcaatggcacctgggcagtgccagggcttaaagcccgctgctccttttcggtagaggagaggcccatcactggtgtggtggggtgggctctcccttaggcttgggcaaggcagccacctgcccttgctctcccttagtgttccctggcctccctgccatcaggttgctgggagtggagatggagggattattgagcagaaaatgagttggatggagataaacagctcccatccctgggtaatggatggtaagatgatggagattcctaagattggtggagttgggcaatgcatagccatctgactccttcagggtgctcttgatgggctggctgtaagggagactcagtcccagcctctcccctctacaactcctgccactgttggccatgtcgtaaggcagcagctgtgccaggatagctgggtccattcagagcaccttgagaagtgttgcagggaggtgttaagaagagaactctgtgcaaacagtgatggaaggctgttgtcttggtgtatcccttgcctcatagtcaatatattttttttttggcgagtcaccagtgacccgagccctccacaccagcctcctgtatctcatcaggtcccttctcagtactgtatttgctcagtgcatcaggaatgggtgtatgggtgtgtgtgggtgggtgtgagtgtgggtgtgtacgtaccaataaacaacctggttttaagacaatgt

SEQ ID NO: 16340 - DNA, 609 bp, Homo sapiens
  ENST00000538433
tgtgtgcattgaaacagcagccttaaggtctttaaacggggaaatacatttttcttgcttcagagattcaattttacttgcccgagaagcttgtgtggtgtgattttcatcgctaaaagcaacagcagccacatggctgacaacaccaccacttaacaattcaaagctcggtcaccgttttcaggagtctcttccaaatctttctgaagtgcttttgaagttctacattccccgtctaagggaacacccagcagtcccaggataaaagggcagaaggtataaaagaacgtgtggatcactttgctgagtacatccaagatttgaagaactgaaataaatcagctttaaacctgctttttaaaaatacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaaggtgaatgccacagaagaaatgctgcagcaggagcttctaagtaggacatccttagaaactcagaagttggatc

SEQ ID NO: 16341 - DNA, 1191 bp, Homo sapiens
  ENST00000545381
ggcagtgggagggggaggtacctggaactgggagtgatgtcagctcccagctcggtgcctgcccggattcctgacatggtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatgacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaaggtgaatgccacagaagaaatgctgcagcaggagcttctaagtaggacatccttagaaactcagaagttggatctgatggctgaaatatctaacttgaagttgaaactgacagctgtagagaaggacagattggattatgaagataagttcagagacacagaggggctgattcaggagatcaatgatttgaggttaaaagttagtgaaatggacagtgagagacttcagtatgaaaaaaagcttaaatcaaccaaagatgaactggcatctttaaaagaacaactagaagaaaaggaatctgaagtaaaaaggctacaagaaaaattggtttgcaagatgaaaggagaaggggttgaaattgttgatagagatgaaaattttaaaaagaagctcaaagaaaaaa

SEQ ID NO: 16342 - DNA, 2805 bp, Homo sapiens
  ENST00000545334
ggtacctggaactgggagtgatgtcagctcccagctcggtgcctgcccggattcctgacatggtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatggtagggtctgcctgttccaaattctgttataaatcctttgttgcttattccaaaatttagaacatagaatagctgattagaacaagaaaagtttagggcaacacatgtgctccgattttattacttaagatatcttaattttcttttgactctaaggataactttttaaaaagtgctattagtgtacattttgtaaataccaacaacaggtcacctgattctgcccataaaaacagactggcttttagattgtgcctgaatgacctactgtggcttaaatcaaatagtcctgtaagggaaagaatcttgcacatgatagatgatttctcagtcatattgggttattcaccataaaggatccaatagcaattctaaatggaaagcatgatgaaagactttcaaaaagcaacaggatttacagcagtatttgaccggaagtgccatctagtggtttatggcaatcatttcagttccagttcccgaattaaattgtggagttgggcctttaacccatttatgcgcagtgttccattattggaacgctaagcttgtgggagttatttatatcctgctcaaagtcatcgccaaggtctcatttaaaaaaaaaaaatcacaacctccagcataaatgggttaatggtgttactcactgaacaatgaggccgctttctaggcatccttctcaaaaattgaagatgtggcagagctaccctttgtctgggcacggttggaaatactgtggttttaatctgtgatgaatacataaaatctaaagaatgtcacaaaaacagattcagtggaggacagaggaaaggagatattttgtgcttaaaggatattcaattttcagtaagatgcactcatatgcttatgagttaactgtgttgatataaaagctaataagaattgtatgaaagaatcgtgatctactttatgatctgtggtagacatgaaaaccgcttgctttgggaaccttaagagtacatcctacagctaaaacattttcatatgatgtgacacaaatattagagctcccagccagtcctgtgctgaatactctgtgttcccacctggtttacctctgcgtttctgagagcgaatagtacaatctatcctttagtgggggtgcagctacacaaactggagttattttacttgttaaaacacataatgccttactattatactttctatttgctctacagatttctcctccagagacttaagggtccaggtttgctgatttctttggggattgcttcatgctctgtacttggtgtttcctgacatattccttagtctatttcaatgtcctatctcaccccttctttactccatgttcttctgaccatttagcatgcagtgaaaaaggaatttactattgttagaagaacgtatttctatcccacacccagaggccaccaatggcaatagtagccgaagcgtacctgtagttcagcttttgacatgtgtctaaaacatgtccattaacatgtgcttaatctgttctgtgaaagtattttcagaaatgataaaaagtaatgatggttacatctgaatataagttagatcatgacactcactccttttttcagaaactaccagtggcatcacatcttactcagagtaaaaaccacagtgcttactgtgggctgcaaggcctcgtaggatttgccccccatgactttctgacttcatctcttgtcacacatctccttattcgctccacgccaagcacagtggctttttcactgattcttaaacatgccaggtacactggcctcagagcctttgcactggcttttccaggcactggcttttcactctgcctggaaagctctttcgccagatatttgcatggctagctccctcacattctcctggtgtttactcaaaagtcatgctctcagtgaggccttgtatcaccaccctaactaaaattatacccatttattccttgtcttacatctccctgcttattttgttcttagcattcaccattttcttatgtgcaatgtgtttgtgatgtttatatcatttattttctgtctttccaattggaatgtaagcatcaggaatcagatttttgcccttattttaaaaaaattactgtatccctggtgcttagaagaatgcctggctcagtagttatatttgtaatgaatgatgctccatgaatgataaagtggattgcatgtttgaat

SEQ ID NO: 16343 - DNA, 2645 bp, Homo sapiens
  ENST00000540114
gagtgatgtcagctcccagctcggtgcctgcccggattcctgacatggtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatacaaatggacacctaccagggaacggagatgtgtatcaagaaaggctggcacgtttagaaaatgataaagaatccctcgttcttcaggagcttctaagtaggacatccttagaaactcagaagttggatctgatggctgaaatatctaacttgaagttgaaactgacagctgtagagaaggacagattggattatgaagataagttcagagacacagaggggctgattcaggagatcaatgatttgaggttaaaagttagtgaaatggacagtgagagacttcagtatgaaaaaaagcttaaatcaaccaaatctttaatggccaaactttctagcatgaaaatcaaggtgggtcagatgcagtatgaaaagcagcggatggaacaaaaatgggagtcactgaaggatgaactggcatctttaaaagaacaactagaagaaaaggaatctgaagtaaaaaggctacaagaaaaattggtttgcaagatgaaaggagaaggggttgaaattgttgatagagacatcgaagtacaaaaaatgaaaaaagctgtggagtccttgatggcagcaaatgaagaaaaggatcggaaaatagaagatcttcgacagtgcctgaacaggtacaagaaaatgcaagacacggtggtactggcccaaggtaaaaaaggcaaagatggagaatatgaagagctgctcaattccagttccatctcctctttgctggatgcacagggtttcagtgatctggagaaaagtccatcacccactccagtaatgggatctcccagttgtgacccatttaacacaagtgttcccgaagagttccatactaccatcttgcaagtttccatcccttcattattgccagcaactgtaagcatggaaacttctgaaaaatcaaagttgactcctaagccagagacttcatttgaagaaaatgatggaaacataatccttggtgccactgttgatacccaactgtgtgataaacttttaacttcaagtctgcagaagtccagcagcctgggcaatctgaagaaagagacatctgatggggaaaaggaaactattcagaagacttcagaggacagagctccggcagaaagcaggccatttgggacccttcctcccaggcccccagggcaggacacctccatggatgacaaccccttcggcactcgaaaagtcagatcttcctttggccggggcttttttaaaatcaaaagtaacaagagaacagcaagtgcaccaaacttagctgaaacagaaaaagagacagcagagcacctagatctggctggtgcttcttctcggccaaaagattcacagaggaacagtcccttccagataccgcctccatctccagattccaaaaagaaatccagaggtatcatgaaactctttggaaaacttaggagaagtcaatcaactacattcaacccagatgacatgtctgagcctgaattcaaaagaggagggacaagggcaaccgcggggccccgattaggttggtctcgagacttgggacagtctaacagtgacttggatatgccatttgccaagtggaccaaggagcaggtttgcaattggctgatggaacagggcttgggctcgtacctgaattctggcaagcactggattgcatctggccaaacgcttttgcaggcttctcaacaagatctagagaaggaacttggaatcaagcattcacttcatcgaaagaaactccagctagcactccaagccctgggatctgaagaagaaaccaatcatgggaagctggatttcaactgggtcactagatggttggatgacattggcctccctcaatataagacccagtttgatgaaggacgggttgatggtcgaatgctacattacatgactgttgatgacttactgtctctgaaggttgtaagtgtgctacaccatctcagtatcaaaagggccatccaggtcctgaggatcaataactttgaaccaaactgtctacggaggcggccatctgatgagaataccatcgccccatcagaagttcagaagtggactaaccatcgagtgatggagtggctgcgctccgtggacttggcagaatatgcgcccaatctcagaggcagtggtgtccatggtgggctcatggttctagagcctcgttttaacgtagaaacaatggctcagttattgaacatcccacccaataagactttgctgcgaagacatttggccactcatttcaaccttctgattggggctgaggcacagcaccagaagcgagatgccatggagctgccggattatgtacttctaacagctactgccaaagtgaagccaaagaaacttgcctttagcaattttgggaatttg

SEQ ID NO: 16344 - DNA, 574 bp, Homo sapiens
  ENST00000541633
agtgatgtcagctcccagctcggtgcctgcccggattcctgacatggtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatataccactttcacatatgttgttgaatcattaacactgacacacacccaacagctttgtaactcaggcctgaaggaagctgacctcacacactggtttcgtccttgaggcacggcctcattacctcaggaacaccaggcagcgcttccacactgtgcttggagccattttaaacagcacaagggttgatcgacaagtacaaacgtgtgaaaaatgtggcacagaatagaccatgaaaaggacactttatggcaggagggctgaactgatgcaggaaagtggagcatcgtcttgt

SEQ ID NO: 16345 - DNA, 5719 bp, Homo sapiens
  ENST00000537927
cagctcccagctcggtgcctgcccggattcctgacatggtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaaggtgaatgccacagaagaaatgctgcagcaggagcttctaagtaggacatccttagaaactcagaagttggatctgatggctgaaatatctaacttgaagttgaaactgacagctgtagagaaggacagattggattatgaagataagttcagagacacagaggggctgattcaggagatcaatgatttgaggttaaaagttagtgaaatggacagtgagagacttcagtatgaaaaaaagcttaaatcaaccaaatctttaatggccaaactttctagcatgaaaatcaaggtgggtcagatgcagtatgaaaagcagcggatggaacaaaaatgggagtcactgaaggatgaactggcatctttaaaagaacaactagaagaaaaggaatctgaagtaaaaaggctacaagaaaaattggtttgcaagatgaaaggagaaggggttgaaattgttgatagagacatcgaagtacaaaaaatgaaaaaagctgtggagtccttgatggcagcaaatgaagaaaaggatcggaaaatagaagatcttcgacagtgcctgaacaggtacaagaaaatgcaagacacggtggtactggcccaaggcaaagatggagaatatgaagagctgctcaattccagttccatctcctctttgctggatgcacagggtttcagtgatctggagaaaagtccatcacccactccagtaatgggatctcccagttgtgacccatttaacacaagtgttcccgaagagttccatactaccatcttgcaagtttccatcccttcattattgccagcaactgtaagcatggaaacttctgaaaaatcaaagttgactcctaagccagagacttcatttgaagaaaatgatggaaacataatccttggtgccactgttgatacccaactgtgtgataaacttttaacttcaagtctgcagaagtccagcagcctgggcaatctgaagaaagagacatctgatggggaaaaggaaactattcagaagacttcagaggacagagctccggcagaaagcaggccatttgggacccttcctcccaggcccccagggcaggacacctccatggatgacaaccccttcggcactcgaaaagtcagatcttcctttggccggggcttttttaaaatcaaaagtaacaagagaacagcaagtgcaccaaacttagctgaaacagaaaaagagacagcagagcacctagatctggctggtgcttcttctcggccaaaagattcacagaggaacagtcccttccagataccgcctccatctccagattccaaaaagaaatccagaggtatcatgaaactctttggaaaacttaggagaagtcaatcaactacattcaacccagatgacatgtctgagcctgaattcaaaagaggagggacaagggcaaccgcggggccccgattaggttggtctcgagacttgggacagtctaacagtgacttggatatgccatttgccaagtggaccaaggagcaggtttgcaattggctgatggaacagggcttgggctcgtacctgaattctggcaagcactggattgcatctggccaaacgcttttgcaggcttctcaacaagatctagagaaggaacttggaatcaagcattcacttcatcgaaagaaactccagctagcactccaagccctgggatctgaagaagaaaccaatcatgggaagctggatttcaactgggtcactagatggttggatgacattggcctccctcaatataagacccagtttgatgaaggacgggttgatggtcgaatgctacattacatgactgttgatgacttactgtctctgaaggttgtaagtgtgctacaccatctcagtatcaaaagggccatccaggtcctgaggatcaataactttgaaccaaactgtctacggaggcggccatctgatgagaataccatcgccccatcagaagttcagaagtggactaaccatcgagtgatggagtggctgcgctccgtggacttggcagaatatgcgcccaatctcagaggcagtggtgtccatggtgggctcatggttctagagcctcgttttaacgtagaaacaatggctcagttattgaacatcccacccaataagactttgctgcgaagacatttggccactcatttcaaccttctgattggggctgaggcacagcaccagaagcgagatgccatggagctgccggattatgtacttctaacagctactgccaaagtgaagccaaagaaacttgcctttagcaattttgggaatttgagaaagaagaaacaggaagatggtgaagaatatgtttgtccaatggaattgggacaggcatcaggaagtgcatctaagaaaggatttaaacctggtttggatatgcgcctgtatgaggaagatgatttggaccggttagagcagatggaagattcagaagggacagtgagacagataggtgcattctctgaaggcatcaacaatctgacgcacatgttaaaagaagatgacatgtttaaagattttgctgcccgttcccccagtgccagcattacagatgaagactcaaacgtttgaccgtagcacctggatgaacattaggagtgcttagtcttttttctacttgcttttccaaacactcacagtatatacaacaggcagcggattgtctattgtttgttgttccaacttctgctgtcgagaagtttaaacagaaagcaggagtaatgtgccgattctgaagttgccacaaaaaataagacactggtgaatgagagtataattgtttttcttctatttaatgtaaaaatctgtgatatattatatttaaagtgttgcatttaagatgagtattttaccagagtgtttccattcatatccgcggtatggaggatttgaggaacagtaaccaggatgtgaatgattttgttacatcagtgttcactgtagccacctaagtaggacattatatgatttcagaatcaatatgtggaacttctttaagcattcagtgtgcccactaaatgccagccacacctccacttgcctcttattgtcttatttttatatatttttctaaatatatgtatatatacagtacatagaaaatagaacttttattttgtgacctaaggacgatggtgaaaagatcacgttttcaaaacaatctggtgatcagaatgttcatataccagctggtttctgaagaggtcagaatgatctttctccatactgacttttaacaatgttgatcattgaggctaaattaatatatatgaaatattcctttttgatgacaccacaaaattgttgaacagtttaagaatttcaaccttaatcttggatccctttacctcatatggaagaacttgagggacattagtatacttttttttaagatggagtcttgctctgtcacccaggttggagtgccatggcatgatcttggctcactgcaacctccacctcctgggtcaagccattctgcttcagccccaagtaggtgggactccaggcatgcaccaccatgcctggctaatttttgcatttttagtagagacagggtttcaccatattggccaggctgggactcgaactcctgaccttgtgatctgcccgcctcagcctcccaaagtactgggattataggcatgagccaccacgcccagcctgttatttttttattattattgtttttttttagtgacagagtctcattctgttgcccatgctggagtgcagtggcgtgatcatagctcactgcagccttgaattcctaggctccagtgatcctctcacctcagcttccctaatagctaggattacaggtgtgtggcctcccaccccaccccacccttcacacctggctgatttttcaaaaagtttttttgtagaaacagggtctcaccatgttgtccagcctggtctcaaactcctgtcctcaagtgatcctcccacctcagcctttcaaagtgctggaattacaggtgtgagccactctgcctggcctaccactaacttgaatacattcagaatcacctcctctccccaaaatttgtagaaatagtttttgaggaagccaaaagcaaagcagaaacctttacagtattgtttcttttctctttgttaactgtgtcattacagcaaaatactagcagtctgcctaaacatgttcattgtacatttctcaggctatcaatgaatggaggtttttaaaaagttgaatatttgtctgaacattttatttcaaagttcaaaaaaacagaggctgcaaaattcattttataatggctattttgtgacgataagatgtagttcatgtttttctgtagcactgggcccaaatattctttgtaaagaaaatcgctgcagcaaaaactgttactgtgtttattatatttgtagaagtattagaaaaatattctattttttattcagtgctgcgtaattacccatggtagccaaccctacaaaagacaggttttcacaaattgaggtggaggtgggcggttcagtatctgccactggacttgattataaactgtatttgaatatcagtggtattatcttttaagttgtcagcaagttaccaaggtattcattaaagaacttgtaatatcaaattactatttattcataacaattgatttgatgctaataataattttctttaaactctaccattcattatgtggtaactgtattgaacttactttatttggattttattttaatgtgactagatgtcaccacttcaaaaaatcaatttgttcttagaacctggttgaaaataccaggaaactgttacagacgccattttttttttttttgagacggagtcttgctctgttgcccaggctggagtgcagtggcacaatctcagctcactgcaagctccgcctcctgggttcacgccattctcccacctcagcttcccaagcagctgggactacaggtacctgccaccacgcctggctaattttgtttttgtatttttagtagagacggggtttcaccgtgttagccaggaaggtctcaatctcctgacctcgtgaatcgcccccctcggtctcccaaagtgctgggattacaggcgtgagccaccatgcccggcccaaatattttttattcaggatggtataacctaactgataataggtaataaggttaaatttttttatgacgtattttatttacaaatatcatacactgctggtgttaccatatgaaaggaaataaagtcaattgataattgcctc

SEQ ID NO: 16346 - DNA, 6001 bp, Homo sapiens
  ENST00000318304
ggattcctgacatggtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatgacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaaggtgaatgccacagaagaaatgctgcagcaggagcttctaagtaggacatccttagaaactcagaagttggatctgatggctgaaatatctaacttgaagttgaaactgacagctgtagagaaggacagattggattatgaagataagttcagagacacagaggggctgattcaggagatcaatgatttgaggttaaaagttagtgaaatggacagtgagagacttcagtatgaaaaaaagcttaaatcaaccaaatctttaatggccaaactttctagcatgaaaatcaaggtgggtcagatgcagtatgaaaagcagcggatggaacaaaaatgggagtcactgaaggatgaactggcatctttaaaagaacaactagaagaaaaggaatctgaagtaaaaaggctacaagaaaaattggtttgcaagatgaaaggagaaggggttgaaattgttgatagagacatcgaagtacaaaaaatgaaaaaagctgtggagtccttgatggcagcaaatgaagaaaaggatcggaaaatagaagatcttcgacagtgcctgaacaggtacaagaaaatgcaagacacggtggtactggcccaaggcaaagatggagaatatgaagagctgctcaattccagttccatctcctctttgctggatgcacagggtttcagtgatctggagaaaagtccatcacccactccagtaatgggatctcccagttgtgacccatttaacacaagtgttcccgaagagttccatactaccatcttgcaagtttccatcccttcattattgccagcaactgtaagcatggaaacttctgaaaaatcaaagttgactcctaagccagagacttcatttgaagaaaatgatggaaacataatccttggtgccactgttgatacccaactgtgtgataaacttttaacttcaagtctgcagaagtccagcagcctgggcaatctgaagaaagagacatctgatggggaaaaggaaactattcagaagacttcagaggacagagctccggcagaaagcaggccatttgggacccttcctcccaggcccccagggcaggacacctccatggatgacaaccccttcggcactcgaaaagtcagatcttcctttggccggggcttttttaaaatcaaaagtaacaagagaacagcaagtgcaccaaacttagctgaaacagaaaaagagacagcagagcacctagatctggctggtgcttcttctcggccaaaagattcacagaggaacagtcccttccagataccgcctccatctccagattccaaaaagaaatccagaggtatcatgaaactctttggaaaacttaggagaagtcaatcaactacattcaacccagatgacatgtctgagcctgaattcaaaagaggagggacaagggcaaccgcggggccccgattaggttggtctcgagacttgggacagtctaacagtgacttggatatgccatttgccaagtggaccaaggagcaggtttgcaattggctgatggaacagggcttgggctcgtacctgaattctggcaagcactggattgcatctggccaaacgcttttgcaggcttctcaacaagatctagagaaggaacttggaatcaagcattcacttcatcgaaagaaactccagctagcactccaagccctgggatctgaagaagaaaccaatcatgggaagctggatttcaactgggtcactagatggttggatgacattggcctccctcaatataagacccagtttgatgaaggacgggttgatggtcgaatgctacattacatgactgttgatgacttactgtctctgaaggttgtaagtgtgctacaccatctcagtatcaaaagggccatccaggtcctgaggatcaataactttgaaccaaactgtctacggaggcggccatctgatgagaataccatcgccccatcagaagttcagaagtggactaaccatcgagtgatggagtggctgcgctccgtggacttggcagaatatgcgcccaatctcagaggcagtggtgtccatggtgggctcatggttctagagcctcgttttaacgtagaaacaatggctcagttattgaacatcccacccaataagactttgctgcgaagacatttggccactcatttcaaccttctgattggggctgaggcacagcaccagaagcgagatgccatggagctgccggattatgtacttctaacagctactgccaaagtgaagccaaagaaacttgcctttagcaattttgggaatttgagaaagaagaaacaggaagatggtgaagaatatgtttgtccaatggaattgggacaggcatcaggaagtgcatctaagaaaggatttaaacctggtttggatatgcgcctgtatgaggaagatgatttggaccggttagagcagatggaagattcagaagggacagtgagacagataggtgcattctctgaaggcatcaacaatctgacgcacatgttaaaagaagatgacatgtttaaagattttgctgcccgttcccccagtgccagcattacagatgaagactcaaacgtttgaccgtagcacctggatgaacattaggagtgcttagtcttttttctacttgcttttccaaacactcacagtatatacaacaggcagcggattgtctattgtttgttgttccaacttctgctgtcgagaagtttaaacagaaagcaggagtaatgtgccgattctgaagttgccacaaaaaataagacactggtgaatgagagtataattgtttttcttctatttaatgtaaaaatctgtgatatattatatttaaagtgttgcatttaagatgagtattttaccagagtgtttccattcatatccgcggtatggaggatttgaggaacagtaaccaggatgtgaatgattttgttacatcagtgttcactgtagccacctaagtaggacattatatgatttcagaatcaatatgtggaacttctttaagcattcagtgtgcccactaaatgccagccacacctccacttgcctcttattgtcttatttttatatatttttctaaatatatgtatatatacagtacatagaaaatagaacttttattttgtgacctaaggacgatggtgaaaagatcacgttttcaaaacaatctggtgatcagaatgttcatataccagctggtttctgaagaggtcagaatgatctttctccatactgacttttaacaatgttgatcattgaggctaaattaatatatatgaaatattcctttttgatgacaccacaaaattgttgaacagtttaagaatttcaaccttaatcttggatccctttacctcatatggaagaacttgagggacattagtatacttttttttaagatggagtcttgctctgtcacccaggttggagtgccatggcatgatcttggctcactgcaacctccacctcctgggtcaagccattctgcttcagccccaagtaggtgggactccaggcatgcaccaccatgcctggctaatttttgcatttttagtagagacagggtttcaccatattggccaggctgggactcgaactcctgaccttgtgatctgcccgcctcagcctcccaaagtactgggattataggcatgagccaccacgcccagcctgttatttttttattattattgtttttttttagtgacagagtctcattctgttgcccatgctggagtgcagtggcgtgatcatagctcactgcagccttgaattcctaggctccagtgatcctctcacctcagcttccctaatagctaggattacaggtgtgtggcctcccaccccaccccacccttcacacctggctgatttttcaaaaagtttttttgtagaaacagggtctcaccatgttgtccagcctggtctcaaactcctgtcctcaagtgatcctcccacctcagcctttcaaagtgctggaattacaggtgtgagccactctgcctggcctaccactaacttgaatacattcagaatcacctcctctccccaaaatttgtagaaatagtttttgaggaagccaaaagcaaagcagaaacctttacagtattgtttcttttctctttgttaactgtgtcattacagcaaaatactagcagtctgcctaaacatgttcattgtacatttctcaggctatcaatgaatggaggtttttaaaaagttgaatatttgtctgaacattttatttcaaagttcaaaaaaacagaggctgcaaaattcattttataatggctattttgtgacgataagatgtagttcatgtttttctgtagcactgggcccaaatattctttgtaaagaaaatcgctgcagcaaaaactgttactgtgtttattatatttgtagaagtattagaaaaatattctattttttattcagtgctgcgtaattacccatggtagccaaccctacaaaagacaggttttcacaaattgaggtggaggtgggcggttcagtatctgccactggacttgattataaactgtatttgaatatcagtggtattatcttttaagttgtcagcaagttaccaaggtattcattaaagaacttgtaatatcaaattactatttattcataacaattgatttgatgctaataataattttctttaaactctaccattcattatgtggtaactgtattgaacttactttatttggattttattttaatgtgactagatgtcaccacttcaaaaaatcaatttgttcttagaacctggttgaaaataccaggaaactgttacagacgccattttttttttttttgagacggagtcttgctctgttgcccaggctggagtgcagtggcacaatctcagctcactgcaagctccgcctcctgggttcacgccattctcccacctcagcttcccaagcagctgggactacaggtacctgccaccacgcctggctaattttgtttttgtatttttagtagagacggggtttcaccgtgttagccaggaaggtctcaatctcctgacctcgtgaatcgcccccctcggtctcccaaagtgctgggattacaggcgtgagccaccatgcccggcccaaatattttttattcaggatggtataacctaactgataataggtaataaggttaaatttttttatgacgtattttatttacaaatatcatacactgctggtgttaccatatgaaaggaaataaagtcaattgataattgcctca

SEQ ID NO: 16347 - DNA, 875 bp, Homo sapiens
  ENST00000535047
gtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatgacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaaggtgaatgccacagaagaaatgctgcagcaggtatgtgcagaggccagaaccaagatgggatttccctgctgaactatgtgagatgctgcatttctatgttgtgtttgctctgatgcagcagtaagtttcttgattcatttagaccagcacattaaaaaaaaaaaa

SEQ ID NO: 16348 - DNA, 3208 bp, Homo sapiens
  ENST00000542629
agtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatgacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaaggtgaatgccacagaagaaatgctgcagcaggagcttctaagtaggacatccttagaaactcagaagttggatctgatggctgaaatatctaacttgaagttgaaactgacagctgtagagaaggacagattggattatgaagataagttcagagacacagaggggctgattcaggagatcaatgatttgaggttaaaagttagtgaaatggacagtgagagacttcagtatgaaaaaaagcttaaatcaaccaaagatgaactggcatctttaaaagaacaactagaagaaaaggaatctgaagtaaaaaggctacaagaaaaattggtttgcaagatgaaaggagaaggggttgaaattgttgatagagacatcgaagtacaaaaaatgaaaaaagctgtggagtccttgatggcagcaaatgaagaaaaggatcggaaaatagaagatcttcgacagtgcctgaacaggtacaagaaaatgcaagacacggtggtactggcccaaggcaaagatggagaatatgaagagctgctcaattccagttccatctcctctttgctggatgcacagggtttcagtgatctggagaaaagtccatcacccactccagtaatgggatctcccagttgtgacccatttaacacaagtgttcccgaagagttccatactaccatcttgcaagtttccatcccttcattattgccagcaactgtaagcatggaaacttctgaaaaatcaaagttgactcctaagccagagacttcatttgaagaaaatgatggaaacataatccttggtgccactgttgatacccaactgtgtgataaacttttaacttcaagtctgcagaagtccagcagcctgggcaatctgaagaaagagacatctgatggggaaaaggaaactattcagaagacttcagaggacagagctccggcagaaagcaggccatttgggacccttcctcccaggcccccagggcaggacacctccatggatgacaaccccttcggcactcgaaaagtcagatcttcctttggccggggcttttttaaaatcaaaagtaacaagagaacagcaagtgcaccaaacttagctgaaacagaaaaagagacagcagagcacctagatctggctggtgcttcttctcggccaaaagattcacagaggaacagtcccttccagataccgcctccatctccagattccaaaaagaaatccagaggtatcatgaaactctttggaaaacttaggagaagtcaatcaactacattcaacccagatgacatgtctgagcctgaattcaaaagaggagggacaagggcaaccgcggggccccgattaggttggtctcgagacttgggacagtctaacagtgacttggatatgccatttgccaagtggaccaaggagcaggtttgcaattggctgatggaacagggcttgggctcgtacctgaattctggcaagcactggattgcatctggccaaacgcttttgcaggcttctcaacaagatctagagaaggaacttggaatcaagcattcacttcatcgaaagaaactccagctagcactccaagccctgggatctgaagaagaaaccaatcatgggaagctggatttcaactgggtcactagatggttggatgacattggcctccctcaatataagacccagtttgatgaaggacgggttgatggtcgaatgctacattacatgactgttgatgacttactgtctctgaaggttgtaagtgtgctacaccatctcagtatcaaaagggccatccaggtcctgaggatcaataactttgaaccaaactgtctacggaggcggccatctgatgagaataccatcgccccatcagaagttcagaagtggactaaccatcgagtgatggagtggctgcgctccgtggacttggcagaatatgcgcccaatctcagaggcagtggtgtccatggtgggctcatggttctagagcctcgttttaacgtagaaacaatggctcagttattgaacatcccacccaataagactttgctgcgaagacatttggccactcatttcaaccttctgattggggctgaggcacagcaccagaagcgagatgccatggagctgccggattatgtacttctaacagctactgccaaagtgaagccaaagaaacttgcctttagcaattttgggaatttgagaaagaagaaacaggaagatggtgaagaatatgtttgtccaatggaattgggacaggcatcaggaagtgcatctaagaaaggatttaaacctggtttggatatgcgcctgtatgaggaagatgatttggaccggttagagcagatggaagattcagaagggacagtgagacagataggtgcattctctgaaggcatcaacaatctgacgcacatgttaaaagaagatgacatgtttaaagattttgctgcccgttcccccagtgccagcattacagatgaagactcaaacgtttga

SEQ ID NO: 16349 - DNA, 5933 bp, Homo sapiens
  ENST00000228425
gactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatgacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaaggtgaatgccacagaagaaatgctgcagcaggagcttctaagtaggacatccttagaaactcagaagttggatctgatggctgaaatatctaacttgaagttgaaactgacagctgtagagaaggacagattggattatgaagataagttcagagacacagaggggctgattcaggagatcaatgatttgaggttaaaagttagtgaaatggacagtgagagacttcagtatgaaaaaaagcttaaatcaaccaaagatgaactggcatctttaaaagaacaactagaagaaaaggaatctgaagtaaaaaggctacaagaaaaattggtttgcaagatgaaaggagaaggggttgaaattgttgatagagatgaaaattttaaaaagaagctcaaagaaaaaaacatcgaagtacaaaaaatgaaaaaagctgtggagtccttgatggcagcaaatgaagaaaaggatcggaaaatagaagatcttcgacagtgcctgaacaggtacaagaaaatgcaagacacggtggtactggcccaaggtaaaaaaggcaaagatggagaatatgaagagctgctcaattccagttccatctcctctttgctggatgcacagggtttcagtgatctggagaaaagtccatcacccactccagtaatgggatctcccagttgtgacccatttaacacaagtgttcccgaagagttccatactaccatcttgcaagtttccatcccttcattattgccagcaactgtaagcatggaaacttctgaaaaatcaaagttgactcctaagccagagacttcatttgaagaaaatgatggaaacataatccttggtgccactgttgatacccaactgtgtgataaacttttaacttcaagtctgcagaagtccagcagcctgggcaatctgaagaaagagacatctgatggggaaaaggaaactattcagaagacttcagaggacagagctccggcagaaagcaggccatttgggacccttcctcccaggcccccagggcaggacacctccatggatgacaaccccttcggcactcgaaaagtcagatcttcctttggccggggcttttttaaaatcaaaagtaacaagagaacagcaagtgcaccaaacttagatcgtaaacgaagtgccagtgcacccaccctagctgaaacagaaaaagagacagcagagcacctagatctggctggtgcttcttctcggccaaaagattcacagaggaacagtcccttccagataccgcctccatctccagattccaaaaagaaatccagaggtatcatgaaactctttggaaaacttaggagaagtcaatcaactacattcaacccagatgacatgtctgagcctgaattcaaaagaggagggacaagggcaaccgcggggccccgattaggttggtctcgagacttgggacagtctaacagtgacttggatatgccatttgccaagtggaccaaggagcaggtttgcaattggctgatggaacagggcttgggctcgtacctgaattctggcaagcactggattgcatctggccaaacgcttttgcaggcttctcaacaagatctagagaaggaacttggaatcaagcattcacttcatcgaaagaaactccagctagcactccaagccctgggatctgaagaagaaaccaatcatgggaagctggatttcaactgggtcactagatggttggatgacattggcctccctcaatataagacccagtttgatgaaggacgggttgatggtcgaatgctacattacatgactgttgatgacttactgtctctgaaggttgtaagtgtgctacaccatctcagtatcaaaagggccatccaggtcctgaggatcaataactttgaaccaaactgtctacggaggcggccatctgatgagaataccatcgccccatcagaagttcagaagtggactaaccatcgagtgatggagtggctgcgctccgtggacttggcagaatatgcgcccaatctcagaggcagtggtgtccatggtgggctcatggttctagagcctcgttttaacgtagaaacaatggctcagttattgaacatcccacccaataagactttgctgcgaagacatttggccactcatttcaaccttctgattggggctgaggcacagcaccagaagcgagatgccatggagctgccggattatgtacttctaacagctactgccaaagtgaagccaaagaaacttgcctttagcaattttgggaatttgagaaagaagaaacaggaagatggtgaagaatatgtttgtccaatggaattgggacaggcatcaggaagtgcatctaagaaaggatttaaacctggtttggatatgcgcctgtatgaggaagatgatttggaccggttagagcagatggaagattcagaagggacagtgagacagataggtgcattctctgaaggcatcaacaatctgacgcacatgttaaaagaagatgacatgtttaaagattttgctgcccgttcccccagtgccagcattacagatgaagactcaaacgtttgaccgtagcacctggatgaacattaggagtgcttagtcttttttctacttgcttttccaaacactcacagtatatacaacaggcagcggattgtctattgtttgttgttccaacttctgctgtcgagaagtttaaacagaaagcaggagtaatgtgccgattctgaagttgccacaaaaaataagacactggtgaatgagagtataattgtttttcttctatttaatgtaaaaatctgtgatatattatatttaaagtgttgcatttaagatgagtattttaccagagtgtttccattcatatccgcggtatggaggatttgaggaacagtaaccaggatgtgaatgattttgttacatcagtgttcactgtagccacctaagtaggacattatatgatttcagaatcaatatgtggaacttctttaagcattcagtgtgcccactaaatgccagccacacctccacttgcctcttattgtcttatttttatatatttttctaaatatatgtatatatacagtacatagaaaatagaacttttattttgtgacctaaggacgatggtgaaaagatcacgttttcaaaacaatctggtgatcagaatgttcatataccagctggtttctgaagaggtcagaatgatctttctccatactgacttttaacaatgttgatcattgaggctaaattaatatatatgaaatattcctttttgatgacaccacaaaattgttgaacagtttaagaatttcaaccttaatcttggatccctttacctcatatggaagaacttgagggacattagtatacttttttttaagatggagtcttgctctgtcacccaggttggagtgccatggcatgatcttggctcactgcaacctccacctcctgggtcaagccattctgcttcagccccaagtaggtgggactccaggcatgcaccaccatgcctggctaatttttgcatttttagtagagacagggtttcaccatattggccaggctgggactcgaactcctgaccttgtgatctgcccgcctcagcctcccaaagtactgggattataggcatgagccaccacgcccagcctgttatttttttattattattgtttttttttagtgacagagtctcattctgttgcccatgctggagtgcagtggcgtgatcatagctcactgcagccttgaattcctaggctccagtgatcctctcacctcagcttccctaatagctaggattacaggtgtgtggcctcccaccccaccccacccttcacacctggctgatttttcaaaaagtttttttgtagaaacagggtctcaccatgttgtccagcctggtctcaaactcctgtcctcaagtgatcctcccacctcagcctttcaaagtgctggaattacaggtgtgagccactctgcctggcctaccactaacttgaatacattcagaatcacctcctctccccaaaatttgtagaaatagtttttgaggaagccaaaagcaaagcagaaacctttacagtattgtttcttttctctttgttaactgtgtcattacagcaaaatactagcagtctgcctaaacatgttcattgtacatttctcaggctatcaatgaatggaggtttttaaaaagttgaatatttgtctgaacattttatttcaaagttcaaaaaaacagaggctgcaaaattcattttataatggctattttgtgacgataagatgtagttcatgtttttctgtagcactgggcccaaatattctttgtaaagaaaatcgctgcagcaaaaactgttactgtgtttattatatttgtagaagtattagaaaaatattctattttttattcagtgctgcgtaattacccatggtagccaaccctacaaaagacaggttttcacaaattgaggtggaggtgggcggttcagtatctgccactggacttgattataaactgtatttgaatatcagtggtattatcttttaagttgtcagcaagttaccaaggtattcattaaagaacttgtaatatcaaattactatttattcataacaattgatttgatgctaataataattttctttaaactctaccattcattatgtggtaactgtattgaacttactttatttggattttattttaatgtgactagatgtcaccacttcaaaaaatcaatttgttcttagaacctggttgaaaataccaggaaactgttacagacgccattttttttttttttgagacggagtcttgctctgttgcccaggctggagtgcagtggcacaatctcagctcactgcaagctccgcctcctgggttcacgccattctcccacctcagcttcccaagcagctgggactacaggtacctgccaccacgcctggctaattttgtttttgtatttttagtagagacggggtttcaccgtgttagccaggaaggtctcaatctcctgacctcgtgaatcgcccccctcggtctcccaaagtgctgggattacaggcgtgagccaccatgcccggcccaaatattttttattcaggatggtataacctaactgataataggtaataaggttaaatttttttatgacgtattttatttacaaatatcatacactgctggtgttaccatatgaaaggaaataaagtcaattgataattgcctca

SEQ ID NO: 16350 - DNA, 559 bp, Homo sapiens
  ENST00000535575
ccggctccaatccctggatggctttaagtccagcaaacctttctgtttttcctatcgctcttctctttgcttaacctctcctctttcctccagacccacttaaaagcagttcatcaggaaaacttagctgacagtctcagtcagaactcactcgtgcaggaactttgcaggaagcagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttc

SEQ ID NO: 16351 - DNA, 585 bp, Homo sapiens
  ENST00000542187
agactggcacttacactatcagccctcctgcttatcaagccttcagactcagactggagctatacccttgggttttctgggtctccagcttgcagttagcagatcttgggacttctcagcctacataaatgcatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatgacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagtttt

SEQ ID NO: 16352 - DNA, 937 bp, Homo sapiens
  ENST00000534917
gcactctgtgaaatagcatagagtcatttttaggatagaaatatctgacaaataatagatattacactacctttcttaatcaaaattatactcaccttttattttcataagcccatcactttagggcagacgcattggggatttaaaggaatgttttaaatggaaagatgccttcgttcttaaggaggtacatttatttccatttgtctcatctgattcatacaactttaaccctaggagctggtgacttcttaagatttccaagctgctattttataggtataggtaactgtgttaccactttcctaatgtactttcttgtttcttcttggacaggggctgattcaggagatcaatgatttgaggttaaaagttagtgaaatggacagtgagagacttcagtatgaaaaaaagcttaaatcaaccaaagatgaactggcatctttaaaagaacaactagaagaaaaggaatctgaagtaaaaaggctacaagaaaaattggtttgcaagatgaaaggagaaggggttgaaattgttgatagaggtaagaagatatatttcacatttatcatctcattttgttaaagtcctccaaaatctgtaaaggaaaccaatgaaaatcaatgtgtagttttagcatcaaagaaagagcagcagaatccagccaggaccagaaccacaggggattctccaagactctttactgtgactgggaatccattaatttcctcttcagcagctggaaaaggggaattctgtactttatttggtgtttaagattgctagactgtaaattctcatcacaaggatggacttgtctcaattgcgatgcaagggaatttgtgccaaaggagttaaaaagaaccatccctgtgtcccgggatcgttgccctcagaactgaaattagataaagtaagggacttagaaactgttctg

SEQ ID NO: 16353 - DNA, 616 bp, Homo sapiens
  ENST00000537261
aatgaagaaaaggatcggaaaatagaagatcttcgacagtgcctgaacaggtacaagaaaatgcaagacacggtggtactggcccaaggtaaaaaaggcaaagatggagaatatgaagagctgctcaattccagttccatctcctctttgctggatgcacagggtttcagtgatctggagaaaagtccatcacccactccagtaatgggatctcccagttgtgacccatttaacacaagtgttcccgaagagttccatactaccatcttgcaagtttccatcccttcattattgccagcaactgtaagcatggaaacttctgaaaaatcaaagttgactcctaagccagagacttcatttgaagaaaatgatggaaacataatccttggtgccactgttgatacccaactgtgtgataaacttttaacttcaagtctgcagaagtccagcagcctgggcaatctgaagaaagagacatctgatggggacagagctccggcagaaagcaggccatttgggacccttcctcccaggcccccagggcaggacacctccatggatgacaaccccttcggcactcgaaaagtcagatcttcctttggccggggctttttta

SEQ ID NO: 16354 - DNA, 1565 bp, Homo sapiens
  ENST00000619325
gacagagctccggcagaaagcaggccatttgggacccttcctcccaggcccccagggcaggacacctccatggatgacaaccccttcggcactcgaaaagtcagatcttcctttggccggggcttttttaaaatcaaaagtaacaagagaacagcaagtgcaccaaacttaggtacgtatgaccaaaatgcctttgccctaattcttccacaaggaggaaaagagcagtgtcttcccttcccttactctttcattcattgattcatttctctttctcagaaacgaaggtgaatgacttaggggaatttagcaaaaaatgcctccgtggatttaatttagtgttgtgaagatatatagactctcaccctgctctctcctgtggtataaacttagcggaaagacctaaaatcatgattccctttgacttcatcatggagtttcccatctgttgtgatagtggataaattaacattgacgttgagcctgtgtgtaacatcagaagcactgtgtgccgcatgcctctcctccacggtgtgtatttggcgaggaggagtctgatctgcatttcattttgtcatctctgtgttctctccattgggctgcgtgtgattgtgtgcgttgttgggatatctgaagatcgtaaacgaagtgccagtgcacccaccctaggtattgtacccctgcatgccagccttcaccagcactgtgctccaaaccaatctaatccctgctcttggcatctgtgatctctagaaagcgatctgacagcaatcagaaaatgtagttctctattccggagtgttctttccaccttctgctaaaaaggactctgtagaggctttgcttccaagcctaaatgctgttttaaccaatactagtaacactcactgtgtgaatagctttgagaggacctagacgtgtgcagcatccctcagagtgcagggcaggaatgtcctggcattgtacattgcagctctttcagccttgaagtgcatattaccacacactaactcccaggtccttgcagtccgttctccatgcttacatttcccccagcctccaaaaagaaatttttttggccatatagggaggtttatagaagacattgaatattatagttttaggcttacttctcttaggggaacattcttctgacgttttattactttgaagatggagataatatttagtgatgacagaagcaactttacttgatatctgaggcgttaccccccaaagtgattttagaagaggggcagctcagttttcctctttgtaaggcaggggacaaatggggaaaaaagttctcaaaataaaaaagagaaatatggtagttttaagatgaggataagctaggcagcattttcaggggcacctgtagccatcgtggttgaaggatttgaattgggaaagttcctttgggtttttccaaaaggtgctgttaccttgtatagatatccacctatctattcacatggaccagcaaacgggacttctctctctatcgatataaatgtctagaatgaacactggatgcataaaataaactgatctgttcagacaac

SEQ ID NO: 16355 - DNA, 566 bp, Homo sapiens
  ENST00000540503
tttaaatttaaatgtctatgttaacaacacaaagaggattagttccagtaggtgcactagttaaaaatgttctgattaacaagtctaaggcctcctcaggtctaatactggccatgtgtgttgtcttctttagacttaggagaagtcaatcaactacattcaacccagatgacatgtctgagcctgaattcaaaagaggagggacaagggcaaccgcggggccccgattaggttggtctcgagacttgggacagtctaacagtgacttggatatgccatttgccaagtggaccaaggagcaggtttgcaattggctgatggaacagggcttgggctcgtacctgaattctggcaagcactggattgcatctggccaaacgcttttgcaggcttctcaacaagatctagagaaggaacttggaatcaagcattcacttcatcgaaagaaactccagctagcactccaagccctgggatctgaagaagaaaccaatcatgggaagctggatttcaactgggtcactagatggttggatgacattggcctccctcaatataagacccag

SEQ ID NO: 16356 - DNA, 973 bp, Homo sapiens
  ENST00000539326
atgacattggcctccctcaatataagacccagtttgatgaaggacgggttgatggtcgaatgctacattacatgactgttaataccatcgccccatcagaagttcagaagtggactaaccatcgagtgatggagtggctgcgctccgtggacttggcagaatatgcgcccaatctcagaggcagtggtgtccatggtgggctcatggttctagagcctcgttttaacgtagaaacaatggctcagttattgaacatcccacccaataagactttgctgcgaagacatttggccactcatttcaaccttctgattggggctgaggcacagcaccagaagcgagatgccatggagctgccggattatgtacttctaacagctactgccaaagtgaagccaaagaaacttgcctttagcaattttgggaatttgagaaagaagaaacaggaagatggtgaagaatatgtttgtccaatggaattgggacaggcatcaggaagtgcatctaagaaaggatttaaacctggtttggatatgcgcctgtatgaggaagatgatttggaccggttagagcagatggaagattcagaagggacagtgagacagataggtgcattctctgaaggcatcaacaatctgacgcacatgttaaaagaagatgacatgtttaaagattttgctgcccgttcccccagtgccagcattacagatgaagactcaaacgtttgaccgtagcacctggatgaacattaggagtgcttagtcttttttctacttgcttttccaaacactcacagtatatacaacaggcagcggattgtctattgtttgttgttccaacttctgctgtcgagaagtttaaacagaaagcaggagtaatgtgccgattctgaagttgccacaaaaaataagacactggtgaatgagagtataattgtttttcttctatttaatgtaaaaatctgtgatatatt

SEQ ID NO: 16357 - DNA, 424 bp, Homo sapiens
  ENST00000540256
ctttctttttgcatttagtgggttgttgagtaactgtactccatggagcagactttttagacagaaaatgcaatttaatatttaggatcctggttgtgtgttcccatagaataccatcgccccatcagaagttcagaagtggactaaccatcgagtgatggagtggctgcgctccgtggacttggcagaatatgcgcccaatctcagaggcagtggtgtccatggtgggctcatggttctagagcctcgttttaacgtagaaacaatggctcagttattgaacatcccacccaataagactttgctgcgaagacatttggccactcatttcaaccttctgattggggctgaggcacagcaccagaagcgagatgccatggagctgccggattatgtacttctaacagctactgccaaagtgaag

SEQ ID NO: 16358 - DNA, 484 bp, Homo sapiens
  ENST00000526873
actagagggacctccaccccaggttgcgagtgcagcgcggcgggacctgggatgattcgggggctttccgacctgcttagggagggcggctcagagacaacctcaattttgcctggattgcacgcgggccgaggaagtcgggatgctccgaagggtttctgctctgggagtgcctctaattaagaagaggaggaggccaggcaggcaaaaggagtcatggcttctgatgctagtcatgcgctggaagctgccctggagcaaatggacgggatcattgcaggcactaaaacaggtgcagatcttagtgatggtacttgtgagcctggactggcttccccggcctcctacatgaaccccttcccggtgctccatctcatcgaggacttgaggctggccttggagatgctggagcttcctcaggagagagcagccctcctgagccagatccctggcccaacagctgcctacataaaggaatggtttg

SEQ ID NO: 16359 - DNA, 814 bp, Homo sapiens
  ENST00000528947
gggctgaccaggccggtcccccgggaacaggaaccctggtggacgggtcccagcaggcttcttcggtgcccgagagggagcgggtgcccaagggggtggtccctgtggcaggtcccggggtgggggcgcggcgctccgggaagagccttccgcaggtccccgccccgtcacgtgggcgccggccccggccgctgcggtcggtccgctggttggtcgggcgcttggtccggcagttggtcggtgggccagtggcccgtcgctcgcttctgggctctcatgtttgaaggtgggagggacacgggagcggcccgcacacctgagccgcccggagaggagcctcggccccgtacccaggaaaaactggcggagagcctcagaaccacctgtttcctctgctgcaccatgcttgagtgtggaagccgtgcccctgttctccacagcgtgtatggccattcggcacatgtgtagatttgctgaatgagcaaacagcaactcctccagtttacagactaagaagaggaggaggccaggcaggcaaaaggagtcatggcttctgatgctagtcatgcgctggaagctgccctggagcaaatggacgggatcattgcaggcactaaaacaggtgcagatcttagtgatggtacttgtgagcctggactggcttccccggcctcctacatgaaccccttcccggtgctccatctcatcgaggacttgaggctggccttggagatgctggagcttcctcaggagagagcagccctcctgagccagatccctggcccaacagctgcctacataaaggaatggtttg

SEQ ID NO: 16360 - DNA, 3557 bp, Homo sapiens
  ENST00000299492
gctgaccaggccggtcccccgggaacaggaaccctggtggacgggtcccagcaggcttcttcggtgcccgagagggagcgggtgcccaagggggtggtccctgtggcaggtcccggggtgggggcgcggcgctccgggaagagccttccgcaggtccccgccccgtcacgtgggcgccggccccggccgctgcggtcggtccgctggttggtcgggcgcttggtccggcagttggtcggtgggccagtggcccgtcgctcgcttctgggctctcatgtttgaaggtgggagggacacgggagcggcccgcacacctgagccgcccggagaggagcctcggccccgtacccagtaagaagaggaggaggccaggcaggcaaaaggagtcatggcttctgatgctagtcatgcgctggaagctgccctggagcaaatggacgggatcattgcaggcactaaaacaggtgcagatcttagtgatggtacttgtgagcctggactggcttccccggcctcctacatgaaccccttcccggtgctccatctcatcgaggacttgaggctggccttggagatgctggagcttcctcaggagagagcagccctcctgagccagatccctggcccaacagctgcctacataaaggaatggtttgaagagagcttgtcccaggtaaaccaccacagtgctgctagtaatgaaacctaccaggaacgcttggcacgtctagaaggggataaggagtccctcatattgcaggtgagtgtcctcacagaccaagtagaagcccagggagaaaagattcgagacctggaagtgtgtctggaaggacaccaggtgaaactcaatgctgctgaagagatgcttcaacaggagctgctaagccgcacatctcttgagacccagaagctcgatctgatgactgaagtgtctgagctgaagctcaagctggttggcatggagaaggagcagagagagcaggaggagaagcagagaaaagcagaggagttactgcaagagctcaggcacctcaaaatcaaagtggaagagttggaaaatgaaaggaatcagtatgaatggaagctaaaggccactaaggctgaagtcgcccagctgcaagaacaggtggccctgaaagatgcagaaattgagcgtctgcacagccagctctcccggacagcagctctccacagtgagagtcacacagagagagaccaagaaattcaacgtctgaaaatggggatggaaactttgctgcttgccaatgaagataaggaccgtcggatagaggagcttacggggctgttaaaccagtaccggaaggtaaaggagattgtgatggtcactcaagggccttcggagagaactctctcaatcaatgaagaagaaccggagggaggtttcagcaagtggaacgctacaaataaggaccctgaagaattatttaaacaagagatgcctccaagatgtagctctcctacagtggggccacctccattgccacagaaatcactggaaaccagggctcagaaaaagctctcttgtagtctagaagacttgagaagtgaatctgtggataagtgtatggatgggaaccagcccttcccggtgttagaacccaaggacagccctttcttggcggagcacaaatatcccactttacctgggaagctttcaggagccacgcccaatggagaggctgccaaatctcctcccaccatctgccagcctgacgccacggggagcagcctgctgaggctgagagacacagaaagtggctgggacgacactgctgtggtcaatgacctctcatccacatcatcgggcactgaatcaggtcctcagtctcctctgacaccagatggtaaacggaatcccaaaggcattaagaagttctggggaaaaatccgaagaactcagtcaggaaatttctacactgacacgctggggatggcagagtttcgacgaggtgggctccgggcaaccgcagggccaagactctctaggaccagggactccaagggacagaaaagtgacgccaatgccccctttgcccagtggagcacagagcgtgtgtgtgcatggctggaggactttggcctggctcagtatgtgatctttgccaggcagtgggtatcttctggccacaccttattgacagccacccctcaggacatggaaaaggagctaggaattaagcacccactccacaggaagaagcttgttttagcagtgaaagccatcaacaccaaacaggaggagaagtctgcactgctagaccacatttgggtgacaaggtggcttgatgatattggcttaccccagtacaaagaccagtttcatgaatctagagttgacagacgaatgctgcaatacctaactgtgaacgatttactcttcttaaaagtcaccagccaactacatcatctcagcatcaaatgtgccattcacgtgctgcatgtcaacaagttcaacccccactgcctgcaccggcggccagctgatgagagtaacctttctccttcagaagttgtacagtggtccaaccacagggtgatggagtggttacgatctgtggacctggcagagtatgcacccaatcttcgagggagtggagtccatggaggcctcattatcctggagccacgcttcactggggacaccctggctatgcttctcaacatccccccacaaaagacgctcctcaggcgccacctgaccaccaagttcaatgccttgattggtccggaggctgaacaggagaagcgagagaaaatggcctcaccagcttacacaccactgaccaccacagccaaagtccggccaaggaaactaggattttcacacttcggaaacataagaaaaaagaagttcgatgaatcgacggactacatttgcccaatggagcccagtgacggtgtcagtgatagtcacagggtctacagtggctaccggggcctcagcccccttgatgcccctgaactggatgggctggaccaggtgggacagattagctgatgcccttgtcacctgccctctgtgcaccctgagagctcacagtaacactgtgtgtgtcaccatataactgcacctcacccccgcacgtgtgcatgactcgcagagaatattccagcaattgtgtacccctgggccagtctctttgaaccctgagggtggccaggatctggagctgcatctctaaggggccaggctttggggaccattgccaaaggtggactcaggaggaaagacacttaaagacacttttacatgtctagtaattcttgatgttcatcttcagcaccagtggaaacacatgaacttcgatgcaggtccagagaccatggacactcccacgaggctcagctctcaggcaccccctacacttcagttgagggaaaagctcaagtgccttaggcccgtggaccacagtcttggctgagatcaaagggatgagcaacagggacttctgccacagtgacaatggaattgtgttgtgccttacttcagaggtggtctcttctttcttgtaataaaagcaatatttatgcggaaa

SEQ ID NO: 16361 - DNA, 625 bp, Homo sapiens
  ENST00000527790
cagtaggaggaggatgtcgctgctgagactgtgggacagctaggctcagagggagtctgacttcggggcacccggagtaagaagaggaggaggccaggcaggcaaaaggagtcatggcttctgatgctagtcatgcgctggaagctgccctggagcaaatggacgggatcattgcaggcactaaaacaggtgcagatcttagtgatggtacttgtgagcctggactggcttccccggcctcctacatgaaccccttcccggtgctccatctcatcgaggacttgaggctggccttggagatgctggagcttcctcaggagagagcagccctcctgagccagatccctggcccaacagctgcctacataaaggaatggtttgaagagagcttgtcccaggtaaaccaccacagtgctgctagtaatgaaacctaccaggaacgcttggcacgtctagaaggggataaggagtccctcatattgcaggtgagtgtcctcacagaccaagtagaagcccagggagaaaagattcgagacctggaagtgtgtctggaaggacaccaggtgaaactcaatgctgctgaagagatgcttcaacaggagctgctaagccgcacatctcttga

SEQ ID NO: 16362 - DNA, 534 bp, Homo sapiens
  ENST00000526046
attcagcaactctgatagcaacgttctcagcagcctggcccctctgtcctgctatggctcctctttgtcctgacaggatatctcgctgtgttgggctcctctgtcctgagggaaatttagcacaatggccttgtccctcattgtgatataaagccagtgtctgtgggctctgccattgctctgaggagctgtcttcgcaggccaggtgtgcggcttctcctctccactgtcagatctgatcctgtgggggtcgtgacctctggatgttataggacctgtggaggacagtaagaagaggaggaggccaggcaggcaaaaggagtcatggcttctgatgctagtcatgcgctggaagctgccctggagcaaatggacgggatcattgcaggcactaaaacaggtgcagatcttagtgatggtacttgtgagcctggactggcttccccggcctcctacatgaaccccttcccggtgctccatctcatcgaggacttgaggctggccttggagatgctggagcttcctcaggagaga

SEQ ID NO: 16363 - DNA, 407 bp, Homo sapiens
  ENST00000524548
accccttcccggtgctccatctcatcgaggacttgaggctggccttggagatgctggagcttcctcaggagagagcagccctcctgagccagatccctggcccaacagctgcctacataaaggaatggtttgaagagagcttgtcccaggtaaaccaccacagtgctgctagtaatgaaacctaccaggaacgcttggcacgtctagaaggggataaggagtccctcatattgcaggtgagtgtcctcacagaccaagtagaagcccagggagaaaagattcgagacctggaagtgtgtctggaaggacaccaggtgaaactcaatgctgctgaagagatgcttcaacagatatgcaatttagtcctcagattttgtatgcttaatattatatttttcccatttaaa

SEQ ID NO: 16364 - DNA, 780 bp, Homo sapiens
  ENST00000529575
agtttacagttctgcctgataagatgctgctgatttctggtaggcagcaggagtaacacctcagggggcctcagctcctttttcagccattccctcaagtacttggaattccagccagtcccaggtaaaccaccacagtgctgctagtaatgaaacctaccaggaacgcttggcacgtctagaaggggataaggagtccctcatattgcaggtgagtgtcctcacagaccaagtagaagcccagggagaaaagattcgagacctggaagtgtgtctggaaggacaccaggtgaaactcaatgctgctgaagagatgcttcaacaggagctgctaagccgcacatctcttgagacccagaagctcgatctgatgactgaagtgtctgagctgaagctcaagctggttggcatggagaaggagcagagagagcaggaggagaagcagagaaaagcagaggagttactgcaagagctcaggcacctcaaaatcaaagtggaagagttggaaaatgaaaggaatcagtatgaatggaagctaaaggccactaaggctgaagtcgcccagctgcaagaacaggtggccctgaaagatgcagaaattgagcgtctgcacagccagctctcccggacagcagctctccacagtgagagtcacacagagagagaccaagaaattcaacgtctgaaaatggggatggaaactttgctgcttgccaatgaagataaggaccgtcggatagaggagcttacggggctgttaaaccagtaccggaaggtaaa

SEQ ID NO: 16365 - DNA, 3003 bp, Homo sapiens
  ENST00000533792
gatgggaataggaggaggtggggggtggcatctagggagtgctggaggggccacctggagagcctgcatgtgacctgccctgaaaggaggaaaacagctgcagctccagtcccaggtaaaccaccacagtgctgctagtaatgaaacctaccaggaacgcttggcacgtctagaaggggataaggagtccctcatattgcaggtgagtgtcctcacagaccaagtagaagcccagggagaaaagattcgagacctggaagtgtgtctggaaggacaccaggtgaaactcaatgctgctgaagagatgcttcaacaggagctgctaagccgcacatctcttgagacccagaagctcgatctgatgactgaagtgtctgagctgaagctcaagctggttggcatggagaaggagcagagagagcaggaggagaagcagagaaaagcagaggagttactgcaagagctcaggcacctcaaaatcaaagtggaagagttggaaaatgaaaggaatcagtatgaatggaagctaaaggccactaaggctgaagtcgcccagctgcaagaacaggtggccctgaaagatgcagaaattgagcgtctgcacagccagctctcccggacagcagctctccacagtgagagtcacacagagagagaccaagaaattcaacgtctgaaaatggggatggaaactttgctgcttgccaatgaagataaggaccgtcggatagaggagcttacggggctgttaaaccagtaccggaaggtaaaggagattgtgatggtcactcaagggccttcggagagaactctctcaatcaatgaagaagaaccggagggaggtttcagcaagtggaacgctacaaataaggaccctgaagaattatttaaacaagagatgcctccaagatgtagctctcctacagtggggccacctccattgccacagaaatcactggaaaccagggctcagaaaaagctctcttgtagtctagaagacttgagaagtgaatctgtggataagtgtatggatgggaaccagcccttcccggtgttagaacccaaggacagccctttcttggcggagcacaaatatcccactttacctgggaagctttcaggagccacgcccaatggagaggctgccaaatctcctcccaccatctgccagcctgacgccacggggagcagcctgctgaggctgagagacacagaaagtggctgggacgacactgctgtggtcaatgacctctcatccacatcatcgggcactgaatcaggtcctcagtctcctctgacaccagatggtaaacggaatcccaaaggcattaagaagttctggggaaaaatccgaagaactcagtcaggaaatttctacactgacacgctggggatggcagagtttcgacgaggtgggctccgggcaaccgcagggccaagactctctaggaccagggactccaagggacagaaaagtgacgccaatgccccctttgcccagtggagcacagagcgtgtgtgtgcatggctggaggactttggcctggctcagtatgtgatctttgccaggcagtgggtatcttctggccacaccttattgacagccacccctcaggacatggaaaaggagctaggaattaagcacccactccacaggaagaagcttgttttagcagtgaaagccatcaacaccaaacaggaggagaagtctgcactgctagaccacatttgggtgacaaggtggcttgatgatattggcttaccccagtacaaagaccagtttcatgaatctagagttgacagacgaatgctgcaatacctaactgtgaacgatttactcttcttaaaagtcaccagccaactacatcatctcagcatcaaatgtgccattcacgtgctgcatgtcaacaagttcaacccccactgcctgcaccggcggccagctgatgagagtaacctttctccttcagaagttgtacagtggtccaaccacagggtgatggagtggttacgatctgtggacctggcagagtatgcacccaatcttcgagggagtggagtccatggaggcctcattatcctggagccacgcttcactggggacaccctggctatgcttctcaacatccccccacaaaagacgctcctcaggcgccacctgaccaccaagttcaatgccttgattggtccggaggctgaacaggagaagcgagagaaaatggcctcaccagcttacacaccactgaccaccacagccaaagtccggccaaggaaactaggattttcacacttcggaaacataagaaaaaagaagttcgatgaatcgacggactacatttgcccaatggagcccagtgacggtgtcagtgatagtcacagggtctacagtggctaccggggcctcagcccccttgatgcccctgaactggatgggctggaccaggtgggacagattagctgatgcccttgtcacctgccctctgtgcaccctgagagctcacagtaacactgtgtgtgtcaccatataactgcacctcacccccgcacgtgtgcatgactcgcagagaatattccagcaattgtgtacccctgggccagtctctttgaaccctgagggtggccaggatctggagctgcatctctaaggggccaggctttggggaccattgccaaaggtggactcaggaggaaagacacttaaagacacttttacatgtctagtaattcttgatgttcatcttcagcaccagtggaaacacatgaacttcgatgcaggtccagagaccatggacactcccacgaggctcagctctcaggcaccccctacacttcagttgagggaaaagctcaagtgccttaggcccgtggaccacagtcttggctgagatcaaagggatgagcaacagggacttctgccacagtgacaatggaattgtgttgtgccttacttcagaggtggtctcttctttcttgtaataaaagcaatatttatgcggaaagcaa

SEQ ID NO: 16366 - DNA, 1597 bp, Homo sapiens
  ENST00000532926
aatggatggtaccaccagtgccaaggacagcaaacgctctgtgctgggcccgtcgcacagcaggaccaagaacccagactggagctgcttttttttggaaacaacaggctttcctcagggcacagcccgtcactcgcctggaaaatgggtgggcgtgggcttcagggcgggggtcaggctgtgtgtgggaaccagtgagctcctccaagagcagcacttatttttagtcttctccccagtcccaaataaactgagagcagctgggagccctgggtaaatgcagagtgaagcagagacaggaaatcggggctctcagtaatgagttccagccactccagaagggggaagccagacaaggaattttcttcaggactgtttccctctggcaggctccggtattatcactgagaatggtcccgtgtgtgtgtgcgtgtgtgtcatgtttacaacttctgtccaagtcttctttcttttttctctacctttgtgtgacatttgatttctccgcagggctctgaatcccagtcctggtgcgtgtgcgtgcatgtatgtgcgtgtgtgtgtgtgtgtgtgtgtgtgtgtgtgtttgttggggtggtcggggaggacactgaagcagcacggtctgctctgtgtcgctgtgtgtctgaaactgtctagggagaggctgaaggacgcaggccagggaagtggggaaatttgaacacagcttggagttcttgaggggggagggggcagaggcaaggaagaggagagaactggtctccagccaggaaaagggctttttccaccaaggcatctaactgctgacatgggtgcccagcatggatggggacattgatgtttacaagcatttctcgtggctgaagaggtcccaggtaaaccaccacagtgctgctagtaatgaaacctaccaggaacgcttggcacgtctagaaggggataaggagtccctcatattgcaggagctgctaagccgcacatctcttgagacccagaagctcgatctgatgactgaagtgtctgagctgaagctcaagctggttggcatggagaaggagcagagagagcaggaggagaagcagagaaaagcagagctcacagtaacactgtgtgtgtcaccatataactgcacctcacccccgcacgtgtgcatgactcgcagagaatattccagcaattgtgtacccctgggccagtctctttgaaccctgagggtggccaggatctggagctgcatctctaaggggccaggctttggggaccattgccaaaggtggactcaggaggaaagacacttaaagacacttttacatgtctagtaattcttgatgttcatcttcagcaccagtggaaacacatgaacttcgatgcaggtccagagaccatggacactcccacgaggctcagctctcaggcaccccctacacttcagttgagggaaaagctcaagtgccttaggcccgtggaccacagtcttggctgagatcaaagggatgagcaacagggacttctgccacagtgacaatggaattgtgttgtgccttacttcagaggtggtctcttctttcttgtaataaaagcaatatttatgcgg

SEQ ID NO: 16367 - DNA, 577 bp, Homo sapiens
  ENST00000525597
gtaaatgcagagtgaagcagagacaggaaatcggggctctcagtaatgagttccagccactccagaagggggaagccagacaaggaattttcttcaggactgtttccctctggcaggctccgtcccaggtaaaccaccacagtgctgctagtaatgaaacctaccaggaacgcttggcacgtctagaaggggataaggagtccctcatattgcaggtgagtgtcctcacagaccaagtagaagcccagggagaaaagattcgagacctggaagtgtgtctggaaggacaccaggtgaaactcaatgctgctgaagagatgcttcaacaggagctgctaagccgcacatctcttgagacccagaagctcgatctgatgactgaagtgtctgagctgaagctcaagctggttggcatggagaaggagcagagagagcaggaggagaagcagagaaaagcagaggagttactgcaagagctcaggcacctcaaaatcaaagtggaagagttggaaaatgaaaggaatcagtatgaatggaagctaaaggccactaaggctgaagtcgcccagctgcaaga

SEQ ID NO: 16368 - DNA, 602 bp, Homo sapiens
  ENST00000529021
agacaaggaattttcttcaggactgtttccctctggcaggctccggtattatcactgagaatggtcccgtgtgtgtgtgcgtgtgtgtcatgtttacaacttctgtccaagtcttctttcttttttctctacctttgtgtgacatttgatttctccgcagggctctgaatcccagtcctggtgcgtgtgcgtgcatgtatgtgcgtgtgtgtgtgtgtgtgtgtgtgtgtgtgtgtttgttggggtggtcggggaggacactgaagcagcacggtctgctctgtgtcgctgtgtgtctgaaactgtctagggagaggctgctgcccattttacagatggcaccttcggaagacaatgctgagccaggaccagctgctgaatgactctcgcctgcctgcccccaactctgatgactggagatgactttcttcgtggctgagagcgtagggaggcatgtgtgggggccccggagcctttgcttctgtggggagcgggcacacagccccctctgcaagcccagtccgggctggcagggtgtctcagacaggctgctgacaggcatgaagcagagctgtgggacaggtgtccaggggtggccccag

SEQ ID NO: 16369 - DNA, 2580 bp, Homo sapiens
  ENST00000528883
gttgcagaagtgctggcaagccagctgagatgtgccttgaggtcggggctgttctggaagaggaataaggagcaggagtccagcccagaggcagctcctgtggctgttgggtgttttactcttgagtctatcaagagcagtaaacgtgacccatgtcatcagagcagtggccgagactccctggtaaggtgagtgtcctcacagaccaagtagaagcccagggagaaaagattcgagacctggaagtgtgtctggaaggacaccaggtgaaactcaatgctgctgaagagatgcttcaacaggagctgctaagccgcacatctcttgagacccagaagctcgatctgatgactgaagtgtctgagctgaagctcaagctggttggcatggagaaggagcagagagagcaggaggagaagcagagaaaagcagaggagttactgcaagagctcaggcacctcaaaatcaaagtggaagagttggaaaatgaaaggaatcagtatgaatggaagctaaaggccactaaggctgaagtcgcccagctgcaagaacaggtggccctgaaagatgcagaaattgagcgtctgcacagccagctctcccggacagcagctctccacagtgagagtcacacagagagagaccaagaaattcaacgtctgaaaatggggatggaaactttgctgcttgccaatgaagataaggaccgtcggatagaggagcttacggggctgttaaaccagtaccggaaggtaaaggagattgtgatggtcactcaagggccttcggagagaactctctcaatcaatgaagaagaaccggagggaggtttcagcaagtggaacgctacaaataaggaccctgaagaattatttaaacaagagatgcctccaagatgtagctctcctacagtggggccacctccattgccacagaaatcactggaaaccagggctcagaaaaagctctcttgtagtctagaagacttgagaagtgaatctgtggataagtgtatggatgggaaccagcccttcccggtgttagaacccaaggacagccctttcttggcggagcacaaatatcccactttacctgggaagctttcaggagccacgcccaatggagaggctgccaaatctcctcccaccatctgccagcctgacgccacggggagcagcctgctgaggctgagagacacagaaagtggctgggacgacactgctgtggtcaatgacctctcatccacatcatcgggcactgaatcaggtcctcagtctcctctgacaccagatggtaaacggaatcccaaaggcattaagaagttctggggaaaaatccgaagaactcagtcaggaaatttctacactgacacgctggggatggcagagtttcgacgaggtgggctccgggcaaccgcagggccaagactctctaggaccagggactccaagggacagaaaagtgacgccaatgccccctttgcccagtggagcacagagcgtgtgtgtgcatggctggaggactttggcctggctcagtatgtgatctttgccaggcagtgggtatcttctggccacaccttattgacagccacccctcaggacatggaaaaggagctaggaattaagcacccactccacaggaagaagcttgttttagcagtgaaagccatcaacaccaaacaggaggagaagtctgcactgctagaccacatttgggtgacaaggtggcttgatgatattggcttaccccagtacaaagaccagtttcatgaatctagagttgacagacgaatgctgcaatacctaactgtgaacgatttactcttcttaaaagtcaccagccaactacatcatctcagcatcaaatgtgccattcacgtgctgcatgtcaacaagttcaacccccactgcctgcaccggcggccagctgatgagagtaacctttctccttcagaagttgtacagtggtccaaccacagggtgatggagtggttacgatctgtggacctggcagagtatgcacccaatcttcgagggagtggagtccatggaggcctcattatcctggagccacgcttcactggggacaccctggctatgcttctcaacatccccccacaaaagacgctcctcaggcgccacctgaccaccaagttcaatgccttgattggtccggaggctgaacaggagaagcgagagaaaatggcctcaccagcttacacaccactgaccaccacagccaaagtccggccaaggaaactaggattttcacacttcggaaacataagaaaaaagaagttcgatgaatcgacggactacatttgcccaatggagcccagtgacggtgtcagtgatagtcacagggtctacagtggctaccggggcctcagcccccttgatgcccctgaactggatgggctggaccaggtgggacagattagctgatgcccttgtcacctgccctctgtgcaccctgagagctcacagtaacactgtgtgtgtcaccatataactgcacctcacccccgcacgtgtgcatgactcgcagagaatattccagcaattgtgtacccctggg

SEQ ID NO: 16370 - DNA, 1059 bp, Homo sapiens
  ENST00000529321
ttctggaagaggaataaggagcaggagtccagcccagaggcagctcctgtggctgttgggtgttttactcttgagtctatcaagagcagtaaacgtgacccatgtcatcagagcagtggccgagactccctggtaaggtgagtgtcctcacagaccaagtagaagcccagggagaaaagattcgagacctggaagtgtgtctggaaggacaccaggtgaaactcaatgctgctgaagagatgcttcaacaggtaagggcgggtgcactgaaggcccttgggtgccgaagcagctcatgtgctgaagcccctttgtgtgcccaggctacagccctcgctgtctgctttcccatcctgcctgggggcgggattggctgctcagttgtacggtgtttatacagcaggtgaaaccaacctgaacgttgagagtggcagagggggtagggaagggaagggctgccctgagatgaataacctgctgagctggttagacagattcccagacagcactttctccagacctggtgcagtgagggagcgctcggctgggggcctcaccctcatcctgtgggtgccatctggagttttagaaagtcaattctcagctgattctatgcccctttcccatctcgctctgcctcttcctactgtatatagtttttaaaataaaaatattatataaataaccttttagtataatttaatagatatcaaaatggaaaaagatatttaactgttccctaccattcaaataatgtcttctccttgttttctttttgtccttgttatgtgtacatgtactttccaaatctgtaatcacaagagatatgcaatttagtcctcagattttgtatgcttaatattatatttttcccatttaaaatttttgctgtattgtcatctttactatcacctataatagattttcttagtaaaagtatcagaattgacttaactttttttcaattcctaaatatttttactgtattataaataatgagctacaattttttaggaaggggtgttgaatttttattgtatcaaaacttcagaatttgtt

SEQ ID NO: 16371 - DNA, 320 bp, Homo sapiens
  ENST00000530189
gcccagggagaaaagattcgagacctggaagtgtgtctggaaggacaccaggtgaaactcaatgctgctgaagagatgcttcaacaggagctgctaagccgcacatctcttgagacccagaagctcgatctgatgactgaagtgtctgagctgaagctcaagctggttggcatggagaaggagcagagagagcaggaggagaagcagagaaaagcagaggtaagggtgagtgtgtactgtcctaagctcagacctgggaaggctgtcataatgtgaatttaggccatctggtcaactcccagcctggaagctattgggtg

SEQ ID NO: 16372 - DNA, 2965 bp, Homo sapiens
  ENST00000530181
aagaaattagaggttgagtgagcaagtgggacagatgaaaggtcagaagattgtggccagaggagagaatttcagagctgaagattttagaagcaaagcaaacacattctggatacacgtgagatccaagtggtgactgtgctactgagaagctgaacgaaatggaaagcaaagcctgttggagctgaggtcaaagaatgtgaagccagagtggatactgaatgggaaagttaataacaaggatgtggaagctattgaggagacggagtgcgcctaaagagctgctaagccgcacatctcttgagacccagaagctcgatctgatgactgaagtgtctgagctgaagctcaagctggttggcatggagaaggagcagagagagcaggaggagaagcagagaaaagcagaggagttactgcaagagctcaggcacctcaaaatcaaagtggaagagttggaaaatgaaaggaatcagtatgaatggaagctaaaggccactaaggctgaagtcgcccagctgcaagaacaggtggccctgaaagatgcagaaattgagcgtctgcacagccagctctcccggacagcagctctccacagtgagagtcacacagagagagaccaagaaattcaacgtctgaaaatggggatggaaactttgctgcttgccaatgaagataaggaccgtcggatagaggagcttacggggctgttaaaccagtaccggaaggtaaaggagattgtgatggtcactcaagggccttcggagagaactctctcaatcaatgaagaagaaccggagggaggtttcagcaagtggaacgctacaaataaggaccctgaagaattatttaaacaagagatgcctccaagatgtagctctcctacagtggggccacctccattgccacagaaatcactggaaaccagggctcagaaaaagctctcttgtagtctagaagacttgagaagtgaatctgtggataagtgtatggatgggaaccagcccttcccggtgttagaacccaaggacagccctttcttggcggagcacaaatatcccactttacctgggaagctttcaggagccacgcccaatggagaggctgccaaatctcctcccaccatctgccagcctgacgccacggggagcagcctgctgaggctgagagacacagaaagtggctgggacgacactgctgtggtcaatgacctctcatccacatcatcgggcactgaatcaggtcctcagtctcctctgacaccagatggtaaacggaatcccaaaggcattaagaagttctggggaaaaatccgaagaactcagtcaggaaatttctacactgacacgctggggatggcagagtttcgacgaggtgggctccgggcaaccgcagggccaagactctctaggaccagggactccaagggacagaaaagtgacgccaatgccccctttgcccagtggagcacagagcgtgtgtgtgcatggctggaggactttggcctggctcagtatgtgatctttgccaggcagtgggtatcttctggccacaccttattgacagccacccctcaggacatggaaaaggagctaggaattaagcacccactccacaggaagaagcttgttttagcagtgaaagccatcaacaccaaacaggaggagaagtctgcactgctagaccacatttgggtgacaaggtggcttgatgatattggcttaccccagtacaaagaccagtttcatgaatctagagttgacagacgaatgctgcaatacctaactgtgaacgatttactcttcttaaaagtcaccagccaactacatcatctcagcatcaaatgtgccattcacgtgctgcatgtcaacaagttcaacccccactgcctgcaccggcggccagctgatgagagtaacctttctccttcagaagttgtacagtggtccaaccacagggtgatggagtggttacgatctgtggacctggcagagtatgcacccaatcttcgagggagtggagtccatggaggcctcattatcctggagccacgcttcactggggacaccctggctatgcttctcaacatccccccacaaaagacgctcctcaggcgccacctgaccaccaagttcaatgccttgattggtccggaggctgaacaggagaagcgagagaaaatggcctcaccagcttacacaccactgaccaccacagccaaagtccggccaaggaaactaggattttcacacttcggaaacataagaaaaaagaagttcgatgaatcgacggactacatttgcccaatggagcccagtgacggtgtcagtgatagtcacagggtctacagtggctaccggggcctcagcccccttgatgcccctgaactggatgggctggaccaggtgggacagattagctgatgcccttgtcacctgccctctgtgcaccctgagagctcacagtaacactgtgtgtgtcaccatataactgcacctcacccccgcacgtgtgcatgactcgcagagaatattccagcaattgtgtacccctgggccagtctctttgaaccctgagggtggccaggatctggagctgcatctctaaggggccaggctttggggaccattgccaaaggtggactcaggaggaaagacacttaaagacacttttacatgtctagtaattcttgatgttcatcttcagcaccagtggaaacacatgaacttcgatgcaggtccagagaccatggacactcccacgaggctcagctctcaggcaccccctacacttcagttgagggaaaagctcaagtgccttaggcccgtggaccacagtcttggctgagatcaaagggatgagcaacagggacttctgccacagtgacaatggaattgtgttgtgccttacttcagaggtggtctcttctttcttgtaataaaagcaatatttatgcggaaagcaa

SEQ ID NO: 16373 - DNA, 538 bp, Homo sapiens
  ENST00000532416
tgaaagatgcagaaattgagcgtctgcacagccagctctcccggacagcagctctccacagtgagagtcacacagagagagaccaagaaattcaacgtctgaaaatggggatggaaactttgctgcttgccaatgaagataaggaccgtcggatagaggagcttacggggctgttaaaccagtaccggaaggtaaaggagattgtgatggtcactcaagggccttcggagagaactctctcaatcaatgaagaagaaccggagggaggtttcagcaagtggaacgctacaaataaggaccctgaagaattatttaaacaagaggtactgtgtttccatccatgacgtagggtttcagcaggtcctccgagcttgccctgagcttgagggaggatctagtcagacacgtgtcaggtgcacatcttggcaggtgaatacttaaattaatatagtgcccctcaggctgtgatggggatgggcgagcaagaggctgaggctctggcctgtgctctggttggaggcagcatggtggatactgg

SEQ ID NO: 16374 - DNA, 673 bp, Homo sapiens
  ENST00000534409
agggccttcggagagaactctctcaatcaatgaagaagaaccggagggaggtttcagcaagtggaacgctacaaataaggaccctgaagaattatttaaacaagagatgcctccaagatgtagctctcctacagtggggccacctccattgccacagaaatcactggaaaccagggctcagaaaaagctctcttgtagtctagaagacttgagaagtgaatctgtggataagtgtatggatgggaaccagcccttcccggtgttagaacccaaggacagccctttcttggcggagcacaaatatcccactttacctgggaagctttcaggagccacgcccaatggagaggctgccaaatctcctcccaccatctgccagcctgacgccacggggagcagcctgctgaggctgaatcgtggccggagtgtcagtgcccccgtattaggagacacagaaagtggctgggacgacactgctgtggtcaatgacctctcatccacatcatcgggcactgaatcaggtcctcagtctcctctgacaccagatggtaaacggaatcccaaaggcattaagaagttctggggaaaaatccgaagaactcagtcaggaaatttctacactgacacgctggggatggcagagtttcgacgaggtgggctccgggcaaccgca

SEQ ID NO: 16375 - DNA, 2042 bp, Homo sapiens
  ENST00000530582
aaggaccctgaagaattatttaaacaagagatgcctccaagatgtagctctcctacagtggggccacctccattgccacagaaatcactggaaaccagggctcagaaaaagctctcttgtagtctagaagacttgagaagtgaatctgtggataagtgtatggatgggaaccagcccttcccggtgttagaacccaaggacagccctttcttggcggagcacaaatatcccactttacctgggaagctttcaggagccacgcccaatggagaggctgccaaatctcctcccaccatctgccagcctgacgccacggggagcagcctgctgaggctgagagacacagaaagtggctgggacgacactgctgtggtcaatgacctctcatccacatcatcgggcactgaatcaggtcctcagtctcctctgacaccagatggtaaacggaatcccaaaggcattaagaagttctggggaaaaatccgaagaactcagtcaggaaatttctacactgacacgctggggatggcagagtttcgacgaggtgggctccgggcaaccgcagggccaagactctctaggaccagggactccaagggacagaaaagtgacgccaatgccccctttgcccagtggagcacagagcgtgtgtgtgcatggctggaggactttggcctggctcagtatgtgatctttgccaggcagtgggtatcttctggccacaccttattgacagccacccctcaggacatggaaaaggagctaggaattaagcacccactccacaggaagaagcttgttttagcagtgaaagccatcaacaccaaacaggaggagaagtctgcactgctagaccacatttgggtgacaaggtggcttgatgatattggcttaccccagtacaaagaccagtttcatgaatctagagttgacagacgaatgctgcaatacctaactgtgaacgatttactcttcttaaaagtcaccagccaactacatcatctcagcatcaaatgtgccattcacgtgctgcatgtcaacaagttcaacccccactgcctgcaccggcggccagctgatgagagtaacctttctccttcagaagttgtacagtggtccaaccacagggtgatggagtggttacgatctgtggacctggcagagtatgcacccaatcttcgagggagtggagtccatggaggcctcattatcctggagccacgcttcactggggacaccctggctatgcttctcaacatccccccacaaaagacgctcctcaggcgccacctgaccaccaagttcaatgccttgattggtccggaggctgaacaggagaagcgagagaaaatggcctcaccagcttacacaccactgaccaccacagccaaagtccggccaaggaaactaggattttcacacttcggaaacataagaaaaaagaagttcgatgaatcgacggactacatttgcccaatggagcccagtgacggtgtcagtgatagtcacagggtctacagtggctaccggggcctcagcccccttgatgcccctgaactggatgggctggaccagatggcaccttcggaaggtaccgtgacgcagatagggctcctctcccaagacattcaccgccttacgacaatgctgagccaggaccagctgctgaatgactctcgcctgcctgcccccaactctgatgactggagatgactttcttcgtggctgagagcgtagggaggcatgtgtgggggccccggagcctttgcttctgtggggagcgggcacacagccccctctgcaagcccagtccgggctggcagggtgtctcagacaggctgctgacaggcatgaagcagagctgtgggacaggtgtccaggggtggccccagggtccatgtgtgtcttcaaccatgctgcgctcttcaccgcaggcttcataccttttgtacttttatacgtggactgcagaccactttgtgggagggcagtgacatatcagcacacagactcgatggctcgtgatattcctggtgacagcc

SEQ ID NO: 16376 - DNA, 769 bp, Homo sapiens
  ENST00000532381
cttgtctgtctcccagatgtggggagtgcttgctccagacctggcacagggcctggcagggagtagatgttgctgatgtttgtcgggtgaccatatcaaatgggattttctcattgaaagcaacaaaatttggctctggctaacctaagccaaaaagaatgtttttaaaagagtctgcagtggctcgctgaatgaaaggaaaagctgaagaaccaagatcagaaagggaaggagcagaaaaagcccaagaacccaggtctcaggactgtactactgggatatgaacatgatctaagctctagggtccaggaaggagaggcaagctggcccagatggactgataagcctaccacacccccttgcatcttgaaagagcaaggcatctataatgatgtatccaccatggctgcacccagggaggaaatgtctccctaaaaggaatcatgtgaagcagggggaaagatggtgggtggtccccaaacagactgtcctctaccgtgactcttctgtctctggtgcagatgcctccaagatgtagctctcctacagtggggccacctccattgccacagaaatcactggaaaccagggctcagaaaaagctctcttgtagtctagaagacttgagaagtgaatctgtggataagtgtatggatgggaaccagcccttcccggtgttagaacccaaggacagccctttcttggcggagcacaaatatcccactttacctgggaagctttcaggagccacgcccaatggagaggctgc

SEQ ID NO: 16377 - DNA, 545 bp, Homo sapiens
  ENST00000530081
atgcctccaagatgtagctctcctacagtggggccacctccattgccacagaaatcactggaaaccagggctcagaaaaagctctcttgtagtctagaagacttgagaagtgaatctgtggataagtgtatggatgggaaccagcccttcccggtgttagaacccaaggacagccctttcttggcggagcacaaatatcccactttacctgggaagctttcaggagccacgcccaatggagaggctgccaaatctcctcccaccatctgccagcctgacgccacggggagcagcctgctgaggctgaatcgtggccggagtgtcagtgcccccgtattaggtactgtacccattccaggagacacagaaagtggctgggacgacactgctgtggtcaatgacctctcatccacatcatcgggcactgaatcaggtcctcagtctcctctgacaccagatggtaaacggaatcccaaaggcattaagaagttctggggaaaaatccgaagaactcagtcaggaaatttctacactgacacgctggg

SEQ ID NO: 16378 - DNA, 817 bp, Homo sapiens
  ENST00000532172
gacagccctttcttggcggagcacaaatatcccactttacctgggaagctttcaggagccacgcccaatggagaggctgccaaatctcctcccaccatctgccagcctgacgccacggggagcagcctgctgaggctgagagacacagaaagtggctgggacgacactgctgtggtcaatgacctctcatccacatcatcgggcactgaatcaggtcctcagtctcctctgacaccagatggtaaacggaatcccaaaggcattaagaagttctggggaaagtaagttggtgccgttgatcctaattatattgcttagaatttttctttttgattgggcaaagagtctatgtaagcccctggtccaatagacactgaaacagcagtcaaaacagagtgttcatgttcaaagagaagaatctgagatattttccagggccaagagaaggagaagtatgaaagacacccattgaatatatccagttgcctttcatgtcatgcatcctaagcacccacccattccacacaccctgaacataatctctgcagcttatattacattggatctggcacagacacagatgagactgtattctcccttcttaggagtcagtctgttttaagaaatctttgaaaaacctttgaaagccaagtacttgctggcccaactgatccactttgtgacatgaggcagaaactggggcctcctacaaggcatcaaactttgctttgacttctatggcaagtgaccaaatcccagaggcaggatccgaattgaggcttgagtctggccaaggagctgcgacaggttgtgatcc

SEQ ID NO: 16379 - DNA, 561 bp, Homo sapiens
  ENST00000524495
cgcagggccaagactctctaggaccagggactccaagggacagaaaagtgacgccaatgccccctttgcccagtggagcacagagcgtgtgtgtgcatggctggaggactttggcctggctcagtatgtgatctttgccaggcagtgggtatcttctggccacaccttattgacagccacccctcaggacatggaaaaggagctaggaattaagcacccactccacaggaagaagcttgttttagcagtgaaagccatcaacaccaaacaggaggagaagtctgcactgctagaccacatttgggtgacaaggtggcttgatgatattggcttaccccagtacaaagaccagtttcatgaatctagagttgacagacgaatgctgcaatacctaactgtgaacgatttactcttcttaaaagtcaccagccaactacatcatctcagcatcaaatgtgccattcacgtgctgcatgtcaacaagttcaacccccactgcctgcaccggcggccagctgatgagaagttgtacagtggtccaaccacagggtgatggagtgg

SEQ ID NO: 16380 - DNA, 568 bp, Homo sapiens
  ENST00000532112
acatgatctcaggagggccatacaggctgccccattctctaagtagcctgagatttgaaattcagatcttgtgttattaagaaaactctagggtctacctcctatgagtgtgttgtagtggaattttgttcagcagaatcccatgatggaggttgtttgttaaaaaacaggttttttgttttgttttttcttttcttttcttttgtttgtgagacatgattagattcagaacctcaggctctcccactaacaggaatatgctgttttcctgcttcccagtgacgccaatgccccctttgcccagtggagcacagagcgtgtgtgtgcatggctggaggactttggcctggctcagtatgtgatctttgccaggcagtgggtatcttctggccacaccttattgacagccacccctcaggacatggaaaaggagctaggaattaagcacccactccacaggaagaagcttgttttagcagtgaaagccatcaacaccaaacaggaggagaagtctgcactgctagaccacatttgggtgacaaggtggcttgatgatattggcttaccc

SEQ ID NO: 16381 - DNA, 308 bp, Homo sapiens
  ENST00000528929
gacgaatgctgcaatacctaactgtgaacgatttactcttcttaaaagtcaccagccaactacatcatctcagcatcaaatgtgccattcacgtgctgcatgtcaacaagttcaacccccactgcctgcaccggcggccagctgatgagagtaacctttctccttcagaagttgtacagtggtccaaccacagggtgatggagtggttacgatctgtggacctggcagagtatgcacccaatcttcgagggagtggagtccatggaggcctcattgtgagtggctctctggcctagcccacctgcctt

SEQ ID NO: 16382 - DNA, 1841 bp, Homo sapiens
  ENST00000529664
gggcagggttacttaccggggctgactccacagaggaccatggtgggacctattaagcctaacttcctcactctccttctccctctgacagagtaacctttctccttcagaagttgtacagtggtccaaccacagggtgatggagtggttacgatctgtggacctggcagagtatgcacccaatcttcgagggagtggagtccatggaggcctcattgtgagtggctctctggcctagcccacctgccttggtgcaaatgggatattcagaaacttatttattaaggacaaggcacaaaagctaacgaaaaaaaataggtacttcatctggaggtcttgcataatttgatgtctcaaagtattttgataacttgtccttgagaattaatatacctcatggaagcaagatgccttctggcagcacctccttggcatgagacttgaggattctaggtcgatgggttgcatggagaccaacgcttacaaggcgagggaacagcagggctgaggaagggacggggaagccgtaaaaatgcagcttcccacttgctgcaataggatccctatcactactcagatctgtcagtggcaaagccagaggggaaatgaggaagtgtggtggcttggatgtcatccagagaagatcctgagagacagcctcaccaaagaggtcccagttctctgctggtctgtgaaaacaaggtggtcagtcagcacatgtgctagtatgtgctcagagccaggccctgtgccagccagtgagtggagtgggactcagaacaagtgactgagctcctgtccctcctctggaggcacccccagccccaacaggccagtctctcagcatcctccccctcgagccatttgtatttgctcctggccaggcttgtctctggttccttcttagatcctggagccacgcttcactggggacaccctggctatgcttctcaacatccccccacaaaagacgctcctcaggcgccacctgaccaccaagttcaatgccttgattggtccggaggctgaacaggagaagcgagagaaaatggcctcaccagcttacacaccactgaccaccacagccaaagtccggccaaggaaactaggattttcacacttcggaaacataagaaaaaagaagttcgatgaatcgacggactacatttgcccaatggagcccagtgacggtgtcagtgatagtcacagggtctacagtggctaccggggcctcagcccccttgatgcccctgaactggatgggctggaccaggtgggacagattagctgatgcccttgtcacctgccctctgtgcaccctgagagctcacagtaacactgtgtgtgtcaccatataactgcacctcacccccgcacgtgtgcatgactcgcagagaatattccagcaattgtgtacccctgggccagtctctttgaaccctgagggtggccaggatctggagctgcatctctaaggggccaggctttggggaccattgccaaaggtggactcaggaggaaagacacttaaagacacttttacatgtctagtaattcttgatgttcatcttcagcaccagtggaaacacatgaacttcgatgcaggtccagagaccatggacactcccacgaggctcagctctcaggcaccccctacacttcagttgagggaaaagctcaagtgccttaggcccgtggaccacagtcttggctgagatcaaagggatgagcaacagggacttctgccacagtgacaatggaattgtgttgtgccttacttcagaggtggtctcttctttcttgtaataaaagcaatatttatgcggaaagcaagcagctca

SEQ ID NO: 16383 - DNA, 562 bp, Homo sapiens
  ENST00000534552
aaagacgctcctcaggcgccacctgaccaccaagttcaatgccttgattggtccggaggctgaacaggagaagcgagagaaaatggcctcaccagcttacacaccactgaccaccacagccaaagtccggccaaggaaactaggattttcacacttcggaaacataagaaaaaagaagttcgatgaatcgacggactacatttgcccaatggagcccagtgacggtgtcagtgatagtcacagggtctacagtggctaccggggcctcagcccccttgatgcccctgaactggatgggctggaccagcaccagtggaaacacatgaacttcgatgcaggtccagagaccatggacactcccacgaggctcagctctcaggcaccccctacacttcagttgagggaaaagctcaagtgccttaggcccgtggaccacagtcttggctgagatcaaagggatgagcaacagggacttctgccacagtgacaatggaattgtgttgtgccttacttcagaggtggtctcttctttcttgtaataaaagcaatatttatgcggaaa

SEQ ID NO: 16384 - DNA, 6542 bp, Homo sapiens
  ENST00000308249
agtgctgatcgctcgtgccggtgcggccgttaaccgcccttgccggagccctaggctcaaaagcagccccttacccttcctgggcttcccccaacccctttcccggtctgccctggggcatgagcagcgatggccggctgcatccctgaggagaaaacttaccggcgcttcctggagctattcctgggcgagtttcgcggaccgtgcggcggcggcgagccggagccggaacccgaacccgaacccgaacccgaacccgagtccgagcccgagcccgaacctgaactggtagaagctgaggcggccgaggcttcggtagaggaacccggggaggaggcggccacggtagccgcgacggaggagggggaccaggagcaagacccggagcccgaggaggaggcggcggttgagggtgaggaggaggaggagggcgcggcgacggcggcggcagccccggggcactcggccgtgccgccgccgccgccccagctgccgcctttgcccccgctcccgcgaccgctgtcagagcgcatcacccgcgaggaggtggagggcgaaagcctggacctgtgcctgcagcagctctacaaatataattgcccttcctttttggctgctgctttagccagagccacatcagatgaagtccttcagagtgatctttctgcacattatatcccaaaggaaacggatggcacagaagggactgtggagattgagacagtgaaattggcccgttctgtcttcagcaaactacacgagatttgctgcagctgggtgaaagacttccccctccgcaggagaccccagctttattatgagacatcaatccatgccatcaaaaacatgcgcaggaaaatggaggacaaacatgtctgcattcctgactttaatatgctcttcaacctagaggaccaggaagaacaagcttactttgcagtgtttgatggccatgggggagtagatgctgctatttatgcctccattcacctccacgttaacttagtccgccaggagatgttcccccatgatcctgctgaggccctgtgcagggccttccgggtcactgatgagcggtttgtgcagaaagcagccagggagagcttaagatgtgggaccacaggagtggtgactttcatcagaggcaacatgctacatgtggcctgggtgggtgattcccaggttatgcttgtgagaaagggccaagctgttgaactaatgaagccacacaaaccagacagagaggatgaaaagcagagaattgaggcccttggaggttgcgtagtctggtttggtgcctggagggtgaatggaagtctgtcggtttccagagctattggagatgctgaacataagccatatatctgtggggatgcagattctgcctccactgttctggatgggaccgaagactacctcattctggcctgtgatggcttctatgacaccgtgaaccctgatgaggcagtgaaagttgtgtccgaccacctgaaagagaataatggagacagcagcatggttgcccacaaattagtggcatcagctcgtgatgctgggtcaagtgataacatcacggttattgtggtattcctgagggacatgaacaaagctgtaaatgttagtgaggaatcagattggacagagaactcttttcaaggagggcaagaagatggtggggatgataaggagaatcatggagagtgcaaacgcccttggcctcagcaccagtgctcagcaccagccgacctaggctatgatgggcgtgtggattcattcactgatagaactagcctgagcccagggtcccaaatcaacgtgctggaagacccaggctacctagatctcacacaaatagaagcaagcaaacctcacagtgcccagtttttgctaccagttgagatgtttggtcctggtgcaccaaagaaagcaaatcttattaatgagttaatgatggagaaaaaatcagttcagtcatcattgcctgaatggagtggtgctggagagtttcccactgctttcaatttgggttcaacaggggagcagatatacagaatgcagagcttgtctcctgtctgttcagggttggaaaatgaacagttcaaatccccgggaaacagagtttctagattgtctcatttacgccaccactactcaaagaagtggcacagattcaggtttaatccaaagttttattcatttctctctgctcaagagccttcccacaaaataggcactagcctgtcctcacttactggaagtgggaagagaaataggataagaagttctctgccatggaggcaaaatagttggaaagggtacagtgaaaacatgaggaagctcagaaagactcatgatattccatgcccagatcttccttggagctataaaatagaataatttttctttcaagtaggttagctagctctcccccaataaaaataccactatcagagtagaaacaaggtagacatttctaaaacatatgtgcttcattatgaatccatggatggctcaattcttaaatgtaaatagatctctaggaaactcaaagtacagtgttttcaatctaaaaagaagtattggcagtttcacttgcaaaattacacagctggtccctgtgatgtgtctcgacaccaatacacaacccccttcccaccatccttcatgtcactagatacacaacccccttcccaccatcccttcagtcactagtggaagctttcaagttagttatttcagtcaggatatacagtgttgaaatctcaatgcagttgaaatctggtctgatgtgcctaatttatctgtggaaaatttaatgctgaattacatttggttgggaaatgtccctcaaaatcctgggcactatgaaggaaccccctgccccctcacctttttgggtaggtaaaagactaaaagccatatggattttaactgataacaatgaaagtggtaaatcagtgtaaaagtgtcatattctcagacttgtgaggcggtttatagtcagaaagatttacggatttttttcctgtaacataaaagattgtgaactttttttaattaaaaaatatttcctagggctgtagttatttgggagtttcataacctgttatggtgcttttggtggaaatttttattatttagcattttaggagaccgctgtcaactggttttaatctatgatgctaatgtgttttccactgtaccctcatctcaggaataaaactgctttaacggagatgatgtcaggtacaaatacactatagagtcaaaataccatttacaaagaaaatcaaaagcatttctatattttgtctttttttagttcagacagcaaaggcatgtactactataaaatacaaagtgattttagagaatgaaaaatgctacttttatcttctctaaaattatttcccccaaggtagtgaagtaattggaatgaaggaggctgaaagtattgtctaaagtgagcccagaggccactgagaatgcagattactgacagccaggtctgtttagttgtaattggaagacacatgagtgtcctgcttacatgtagcttcagactgcagagacaggacgtgtgcttttcatttcaatatttagttatatttgatattttgaaactgtctgctttttgctatttctgcagtttcaagttagttagaagcatgttgtcaactaaagacaacaaactatcagattcattcattcagtgaagcagcctctgattctctaagagtcacgaatgtcttagtgttaccctcccctagtcaacagcagaccagcctggccaatgcctatgggtggcccctctggagtgctcactaacaagggtgagtgctctcgctaagaagtgtcccccgcctaatcatgtgtttataggatagtacacgttccccaggcccataacagaggactaaaatctctgaattttaaagacacagatgactggcatattttggataccagtatagctatatcaaatagacaaaaacagcttcactttagcaatgatcagattgttaatctacagattttattttttaaaatttggatgtaagtagagactttcagtatttgttttctcttgattttgaagtcatttcttcttctcacgtctgtgacaaatggttgaaaaggagtcaacatggccccaactatagtgccggaaccttttcatcattctgaggctttgccccacacatggtcctcactcatatctgtcaccttctgaagcctagatcttgttaacccatcaggtgcagtgtcagtttcaaatcaaattatctaagaaaacaagaaaacaaaggcagcagactattggtacacattatagtccaaagtgcttagcgaagtaaaaaaaaaagctttttaaaatttctattgttgtctattggtaatgtttttgatcagaataaagagggtaaagggaaaaagttactacacatgctaggctttctcagtggggaaaaaaatggctggatagaactgggacaaacacagacccatctttaggggtctggattttgtaggtccgactacacagcagtgttaactcatttctcatgccattagctctctacaaaataaagcaaagtagttctagtgtggtcgttataaaccaatattgtgaaaaatagcaactattcatttgttcacaacatgcgtatttatagagtagttaggtaccatttgtaaggtaaatcctttaaaattctataatacatactaaaatagtggttattggtctgatatatgctgctcttggttctataaactagataaaagcagtgctttgtgaaatgcagtgttctctcttaacgccactggtgataggaagtagttcccttcagttcaaatcctgtgcccttatttgctgcttgctgacgtaagcaataagtaaccctctaactaatggtatctacatatttctgtaacttgtatttaatgatggtgtacctggtgattgtaaaaatattagacagatataaaagtatctatataatatctataaactgttaatgctgaggtatagtctgtgaattatgtgttttgtatttttattcattgtgtaatttagtggtggtgaaagttctacactcaatccttaaagagtggcagtatccctttttcaatttaacatggtctgcatcaatctgtttgcctgctaaacaagttagaataggaaatagtaaaataaatccaaacaagagtgtaatattggttagggaaacaaacttcaggtcaccaactgaagtcattacaaactccttgtacattcactgtgagtttcaaagggagtcagtccctaatttacaggtttcctttgttcactttctagatgtgtacttttgagggacatgaggttaggcaacattacagcaacacacactggggctattaatcccatttaggtctgtactaaagaggatgggtagaaacacatatgtatataccttttctttacctagaagtgccatccattgtccttgaattattatgattaaagttactgttgcatttaggaggctccttgaaagtaacaccttttccaaggacaatggcaacaatgtcaatgtcaacactgagtctaattttgaccacatttatagtggtatagtgtcaatactgcattttcatgacaaccacactccactgttgaaacactgtgccagtgagaagtgcaacatccagtgggcagatgaaaatgatgcatggccaagttcagtgtttacagataaaactgctgtggttcaagtgcttccttccccatcaaatccttgataaggctttgtgggaaaatgatctaaattattgttttaatttttaaacctaatttattcactcagtgaacattcttacctaagcaaggctataaaagggaatactacagttttgtccacactttaatttgagaccatttttctttgaatcgtaagttagcaaaagaaatttttttcacctttgaaaatcacgtgatgttaaaggacaaatgcccactcttctattctgatctgcaaatagcttaaatgtctcttgcaaaacaaagtaagataccaccagtattacaacacaatgattttccagacaaatggtatggtgttgaaaaataactgttacttcttaaagcagcattttatcttctattttgaagactatttattgtaataattagaaaacatgaaatagggaactccagactgacacagcagttgtttttgaaaaggaaataaactttgatgaattagataatccagatacatcattgtaaactcttactctaggtgctctttggtgagagacaggctttgttctcttgttcataacatttctctgcaaagaattctctatggagtgaagcgaatgaagtgaataatttcttaccaaataaatttatcaatttacaaatctgctctacatctcacttttgagttcagttgtagtcatgagtgatccttcatattttattaaaagtgttcattcaggtaaggtgtatgttgaaattttgccaattatcttaataaaacctggcaatttaaaaa

SEQ ID NO: 16385 - DNA, 6353 bp, Homo sapiens
  ENST00000228705
gctgcagctgcagccgcctgggcgctcctggagcgcgcggtgactcccccggtcggcccgctccatgcagctccgttgcggaagtgtagcggggggaggcggcggccaccgcggcactaagcacgagaggccggggctcggccccctgcagcactaggctctgggagccgcgcgcggcgcgtcccagtggcccgactcgccgtgcgcccggcgcccaccgcagcctgcatgccccgcgctgcgccttgcccggcccccgccgcctcctgctcgcaccgctgcagccgggcgccggagtaatatgctcactcgagtgaaatctgccgtggccaatttcatgggcggcatcatggctggcagctcaggctccgagcacggcggcggcagctgcggaggctcggacctgcccctgcgtttcccctacgggcggccagagttcctggggctgtctcaggacgaggtggagtgcagcgccgaccacatcgcccgccccatcctcatcctcaaggagactcggcggctgccctgggccactggctacgcagaggttatcaatgccgggaagagcacacacaatgaagaccaagccagctgtgaggtgctcactgtgaagaagaaggcaggggccgtgacctcaaccccaaacaggaactcatccaagagacggtcctcccttcccaatggggaagggctgcagctgaaggagaactcggaatccgagggtgtttcctgccactattggtcgctgtttgacgggcacgcggggtccggggccgcggtggtggcgtcacgcctgctgcagcaccacatcacggagcagctgcaggacatcgtggacatcctgaagaactccgccgtcctgccccctacctgcctgggggaggagcctgagaacacgcccgccaacagccggactctgacccgggcagcctccctgcgcggaggggtgggggccccgggctcccccagcacgccccccacacgcttctttaccgagaagaagattccccatgagtgcctggtcatcggagcgcttgaaagtgcattcaaggaaatggacctacagatagaacgagagaggagttcatataatatatctggtggctgcacggccctcattgtgatttgccttttggggaagctgtatgttgcaaatgctggggatagcagggccataatcatcagaaatggagaaattatccccatgtcttcagaatttacccccgagacggagcgccagcgacttcagtacctggcattcatgcagcctcacttgctgggaaatgagttcacacatttggagtttccaaggagagtacagagaaaggagcttggaaagaagatgctctacagggactttaatatgacaggctgggcatacaaaaccattgaggatgaggacttgaagttcccccttatatatggagaaggcaagaaggcccgggtaatggcaactattggagtgaccaggggacttggggaccatgacctgaaggtgcatgactccaacatctacattaaaccattcctgtcttcagctccagaggtaagaatctacgatctttcaaaatatgatcatggatcagatgatgtgctgatcttggccactgatggactctgggacgttttatcaaatgaagaagtagcagaagcaatcactcagtttcttcctaactgtgatccagatgatcctcacaggtacacactggcagctcaggacctggtgatgcgtgcccggggtgtgctgaaggacagaggatggcggatatctaatgaccgactgggctcaggagacgacatttctgtatatgtcattcctttaatacatggaaacaagctgtcatgaaaatggcccaggggattgggaggacagaggggaagaaagctgggatgcctcttggcaggacggaactgggaagtgccccagctgagttccaagtgatgcagtctcttcccagcccaagcggggagttcatggccaaaagactatgcttcaagatgaccctttggtttccatttcttctttagtaacaggtcaactcaacaagagcaaaacacaaaggctgctaccaagtgttgttgtatttcagttcctttcataggcctccgaggtggccattgactatttggggtatatatgtcatatttattttatctagagtagctggggcagccattttcaggtgtaaatggcagaggactcttcagcctgtcaagctgccagcttatctacgggttaaaaagtgctgcattggaaagtagggggtcatgcctcaaaatgtaagtaagtgcccaccttctaggaagcctgaggtttatttcagggattgccgtctgccccccgccccccttctctttttttcttctctgtttctattcttttatggcagtggtggagtgaggcagggatttttttttttttttttcgtgtttttgacattccttgaatctgttttttattccccttccacagaacaggcctgggactttccaacaccctgctaaggaagttctgtgtccaagtcccacccaggctgggttgtccccacctcctccagcccacacagcccaggcagcatccgggccagtgccctgcatgacagagggtctttgttgtgtaatgtttgttcccaagttgcattttctaaccgaatcagtgtgttttcatgaaactgagtgtttctgtggaccagtagttcctctgttgtcttcagtggtcttcctgtgtggctcaagggttctctgtgagagtctggattttcatttctggaatggctggccccatcccacttttctgtatcatggggacacatataaagcagtgtttaatagagcagtttaagaagttgcttgcatctgttggttcaccatggctcatctggggaccattttggattcatgtttcatggcttgtgactgtccccaagcccactccaaacaaagtgtaaggatcagagttctgtcaaggagcagcagttctgctctccccatcatctttgtgcaaggcccctcggggggcactttaataaaagaatttgaaatgggttgactggccattctcatgctgtgctccctgtctcttctcttctctaaagaatcatgtcccagctcctcaaggtccctctatggttccacatctgagtgttcgccacaagagcagcagcagcaggcacagtgcatgccatatctacctgctgcttctctgctgggaggaatggccaagtagattataaaactcacttctgtctcttaggcagacttgtacggccacaaaattacctagtcttcttcctgctgagctactgaggtattgccaccattttgacaactttgagtaattaaaacactcttctgacccaaaaaggaaaaaaggtcactgacgtgacccccccagcatgctagagagctaattccagttctcatatttgtttgaatttcttcccagaggagaggataggaacctctcctccagggcagtaaatcacctgcatttctggagttgtcggtattgtattcgaaaaggcctggagcccctcctgctcaggaaagaactcattccagggtgtggagacagtgccgtctggcaggtgaaatactgtgggaattcacgccaccaggtgtttgtgcaagtgttggcctgggaagaatgggacttcggccttgtcaggagttgtcttcatctgcagcacgtttcttcctcctgcagtagatcttagctaccccagatatctctatggagagaagtttgtggaaaatgctttgcttcgtggcagagtctgatgctgtaggaaaaccttcgggcatgtgacagcagtgtggtccactccctgttctgccctggcactcagagtcatgtgtaagtaggaaacctgagcaagtcttccgtggaggaccctgagctgccgtctttgggatccttcctgtgtccccaccgtctttcatttatttgctttcctgggcctctatctgggccctaccttgagcttctccagttttattcaagccaccagagtaagaatttgggtgtagatgtcacaactaccttctactcaattcaccaattcatttactgctatggcacgtctcaggaataactctagaaacctctaaatcgaaatattataaaatcttgagcacttagtcctgctggttttagttagaaaggcatccaggaattgttttcctacgcccccttgagtggaaagatcttagttagaagataaagtcaagtttgtgttcaggggatgggaggaagactataaataagatgaagaaatcaaaagtaggaaacatgatgtaaacgaagcatggcagatctgtccagcactgatattgctctataaattgagcttactcagttttggccttatttttttacccaggccccatgtcacccagtcctaaaacagtaaccgtgtctacataacgggttggcccctggtgcatccctggaaaagtcaaaggacgcacacttcgaaattctgcagaacgtatttatacatggttcagaaatcttgcgtatctgacttatagccaaatctgcttgctcgaatagcctcagaggaagtcttgtttaataaaaaccttttgatttcctagtcaagtctttatggttgtctcgaggggtgtgtggctactttaatgaaaggctttcctgctctaaatctctttgctgggctgggcctcttcagactatctggtgaaactcctttccttagaacaaactcagtccgtccatgctctgtggcattttgctagatgataaccaaagccttattcctgtagccagtgtcagcagtcagagaggtggagggtgtgttctgctgtggttatgcatacctatctgctgttcttgaggtgtaaaaggaaaggtgaaaatcgggccaggccaagtactcagctgtcttaataggatgaagccttaagcagtggaaatttcagttattttccacagtattccattttggaggatttggggtgtttactttttaaattcttgaacaacttaacctccatgaggctttgtgaagtcagctgtgaccaccctcctcttactgtgttctcagtattcattcacttccagggaagaatgacagccacagggagatggtggtgggcaagaatgagagtcccaggatccagatttagcctcagatcttccccattcaggaagggttttccatttaacaagagcactagtatgaaaacattagggacaaatctcccatgtctttgaaattcggattctcctcttgagatccccttcctcacctgccaatcaactttataaggccacaagtggtcactggttttccttccacaggtttgaggttctcagctttccttaagcgacccagcagctccgctgttttcagagtgaatatgttaagctttgatgagattctattttcagtaagttagtgcttctgggacacttggagaaagctgtgagagtcattgtctacgcaaagaacaacgaagctgatcctaaaagtgatccaatctaagaaaatggtaaaacgagctctggccacagcacagaattttatgtgaggaactcagatttttgaagacttaacaattgcagagaaaggttgcagcctgcacaccatagcccacctctctgagcagactttggttttgtgtggtgacgtggcacatgtttgtacactgggatttttcaaaggacgctacgcgagcagactgacttgcctcttctgtgagcactgtggcttttgtcagatggagtgccggtctgcagaggactgctctttcgaatccacagtgttatctgtgtaaatagctttaatttttcttctgtgtcttaggtgaagttttgttcatgtagcaaccaggtagacagtgaccaaataaggctgtaaatgtgctgtagttttctactgtgatgtacttgaaggagaacctgtgtcctctacttttctgatctcccacaagtattttgtgtttgtttcctgagtcctgaggttattattttactcctgttttgcccccagttttctttgttttttttctggagacccagggaggcccatggtggagatcatttgtaaggaatggatcatggtctgggtttccaaaactaccctagtacagtgaatgagagaaatctgcctggaaattgtttcagaaccatgtacctttatgctttgtgattgtgaaacattgacttttttgtaaccccaaaatgaaaactgtttagtaaaggggatctattttgtgtgttttgaaacttaggtgcaatgtcccctggaaaaagctaaagaaatgtatatgttcaatgacattttaaaataaaatattatatatatgtatatacgacatattcagcaaaa

SEQ ID NO: 16386 - DNA, 862 bp, Homo sapiens
  ENST00000551214
cctgcttgcagcatgtggcctctgagtagagaagttagtacgtgagcattgcgtctctcggattgctagatttgaattttgaatgtgacaatgagactgttgtttcaaagcaattccctaagtggctgtttgctcaagacttttgtagtgtgaacagagatttgggggagggggagaagccatctgctccagaatagtcttcgaatgacacgatcaaatgactgcagagcaaactggagggagtccaacagaaagttcctgtctgctgcatccagccccaaccagcactcaagccattgtgtttacatggaagctcacacacaggtttcaaaggcaaggccgtgataaccaaggatgcattcatgcagcctcacttgctgggaaatgagttcacacatttggagtttccaaggagagtacagagaaaggagcttggaaagaagatgctctacagggactttaatatgacaggctgggcatacaaaaccattgaggatgaggacttgaagttcccccttatatatggagaaggcaagaaggcccgggtaatggcaactattggagtgaccaggggacttggggaccatgacctgaaggtgcatgactccaacatctacattaaaccattcctgtcttcagctccagaggtaagaatctacgatctttcaaaatatgatcatggatcagatgatgtgctgatcttggccactgatggactctgggacgttttatcaaatgaagaagtagcagaagcaatcactcagtttcttcctaactgtgatccagatgatcctcacaggtacacactggcagctcaggacctggtgatgcgtgcccggggtgtgctgaaggacagaggatg

SEQ ID NO: 16387 - DNA, 584 bp, Homo sapiens
  ENST00000551519
aggtggtaggaaagcaagcactaaagatttttctagtcccttcttgaagcacattcagagtctggggactgtcaagagaatgaaagtgagaaagcttttgctacacatcctgcacaatccaacactaactctgttttattctccaggacctacagatagaacgagagaggagttcatataatatatctggtggctgcacggccctcattgtgatttgccttttggggaagctgtatgttgcaaatgctggggatagcagggccataatcatcagaaatggagaaattatccccatgtcttcagaatttacccccgagacggagcgccagcgacttcagtacctggcattcatgcagcctcacttgctgggaaatgagttcacacatttggagtttccaaggagagtacagagaaaggagcttggaaagaagatgctctacagggactttaatatgacaggctgggcatacaaaaccattgaggatgaggacttgaagttcccccttatatatggagaaggcaagaaggcccgggtaatggcaactattggagtgaccaggggacttggggaccatgacctgaag

SEQ ID NO: 16388 - DNA, 522 bp, Homo sapiens
  ENST00000548414
actgcgcctgggagcttgtgtccgattccgggaggtggccgtgtccgagtgcgtggttgtacatttccgaaggtctcagtttctctcactttcagcccgcgagttcctccgcttctcctttagcagggttatcaatgccgggaagagcacacacaatgaagaccaagccagctgtgaggtgctcactgtgaagaagaaggcaggggccgtgacctcaaccccaaacaggaactcatccaagagacggtcctcccttcccaatggggaagggctgcagctgaaggagaactcggaatccgagggtgtttcctgccactattggtcgctgtttgacgggcacgcggggtccggggccgcggtggtggcgtcacgcctgctgcagcaccacatcacggagcagctgcaggacatcgtggacatcctgaagaactccgccgtcctgccccctacctgcctgggggaggagcctgagaacacgcccgccaacagccggactctgacccgggcagcctccctgcgcgg

SEQ ID NO: 16389 - DNA, 468 bp, Homo sapiens
  ENST00000547857
atctatgaaccagaaagggggccctcactggacacaaaaacttgctgatatcttgaacttggatttctcagccttcaaaactggttatcaatgccgggaagagcacacacaatgaagaccaagccagctgtgaggtgctcactgtgaagaagaaggcaggggccgtgacctcaaccccaaacaggaactcatccaagagacggtcctcccttcccaatggggaagggctgcagctgaaggagaactcggaatccgagggtgtttcctgccactattggtcgctgtttgacgggcacgcggggtccggggccgcggtggtggcgtcacgcctgctgcagcaccacatcacggagcagctgcaggacatcgtggacatcctgaagaactccgccgtcctgccccctacctgcctgggggaggagcctgagaacacgcccgccaacagccggactctgacccgggcagcct

SEQ ID NO: 16390 - DNA, 1496 bp, Homo sapiens
  ENST00000471106
ggggcgctccgcctccgcgccccaaatccccggacctgcccaacgccgcctcggcgccgcccgccgccgctccagaagcgcccaggagccctcccgcgaaggctgggagcgggagcgcgacgcccgcgaaggctgttgaggctcgagcgagcttctccagaccgacctttctgcagctgagccccggggggctgcgacgcgccgatgaccacgcgggccgggctgtgcaaagccccccggacacgggccgccgcctgccctggagcacaggctacgccgaggtcatcaatgctggcaagagtcggcacaatgaggaccaggcttgctgtgaagtggtgtatgtggaaggtcggaggagtgttacaggagtacctagggagcctagccgaggccagggactctgcttctactactggggcctatttgatgggcatgcagggggcggagctgctgaaatggcctcacggctcctgcatcgccatatccgagagcagctaaaggacctggtagagatacttcaggacccttcgccaccacccctctgcctcccaaccactccggggaccccagattcctccgatccctctcacttgcttggccctcagtcctgctggtcttcacagaaggaagtgagccacgagagcctggtagtgggggccgttgagaatgccttccagctcatgcaggatgagcagatggcccgggagcggcgtggccaccaagtggaggggggctgctgtgcactggttgtgatctacctgctaggcaaggtgtacgtggccaatgcaggcgatagcagggccatcattgtccggaatggtgaaatcattccaatgtcccgggagtttaccccggagactgagcgccagcgtcttcagctgcttggtctgctgtagtcaacgtcatctgtgtgccaccgtgtgctgtgagcataatgccccctggctctctgttctgatcatccccaactccagggcttcctgaaaccagagctgctaggcagtgaattcacccaccttgagttcccccgcagagttctgcccaaggagctggggcagaggatgttgtaccgggaccagaacatgaccggctgggcctacaaaaagatcgagctggaggatctcaggtttcctctggtctgtggggagggcaaaaaggctcgggtgatggccaccattggggtgacccgaggcttgggagaccacagccttaaggtctgcagttccaccctgcccatcaagccctttctctcctgcttccctgaggtacgagtgtatgacctgacacaatatgagcactgcccagatgatgtgctagtcctgggaacagatggcctgtgggatgtcactactgactgtgaggtagctgccactgtggacagggtgctgtcggcctatgagcctaatgaccacagcagtggcaacttaactgaagaagggatgtccgctatatccaaaattacagctattggcaaataaacgagatggataaaggtg

SEQ ID NO: 16391 - DNA, 1863 bp, Homo sapiens
  ENST00000309276
gggccggttcctggggtggcccagagcaagggcaagtttcgcccgggacccgcccagctggccgggagccagtagcagggaagggccggctggcgcgagcaccgcccacgcggagccatgggggcggggcctgggcgggggcggggccgcggccgagggcggggcagggaggcagcatgctaaaccgggtgcgctcggccgtggcgcacctggtgagctccgggggcgctccgcctccgcgccccaaatccccggacctgcccaacgccgcctcggcgccgcccgccgccgctccagaagcgcccaggagccctcccgcgaaggctgggagcgggagcgcgacgcccgcgaaggctgttgaggctcgagcgagcttctccagaccgacctttctgcagctgagccccggggggctgcgacgcgccgatgaccacgcgggccgggctgtgcaaagccccccggacacgggccgccgcctgccctggagcacaggctacgccgaggtcatcaatgctggcaagagtcggcacaatgaggaccaggcttgctgtgaagtggtgtatgtggaaggtcggaggagtgttacaggagtacctagggagcctagccgaggccagggactctgcttctactactggggcctatttgatgggcatgcagggggcggagctgctgaaatggcctcacggctcctgcatcgccatatccgagagcagctaaaggacctggtagagatacttcaggacccttcgccaccacccctctgcctcccaaccactccggggaccccagattcctccgatccctctcacttgcttggccctcagtcctgctggtcttcacagaaggaagtgagccacgagagcctggtagtgggggccgttgagaatgccttccagctcatggatgagcagatggcccgggagcggcgtggccaccaagtggaggggggctgctgtgcactggttgtgatctacctgctaggcaaggtgtacgtggccaatgcaggcgatagcagggccatcattgtccggaatggtgaaatcattccaatgtcccgggagtttaccccggagactgagcgccagcgtcttcagctgcttggcttcctgaaaccagagctgctaggcagtgaattcacccaccttgagttcccccgcagagttctgcccaaggagctggggcagaggatgttgtaccgggaccagaacatgaccggctgggcctacaaaaagatcgagctggaggatctcaggtttcctctggtctgtggggagggcaaaaaggctcgggtgatggccaccattggggtgacccgaggcttgggagaccacagccttaaggtctgcagttccaccctgcccatcaagccctttctctcctgcttccctgaggtacgagtgtatgacctgacacaatatgagcactgcccagatgatgtgctagtcctgggaacagatggcctgtgggatgtcactactgactgtgaggtagctgccactgtggacagggtgctgtcggcctatgagcctaatgaccacagcaggtatacagctctggcccaagctctggtcctgggggcccggggtaccccccgagaccgtggctggcgtctccccaacaacaagctgggttccggggatgacatctctgtcttcgtcatccccctgggagggccaggcagttactcctgaggggctgaacaccatccctcccactagcctctccatacttactcctctcacagcccaaattctgaagttgtctccctgacccttctttagtggcaacttaactgaagaagggatgtccgctatatccaaaattacagctattggcaaataaacgagatggataaaggtg

SEQ ID NO: 16392 - DNA, 2474 bp, Homo sapiens
  ENST00000464951
gggtgcgctcggccgtggcgcacctggtgagctccgggggcgctccgcctccgcgccccaaatccccggacctgcccaacgccgcctcggcgccgcccgccgccgctccagaagcgcccaggagccctcccgcgaaggctgggagcgggagcgcgacgcccgcgaaggctgttgaggctcgagcgagcttctccagaccgacctttctgcagctgagccccggggggctgcgacgcgccgatgaccacgcgggccgggctgtgcaaagccccccggacacgggccgccgcctgccctggagcacaggctacgccgagtgagcgccccctggggcacccaaaccaggatggggctcccacccctctccccagctccgcatccccggcgctaggacgcgttccccacgccgcgtccgggccaggagctcccttttccgtggacctttgctatcctctggtcttcgggccgcaccccctcccaacccattttccagtggggggcagcctgtgtcaccttcttcacgtccttcccgctcattgactgccctcgcccacgccgcctcaggaccctgttctgccccagagcccggagggcggagagcccggcgaaggatgagttggccagttccccgtcgcggcccggcagcttaaaggctaagggaaaaggggtttcacgaaggagcggggttctttttaataggggacatagcggttgggaagactcgctcacccgcttcccggctccagcgccccagttccctgtccctcttaccgtagttcccctccccctccacacccagaaatagcccgcgacaccaggaggccgccagcttccccaggagcggggagggggacgcccggggtagaggagggtcccatttagatgcccttcagcctgccaactcgtgctggcctggcaaagaagcggaccccctgcccggagcggccggctggcccccgggctgtgtgtattttaaatgcatctgccgggaacgcagagcaccgagggagatgggggcgctcagttcgctgaggaaggtggctggtggcccatggacccaccaccacctcccttagcctcctgtgtgggaggagtttatgggtatgtggctcctgcccagtccaggtgggctttcacttctactctatttcagttcctctttcccgatctgggctggagagcttcctcattgttaaggcagcagaaactttcgctggatggttttaggataaggggtcatcaatgctggcaagagtcggcacaatgaggaccaggcttgctgtgaagtggtgtatgtggaaggtcggaggagtgttacaggagtacctagggagcctagccgaggccagggactctgcttctactactggggcctatttgatgggcatgcagggggcggagctgctgaaatggcctcacggctcctgcatcgccatatccgagagcagctaaaggacctgaaggaagtgagccacgagagcctggtagtgggggccgttgagaatgccttccagctcatggatgagcagatggcccgggagcggcgtggccaccaagtggaggggggctgctgtgcactggttgtgatctacctgctaggcaaggtgtacgtggccaatgcaggcgatagcagggccatcattgtccggaatggtgaaatcattccaatgtcccgggagtttaccccggagactgagcgccagcgtcttcagctgcttggcttcctgaaaccagagctgctaggcagtgaattcacccaccttgagttcccccgcagagttctgcccaaggagctggggcagaggatgttgtaccgggaccagaacatgaccggctgggcctacaaaaagatcgagctggaggatctcaggtttcctctggtctgtggggagggcaaaaaggctcgggtgatggccaccattggggtgacccgaggcttgggagaccacagccttaaggtctgcagttccaccctgcccatcaagccctttctctcctgcttccctgaggtacgagtgtatgacctgacacaatatgagcactgcccagatgatgtgctagtcctgggaacagatggcctgtgggatgtcactactgactgtgaggtagctgccactgtggacagggtgctgtcggcctatgagcctaatgaccacagcaggtatacagctctggcccaagctctggtcctgggggcccggggtaccccccgagaccgtggctggcgtctccccaacaacaagctgggttccggggatgacatctctgtcttcgtcatccccctgggagggccaggcagttactcctgaggggctgaacaccatccctcccactagcctctccatacttactcctctcacagcccaaattctgaagttgtctccctgacccttctttagtggcaacttaactgaagaagggatgtccgctatatccaaaattacagctattggcaaataaacgagatggataaa

SEQ ID NO: 16393 - DNA, 1001 bp, Homo sapiens
  ENST00000482367
gcatgctaaaccgggtgcgctcggccgtggcgcacctggtgagctccgggggcgctccgcctccgcgccccaaatccccggacctgcccaacgccgcctcggcgccgcccgccgccgctccagaagcgcccaggagccctcccgcgaaggctgggagcgggagcgcgacgcccgcgaaggctgttgaggctcgagcgagcttctccagaccgacctttctgcagctgagccccggggggctgcgacgcgccgatgaccacgcgggccgggctgtgcaaagccccccggacacgggccgccgcctgccctggagcacaggctacgccgagaccctgttctgccccagagcccggagggcggagagcccggcgaaggatgagttggccagttccccgtcgcggcccggcagcttaaaggctaagggtcatcaatgctggcaagagtcggcacaatgaggaccaggcttgctgtgaagtggtgtatgtggaaggtcggaggagtgttacaggagtacctagggagcctagccgaggccagggactctgcttctactactggggcctatttgatgggcatgcagggggcggagctgctgaaatggcctcacggctcctgcatcgccatatccgagagcagctaaaggacctggtagagatacttcaggacccttcgccaccacccctctgcctcccaaccactccggggaccccagattcctccgatccctctcacttgcttggccctcagtcctgctggtcttcacagaaggaagtgagccacgagagcctggtagtgggggccgttgagaatgccttccagctcatggatgagcagatggcccgggagcggcgtggccaccaagtggaggggggctgctgtgcactggttgtgatctacctgctaggcaaggtgtacgtggccaatgcaggcgatagcagggccatcattgtccggaatggtgaaatcattccaatgtcccgggagtttaccccggagactga

SEQ ID NO: 16394 - DNA, 847 bp, Homo sapiens
  ENST00000486709
cggccgagggcggggcagggaggcagcatgctaaaccgggtgcgctcggccgtggcgcacctggtgagctccgggggcgctccgcctccgcgccccaaatccccggacctgcccaacgccgcctcggcgccgcccgccgccgctccagaagcgcccaggagccctcccgcgaaggctgggagcgggagcgcgacgcccgcgaaggctgttgaggctcgagcgagcttctccagaccgacctttctgcagctgagccccggggggctgcgacgcgccgatgaccacgcgggccgggctgtgcaaagccccccggacacgggccgccgcctgccctggagcacaggctacgccgagaccctgttctgccccagagcccggagggcggagagcccggcgaaggatgagttggccagttccccgtcgcggcccggcagcttaaaggctaagggaaaaggggtttcacgaaggagcggggttctttttaataggggacatagcggttgggaagactcgctcacccgcttcccggctccagcgccccagttccctgtccctcttaccgtagttcccctccccctccacacccagaaatagcccgcgacaccaggaggccgccagcttccccaggagcggggagggggacgcccggggtagaggagggtcccatttagatgcccttcagcctgccaactcgtgctggcctggcaaagaagcggaccccctgcccggagcggccggctggcccccgggctgtgtgtattttaaatgcatctgccgggaacgcagagcaccgagggagatgggggcgctcagttcgctgaggaaggtggctggtggcccatggacc

SEQ ID NO: 16395 - DNA, 1640 bp, Homo sapiens
  ENST00000455350
ctacaggcacagggcgaggggtagaaccacatcgcttgactcttaagtgtgtttccaactgctcccacttcccgttttctttagagaaacccagaccaaacaaggaaagggaaataggccacggtagggtcattactattgctccttaagcttcctcgccggtccacctacccagacaaggcaaacggaaatctgcagcaggactcagcttggtgcacacaactccgccctcgccacacccactctgcagcgtctggcccggcaatacccatctgggcgcccctcctgcttcctctaggctgagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 16396 - DNA, 1731 bp, Homo sapiens
  ENST00000448378
ctttctttcagcgcctgcgcgctgtcacgttacggcggaactaatccagcgacgcctgcgctttgacgcatttggtgccgtggaagggaaaaagggggactgcagtatgcgtcacacccggaagcggcgagccggaagtggggttagccaggttatccccaggggtggagaagcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 16397 - DNA, 1689 bp, Homo sapiens
  ENST00000429382
ccggaagcggcgagccggaagtggggttagccaggttatccccaggggtggagaagcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgatgatttggggaggaagacggagaaacagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 16398 - DNA, 1536 bp, Homo sapiens
  ENST00000418211
ggattagaagagttgttggaggagctaggcctagggatatgggaggtgtggggttgaatatctagggctgggagaatcggaaggtattggagctatttggagtggcagagatggtgcaggaggatgatttggggaggaagacggagaaacagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 16399 - DNA, 1464 bp, Homo sapiens
  ENST00000444101
gggatatgggaggtgtggggttgaatatctagggctgggagaatcggaaggatgatttggggaggaagacggagaaacagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 16400 - DNA, 1723 bp, Homo sapiens
  ENST00000430959
ggaaaaaggaagggagatcaaagattaggtgctggggactgaaaaataattttcatgtattaatactaccaaggatgatttggggaggaagacggagaaacagcaaggattatattttcctttgaagagttgctgggacctttcctaggttaggaattgtgtcttctcttatactggtggtataagaacaggaaataatacttattcctcaagggactatctgaggtaaaagacctgttctgttttatcttctgtcagctcctctggtgctatgcctatggtactgattgagctaaagaagaaaagagaggaggttccctgggagggagtgggaaaggttagtaagaggggactagataggtatgctcatccttaaccttctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 16401 - DNA, 1640 bp, Homo sapiens; identical to SEQ ID NO: 16395
  ENST00000441553

SEQ ID NO: 16402 - DNA, 1731 bp, Homo sapiens; identical to SEQ ID NO: 16396
  ENST00000437937

SEQ ID NO: 16403 - DNA, 1689 bp, Homo sapiens; identical to SEQ ID NO: 16397
  ENST00000446310

SEQ ID NO: 16404 - DNA, 1536 bp, Homo sapiens; identical to SEQ ID NO: 16398
  ENST00000414618

SEQ ID NO: 16405 - DNA, 1464 bp, Homo sapiens; identical to SEQ ID NO: 16399
  ENST00000434591

SEQ ID NO: 16406 - DNA, 1723 bp, Homo sapiens; identical to SEQ ID NO: 16400
  ENST00000452227

SEQ ID NO: 16407 - DNA, 1640 bp, Homo sapiens; identical to SEQ ID NO: 16395
  ENST00000448550

SEQ ID NO: 16408 - DNA, 1614 bp, Homo sapiens
  ENST00000431424
ccggaagcggcgagccggaagtggggttagccaggttatccccaggggtggagaagcggaggcccaggaggagggggaataaagaaggtggaggatcctggctaccaatctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 16409 - DNA, 1689 bp, Homo sapiens
  ENST00000414032
ccggaagcggcgagccggaagtggggttagccaggttatccccaggggtggagaagcggaggcccaggaggagggggaataaagaaggtggaggatcctggctaccaatctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgatgatttggggaggaagacggagaaacagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 16410 - DNA, 1536 bp, Homo sapiens; identical to SEQ ID NO: 16398
  ENST00000439463

SEQ ID NO: 16411 - DNA, 1464 bp, Homo sapiens; identical to SEQ ID NO: 16399
  ENST00000451993

SEQ ID NO: 16412 - DNA, 1723 bp, Homo sapiens; identical to SEQ ID NO: 16400
  ENST00000450177

SEQ ID NO: 16413 - DNA, 1731 bp, Homo sapiens; identical to SEQ ID NO: 16396
  ENST00000436591

SEQ ID NO: 16414 - DNA, 1689 bp, Homo sapiens; identical to SEQ ID NO: 16397
  ENST00000448210

SEQ ID NO: 16415 - DNA, 1723 bp, Homo sapiens; identical to SEQ ID NO: 16400
  ENST00000422273

SEQ ID NO: 16416 - DNA, 1640 bp, Homo sapiens; identical to SEQ ID NO: 16395
  ENST00000430828

SEQ ID NO: 16417 - DNA, 1464 bp, Homo sapiens; identical to SEQ ID NO: 16399
  ENST00000412077

SEQ ID NO: 16418 - DNA, 1536 bp, Homo sapiens; identical to SEQ ID NO: 16398
  ENST00000444994

SEQ ID NO: 16419 - DNA, 1640 bp, Homo sapiens
  ENST00000376773
ctacaggcacagggcgaggggtagaaccacatcgcttgactcttaagtgtgtttccaactgctcccacttcccgttttctttagagaaacccagaccaaacaaggaaagggaaataggccacggtagggtcattactattgctccttaagcttcctcgccggtccacctacccagacaaggcaaacggaaatctgcagcaggactcagcttggtgcacacaactccgccctcgccacacccactctgcagcgtctggcccggcaatacccatctgggcgcccctcctgcttcctctaggctgagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatccggttttcattttccggtccttttgccatacacagttacagagatcagtcaaatccataccaccactgagatctcatttattgccacagatgcacaaaataaataacccaaaatcacaaaa

SEQ ID NO: 16420 - DNA, 1731 bp, Homo sapiens
  ENST00000376772
ctttctttcagcgcctgcgcgctgtcacgttacggcggaactaatccagcgacgcctgcgctttgacgcatttggtgccgtggaagggaaaaagggggactgcagtatgcgtcacacccggaagcggcgagccggaagtggggttagccaggttatccccaggggtggagaagcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatccggttttcattttccggtccttttgccatacacagttacagagatcagtcaaatccataccaccactgagatctcatttattgccacagatgcacaaaataaataacccaaaatcacaaaa

SEQ ID NO: 16421 - DNA, 1689 bp, Homo sapiens
  ENST00000376769
ccggaagcggcgagccggaagtggggttagccaggttatccccaggggtggagaagcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgatgatttggggaggaagacggagaaacagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatccggttttcattttccggtccttttgccatacacagttacagagatcagtcaaatccataccaccactgagatctcatttattgccacagatgcacaaaataaataacccaaaatcacaaaa

SEQ ID NO: 16422 - DNA, 1536 bp, Homo sapiens
  ENST00000376765
ggattagaagagttgttggaggagctaggcctagggatatgggaggtgtggggttgaatatctagggctgggagaatcggaaggtattggagctatttggagtggcagagatggtgcaggaggatgatttggggaggaagacggagaaacagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatccggttttcattttccggtccttttgccatacacagttacagagatcagtcaaatccataccaccactgagatctcatttattgccacagatgcacaaaataaataacccaaaatcacaaaa

SEQ ID NO: 16423 - DNA, 1464 bp, Homo sapiens
  ENST00000376763
gggatatgggaggtgtggggttgaatatctagggctgggagaatcggaaggatgatttggggaggaagacggagaaacagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatccggttttcattttccggtccttttgccatacacagttacagagatcagtcaaatccataccaccactgagatctcatttattgccacagatgcacaaaataaataacccaaaatcacaaaa

SEQ ID NO: 16424 - DNA, 1723 bp, Homo sapiens
  ENST00000376758
ggaaaaaggaagggagatcaaagattaggtgctggggactgaaaaataattttcatgtattaatactaccaaggatgatttggggaggaagacggagaaacagcaaggattatattttcctttgaagagttgctgggacctttcctaggttaggaattgtgtcttctcttatactggtggtataagaacaggaaataatacttattcctcaagggactatctgaggtaaaagacctgttctgttttatcttctgtcagctcctctggtgctatgcctatggtactgattgagctaaagaagaaaagagaggaggttccctgggagggagtgggaaaggttagtaagaggggactagataggtatgctcatccttaaccttctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatccggttttcattttccggtccttttgccatacacagttacagagatcagtcaaatccataccaccactgagatctcatttattgccacagatgcacaaaataaataacccaaaatcacaaaa

SEQ ID NO: 16425 - DNA, 1640 bp, Homo sapiens; identical to SEQ ID NO: 16395
  ENST00000433942

SEQ ID NO: 16426 - DNA, 1731 bp, Homo sapiens; identical to SEQ ID NO: 16396
  ENST00000452679

SEQ ID NO: 16427 - DNA, 1689 bp, Homo sapiens; identical to SEQ ID NO: 16397
  ENST00000417223

SEQ ID NO: 16428 - DNA, 1536 bp, Homo sapiens; identical to SEQ ID NO: 16398
  ENST00000436833

SEQ ID NO: 16429 - DNA, 1464 bp, Homo sapiens; identical to SEQ ID NO: 16399
  ENST00000428563

SEQ ID NO: 16430 - DNA, 1723 bp, Homo sapiens; identical to SEQ ID NO: 16400
  ENST00000449435

SEQ ID NO: 16431 - DNA, 1640 bp, Homo sapiens
  ENST00000400658
ctacaggcacagggcgaggggtagaaccacatcgcttgactcttaagtgtgtttccaactgctcccacttcccgttttctttagagaaacccagaccaaacaaggaaagggaaataggccacggtagggtcattactattgctccttaagcttcctcgccggtccacctacccagacaaggcaaacggaaatctgcagcaggactcagcttggtgcacacaactccgccctcgccacacccactctgcagcgtctggcccggcaatacccatctgggcgcccctcctgcttcctctaggctgagaaccggagccttaccatcaaacttcggaaacggaagccagagaaaaaggtagaatggacaagtgacactgtggacaatgaacacatgggccgccgctcatcaaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgttattctcacctcttatggaaaatggaacaagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactctttcctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 16432 - DNA, 1731 bp, Homo sapiens
  ENST00000383612
ctttctttcagcgcctgcgcgctgtcacgttacggcggaactaatccagcgacgcctgcgctttgacgcatttggtgccgtggaagggaaaaagggggactgcagtatgcgtcacacccggaagcggcgagccggaagtggggttagccaggttatccccaggggtggagaagcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgagaaccggagccttaccatcaaacttcggaaacggaagccagagaaaaaggtagaatggacaagtgacactgtggacaatgaacacatgggccgccgctcatcaaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgttattctcacctcttatggaaaatggaacaagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactctttcctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 16433 - DNA, 1689 bp, Homo sapiens
  ENST00000400657
ccggaagcggcgagccggaagtggggttagccaggttatccccaggggtggagaagcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgatgatttggggaggaagacggagaaaaagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatcaaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgttattctcacctcttatggaaaatggaacaagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactctttcctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 16434 - DNA, 1539 bp, Homo sapiens
  ENST00000400656
cagggattagaagagttgttggaggagctaggcctagggatatgggaggtgtggggttgaatatctagggctgggagaatcggaaggtattggagctatttggagtggcagagatggtgcaggaggatgatttggggaggaagacggagaaaaagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatcaaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgttattctcacctcttatggaaaatggaacaagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactctttcctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 16435 - DNA, 1464 bp, Homo sapiens
  ENST00000400655
gggatatgggaggtgtggggttgaatatctagggctgggagaatcggaaggatgatttggggaggaagacggagaaaaagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatcaaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgttattctcacctcttatggaaaatggaacaagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactctttcctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 16436 - DNA, 1723 bp, Homo sapiens
  ENST00000400654
ggaaaaaggaagggagatcaaagattaggtgctggggactgaaaaataattttcatgtattaatactaccaaggatgatttggggaggaagacggagaaaaagcaaggattatattttcctttgaagagttgctgggacctttcctaggttaggaattgtgtcttctcttatactggtggtataagaacaggaaataatacttattcctcaagggactatctgaggtaaaagacctgttctgttttatcttctgtcagctcctctggtgctatgcctatggtactggttgagctaaagaagaaaagagaggaggttccctgggagggagtgggaaaggttagtaagaggggactagataggtatgctcatccttaaccttctaggagaaccggagccttaccatcaaacttcggaaacggaagccagagaaaaaggtagaatggacaagtgacactgtggacaatgaacacatgggccgccgctcatcaaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgttattctcacctcttatggaaaatggaacaagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactctttcctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 16437 - DNA, 1640 bp, Homo sapiens
  ENST00000437171
ctacaggcacagggcgaggggtagaaccacatcgcttgactcttaagtgtgtttccaactgctcccacttcccgttttctttagagaaacccagaccaaacaaggaaagggaaataggccacggtagggtcattactattgctccttaagcttcctcgccggtccacctacccagacaaggcaaacggaaatctgcagcaggactcagcttggtgcacacaactccgccctcgccacacccactctgcagcgtctggcccggcaatacccatctgggcgcccctcctgcttcctctaggctgagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgctaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaaaccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 16438 - DNA, 1689 bp, Homo sapiens
  ENST00000449087
ccggaagcggcgagccggaagtggggttagccaggttatccccaggggtggagaagcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgatgatttggggaggaagacggagaaacagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgctaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaaaccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 16439 - DNA, 1607 bp, Homo sapiens
  ENST00000431977
cggcgagccggaagtggggttagccaggttatccccaggggtggagaagcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgctaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaaaccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 16440 - DNA, 1536 bp, Homo sapiens
  ENST00000433662
ggattagaagagttgttggagaagctaggcctagggatatgggaggtgtggggttgaatatctagggctgggagaatcggaaggtattggagctatttggagtggcagagatggtgcaggaggatgatttggggaggaagacggagaaacagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgctaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaaaccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 16441 - DNA, 1464 bp, Homo sapiens
  ENST00000458506
gggatatgggaggtgtggggttgaatatctagggctgggagaatcggaaggatgatttggggaggaagacggagaaacagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgctaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaaaccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 16442 - DNA, 1723 bp, Homo sapiens
  ENST00000455887
ggaaaaaggaagggagatcaaagattaggtgctggggactgaaaaataattttcatgtattaatactaccaaggatgatttggggaggaagacggagaaacagcaaggattatattttcctttgaagagttgctgggacctttcctaggttaggaattgtgtcttctcttatactggtggtataagaacaggaaataatacttattcctcaagggactatctgaggtaaaagacctgttctgttttatcttctgtcagctcctctggtgctatgcctatggtactgattgagctaaagaagaaaagagaggaggttccctgggagggagtgggaaaggttagtaagaggggactagataggtatgctcatccttaaccttctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgctaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaaaccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaa

SEQ ID NO: 16443 - DNA, 607 bp, Homo sapiens
  ENST00000587515
ctagagccaaggcgagagacccgtgccagccccgaggctcccggggcccatgggcccaggcatcgggctggtacagggccccggggctctctcagcccatctgtcacccctcccccccaacacccagatgtcccgtcttggcagtgctgtcccggactgccacattaatgctccagaacccgccagctgggccctggggccggtggggctcctgcagagccctggacaaaggcgagggagggagggaaggggatcctaagcacccctccctccctggccctaggaggcagacatgcccgatgagatcaacattgatgaattgttggagttagagagtgaagaggagagaagccggaaaatccagggactcctgaagtcatgtgggaaacctgtcgaggacttcatccaggagctgctggcaaagcttcaaggcctccacaggcagcccggcctccgccagccaagcccctcccacgacggcagcctcagccccctccaggaccgggcccggactgctcacccctgaccctcttgcactctccctgccccccggacgccgcccagcttgcttgtgtataagttgtatttaatggttctgtaacaataa

SEQ ID NO: 16444 - DNA, 433 bp, Homo sapiens
  ENST00000591291
acagcgcggggccaggctgggtccagcagcgcgatggcagctcagcggctgggcaagcgcgtgctgagcaagctgcagtctccatcgcgggcccgcgggccagggggcagtcccggggggctgcagaagcggcacgcgcgcgtcaccgtcaagtatgaccggcgggagctgcagcggcggctggacgtggagaagtggatcgacgggcgcctggaggagctgtaccgcggcatggaggcagacatgcccgatgagatcaacattgatgaattgttggagttagagagtgaagaggagagaagccggaaaatccagccccctccaggaccgggcccggactgctcacccctgaccctcttgcactctccctgccccccggacgccgcccagcttgcttgtgtataagttgtatttaatggttctgtaacaataa

SEQ ID NO: 16445 - DNA, 637 bp, Homo sapiens
  ENST00000347262
gcctcaagccgacgcagcggcctactctcgcactgcagacggggaaactgaggcctgaggcggccggggtggggcagacctcccggcgagcccgagcccccgcccccggctagccccgccctggcccgtaagaagcacccggggcgcgaggcgaaggcgcacagcgcggggccaggctgggtccagcagcgcgatggcagctcagcggctgggcaagcgcgtgctgagcaagctgcagtctccatcgcgggcccgcgggccagggggcagtcccggggggctgcagaagcggcacgcgcgcgtcaccgtcaagtatgaccggcgggagctgcagcggcggctggacgtggagaagtggatcgacgggcgcctggaggagctgtaccgcggcatgggactcctgaagtcatgtgggaaacctgtcgaggacttcatccaggagctgctggcaaagcttcaaggcctccacaggcagcccggcctccgccagccaagcccctcccacgacggcagcctcagccccctccaggaccgggcccggactgctcacccctgaccctcttgcactctccctgccccccggacgccgcccagcttgcttgtgtataagttgtatttaatggttctgtaacaataa

SEQ ID NO: 16446 - DNA, 777 bp, Homo sapiens
  ENST00000301242
gcagggacccgcccgggactctgggtccccgcccatacctcaacttcgcacgactgcgtgcctcaagccgacgcagcggcctactctcgcactgcagacggggaaactgaggcctgaggcggccggggtggggcagacctcccggcgagcccgagcccccgcccccggctagccccgccctggcccgtaagaagcacccggggcgcgaggcgaaggcgcacagcgcggggccaggctgggtccagcagcgcgatggcagctcagcggctgggcaagcgcgtgctgagcaagctgcagtctccatcgcgggcccgcgggccagggggcagtcccggggggctgcagaagcggcacgcgcgcgtcaccgtcaagtatgaccggcgggagctgcagcggcggctggacgtggagaagtggatcgacgggcgcctggaggagctgtaccgcggcatggaggcagacatgcccgatgagatcaacattgatgaattgttggagttagagagtgaagaggagagaagccggaaaatccagggactcctgaagtcatgtgggaaacctgtcgaggacttcatccaggagctgctggcaaagcttcaaggcctccacaggcagcccggcctccgccagccaagcccctcccacgacggcagcctcagccccctccaggaccgggcccggactgctcacccctgaccctcttgcactctccctgccccccggacgccgcccagcttgcttgtgtataagttgtatttaatggttctgtaacaataa

SEQ ID NO: 16447 - DNA, 949 bp, Homo sapiens
  ENST00000591585
gcctcaagccgacgcagcggcctactctcgcactgcagacggggaaactgaggcctgaggcggccggggtggggcagacctcccggcgagcccgagcccccgcccccggctagccccgccctggcccgtaagaagcacccggggcgcgaggcgaaggcgcacagcgcggggccaggctgggtccagcagcgcgatggcagctcagcggctgggcaagcgcgtgctgagcaagctgcagtctccatcgcgggcccgcgggccagggggcagtcccggggggctgcagaagcggcacgcgcgcgtcaccgtcaagtatgaccggcgggagctgcagcggcggctggacgtggagaagtggatcgacgggcgcctggaggagctgtaccgcggcatggaggcagacatgcccgatgagatcaacattgatgaattgttggagttagagagtgaagaggagagaagccggaaaatccagggactcctgaagtcatgtgggaaacctgtcgaggtgagttttctctccctcattctctccctgttctggccccaagtactctgatgggggagggggaagaagctggcagaagggtctctggggaacaccacccggccccaccacccccggccccaacctgccctccgcagctctttctggtctccaggggtgtcttttgtcctcctacttgtctctctccctctctcccccatctgctgagggggctccattctgtcctcccccatctgccctgtttttgcctctcctgtgcctgtcctttggccaccagccttcgggctcagtctccctctgtcctcccctgtcactgcctccgccaccccgggctcccttccccacctctgggggccctccatcctcccaggccctgaagctgagcggcccaacccctcccacttccttccctgctttaaaagggaaaactattcatgtttc

SEQ ID NO: 16448 - DNA, 2378 bp, Homo sapiens
  ENST00000200453
ataaaagcctagtggccattgtgttcgttgctcttatcggttcccatcccagttgttgatcttatgcaagacgctgcacgaccccgcgcccgcttgtcgccacggcacttgaggcagccggagatactctgagttactcggagcccgacgcctgagggtgagatgaacgcgctggcctccctaaccgtccggacctgtgatcgcttctggcagaccgaaccggcgctcctgcccccggggtgacgcgcagctcccagccgcccagacacatggccccaggccaagcaccccatcaggctaccccgtggagggatgcccaccctttcttcctcctgtccccagtgatgggcctcctcagccgcgcctggagccgcctgaggggcctgggacctctagagccctggctggtggaagcagtaaaaggagcagctctggtagaagctggcctggagggagaagctaggactcctctggcaatcccccataccccttggggcagacgccctgaagaggaggctgaagacagtggaggccctggagaggacagagaaacactggggctgaaaaccagcagttcccttcctgaagcctggggacttttggatgatgatgatggcatgtatggtgagcgagaggcaaccagtgtccctagagggcagggaagtcaatttgcagatggccagcgtgctcccctgtctcccagccttctgataaggacactgcaaggttctgataagaacccaggggaggagaaagccgaggaagagggagttgctgaagaggagggagttaacaagttctcttatccaccatcacaccgggagtgttgtccagccgtggaggaggaggacgatgaagaagctgtaaagaaagaagctcacagaacctctacttctgccttgtctccaggatccaagcccagcacttgggtgtcttgcccaggggaggaagagaatcaagccacggaggataaaagaacagaaagaagtaaaggagccaggaagacctccgtgtccccccgatcttcaggctccgaccccaggtcctgggagtatcgttcaggagaggcgtccgaggagaaggaggaaaaggcacacaaagaaactgggaaaggagaagctgccccagggccgcaatcctcagccccagcccagaggccccagctcaagtcctggtggtgccaacccagtgatgaagaggagggtgaggtcaaggctttgggggcagctgagaaggatggagaagctgagtgtcctccctgcatccccccaccaagtgccttcctgaaggcctgggtgtattggccaggagaggacacagaggaagaggaagatgaggaagaagatgaggacagtgactctggatcagatgaggaagagggagaagctgaggcttcctcttccactcctgctacaggtgtcttcttgaagtcctgggtctatcagccaggagaggacacagaggaggaggaagatgaggacagtgatacaggatcagccgaggatgaaagagaagctgagacttctgcttccacaccccctgcaagtgctttcttgaaggcctgggtgtatcggccaggagaggacacggaggaggaggaagatgaggatgtggatagtgaggataaggaagatgattcagaagcagccttgggagaagctgagtcagacccacatccctcccacccggaccagagggcccacttcaggggctggggatatcgacctggaaaagagacagaggaagaggaagctgctgaggactggggagaagctgagccctgccccttccgagtggccatctatgtacctggagagaagccaccgcctccctgggctcctcctaggctgcccctccgactgcaaaggcggctcaagcgcccagaaacccctactcatgatccggaccctgagactcccctaaaggccagaaaggtgcgcttctccgagaaggtcactgtccatttcctggctgtctgggcagggccggcccaggccgcccgccagggcccctgggagcagcttgctcgggatcgcagccgcttcgcacgccgcatcacccaggcccaggaggagctgagcccctgcctcacccctgctgcccgggccagagcctgggcacgcctcaggaacccacctttagcccccatccctgccctcacccagaccttgccttcctcctctgtcccttcgtccccagtccagaccacgcccttgagccaagctgtggccacaccttcccgctcgtctgctgctgcagcggctgccctggacctcagtgggaggcgtggctgagaccaactggtttgcctataatttattaactatttattttttctaagtgtgggtttatataaggaataaagccttttgatttgt

SEQ ID NO: 16449 - DNA, 1725 bp, Homo sapiens
  ENST00000600406
gtgactctggatcagatgaggaagagggagaagctgaggcttcctcttccactcctgctacaggtgtcttcttgaagtcctgggtctatcagccaggagaggacacagaggaggaggaagatgaggacagtgatacaggatcagccgaggatgaaagagaagctgagacttctgcttccacaccccctgcaagtgctttcttgaaggcctgggtgtatcggccaggagaggacacggaggaggaggaagatgaggatgtggatagtgaggataaggaagatgattcagaagcagccttgggagaagctgagtcagacccacatccctcccacccggaccagagggcccacttcaggggctggggatatcgacctggaaaagagacagaggaagaggaagctgctgaggactggggagaagctgagccctgccccttccgagtggccatctatgtacctggagagaagccaccgcctccctgggctcctcctaggctgcccctccgactgcaaaggcggctcaagcgcccagaaacccctactcatgatccggaccctgagactcccctaaaggccagaaaggtaggtgctgagagcccagattctattttttttttttttttaattgagttggagtcttgggctgtcacccaggctggagtgcagcggcatgatcttggctcactgccaacctctgccgcccaagttcaggcgattctcgtgcctcagcctccagagtatctgggattacaggcgcatgacaccacacccagctaattttttttgtatttttagtagagacgggggttttgccatgttggccaggctggtctcaaactcctgacatcacgtgatccacccatctcagcctcccaaagtgctgggattacaggcgtgagctaccacatctggctgagagcccagattcttgagtcttagaaagaaagggggctgggggccgagacttctgggtccctgtatgttgcagagggttgcatgtcatctccatggagaaggctgtgtacgctgtcacgcaatcccttgtaagaggccaggcccctgggggaggagggagcagctgtggctcacagcagccccaggaaaccacctcttccttcagtgagtcagatagatagagaatcccgtgacagtgacaggcaagtgactagccagatagaaagcatttttgtgtaataactaatttttgtttgcttctctctctctcttccccgccctccccatccggattcccgtggctgtgtgcatctcctgcctgtgtccccatgtctgcccgcaggtgcgcttctccgagaaggtcactgtccatttcctggctgtctgggcagggccggcccaggccgcccgccagggcccctgggagcagcttgctcgggatcgcagccgcttcgcacgccgcatcacccaggcccaggaggagctgagcccctgcctcacccctgctgcccgggccagagcctgggcacgcctcaggaacccacctttagcccccatccctgccctcacccagaccttgccttcctcctctgtcccttcgtccccagtccagaccacgcccttgagccaagctgtggccacaccttcccgctcgtctgctgctgcagcggctgccctggacctcagtgggaggcgtggctgagaccaactggtttgcctataatttattaactatttattttttctaagtgtgggtttatataaggaataa

SEQ ID NO: 16450 - DNA, 6251 bp, Homo sapiens
  ENST00000299824
ctctgtcgccgctggagcagctgcggctcggggacccacagacacagccggggtcgggagccgcccggggcagggctcgggagagcgggccacaccatgaggccccagccccaccagaggccccgcgctgccctggcccccggtgcaccgtgctagcccccagccagggcgttggggagggcggtggccatggccagtcacgtggacctgctgacggagctgcagctgctggagaaggtgcccacgctggagcggctgcgggctgcccagaagcgccgggcccagcagctgaagaaatgggcacagtacgagcaggacttgcagcaccgcaagcgaaagcatgagcggaagcgcagcacgggcggccgccgcaagaaagtgtccttcgaggccagcgtggccctgctggaggcctcgctgaggaacgacgccgaggaagtacgctacttcctgaagaataaggtcagccctgatttgtgcaatgaggacggactcacagccctacaccagtgctgcatcgacaactttgaggaaattgtgaagctgctcctctcccatggtgccaatgtgaacgccaaggacaacgagctgtggacacctctccatgctgcagccacctgcggccacatcaacctggtgaagatcctcgttcagtatggggccgacttgcttgctgtcaactcggatgggaacatgccatatgacctctgcgaggatgaacccaccctggatgtcatcgagacctgcatggcataccagggcatcacccaagagaaaatcaacgagatgcgggtggctcctgagcagcagatgattgcggacatccactgcatgatcgcagcgggccaggacctggactggatagatgcccagggtgccacactgctgcacatagctggagccaatggatacctgcgggcagctgagctcctcctggaccatggagtgcgtgtggatgtgaaggactgggatggctgggagcccctgcatgcagctgccttctggggacagatgcagatggcagagctattggtgtcccatggagctagtctcagtgcaaggacatccatggatgagatgccaatagacctgtgcgaggaggaagagttcaaggtcctgctgctggagctaaaacacaagcatgatgtgatcatgaagtcacagctgaggcacaagtcatccttgagccggaggacctccagcgcaggcagccgtgggaaggtggtgcggcgagccagcctgtcggacaggaccaacctgtataggaaggagtatgagggagaggccatcctgtggcagcggagtgcagctgaggatcagcggacctccacctacaacggggacatcagggagaccaggacagaccaagagaataaggaccctaaccccaggctggagaagcccgtgctactctccgaatttcctaccaagatcccacgaggtgaactggacatgcctgttgagaatggcctccgggctccggtcagtgcctaccagtatgcgctggccaacggggatgtctggaaggtgcatgaggtgcctgactacagcatggcctatggcaaccctggcgtggccgacgccaccccgccctggagcagctacaaggaacagagccctcagacgcttctggagctgaagcggcagcgggctgcagccaagctgctcagccaccccttccttagcacacacctgggcagcagcatggccaggacgggcgagagtagcagtgaaggcaaggcccccttgatcggaggcagaacttcaccgtacagcagcaatgggacctcggtatattacacggtcaccagcggagatcccccactcttaaagttcaaggcccccatagaggagatggaggagaaggtgcatggctgttgccgtatctcctagtctccgtgtgatggaggagggagatgcctggggaggggctcctggaatccaggccagcccaacagccctggctggggaggtgtcagggcagctggggagaggtgggctctgcttttcagaggaactcagaccccagccctcagctggctgcccatagcatcccatgtcccacgtcccgtggttctgcttcctgctgcatcgtctgccatctgacacaaggcctgtcgtggcctcctggttcactctgctgtctgatcttgggagggtgggcttgagatcccagctctattcttggtataaaggcttctccggatcagtacatgcatgtcacattaacacacacacacacacacatatacacacacacacaagctcgatcagtgtgtgtaggaatgacatacctgggctcaggggaagcaagggggcttagaatttgtggggtattcccaaaaggatggaagttaagactcagagtctcattaccactgccaatgtggttttagcaggggaggggacctgctaagctgagacccatagtcctgctcagagttatcccaaagtctgagccaccagccacacctgacaggggtgagaagtcctcgctgtgttcagagggagccaggaatctacatgggtagatgagatagacacagacctgctccccgcagccttgttgagagccacacttctgcccatgccaggagccagctgtgtgaccatccaggggtggagggggaaaaccaggcaatttcgttcctggaatcaaccaaatcatgttttcctcttggatggaagtgtcaaaggcagaagggtgtgggagggggacaaggtcagtatttaccaaagtgtatctgattttaaaaattcctttagtctgtaaaactcctagagggagggaggtaactgaattcacttctttttgtggatcgtatcaaggtcactgggttttactggctggtgctgggaaaatgaagctaagtgaggagcttccattggaatgcttttccagggagagaggccagttaatttaaaaaaaacagtcgctagttaacagcgacagagcccagcaccctggggtctttgtgaatatccagactgtttcagcccagcccatctcagccaaccctccttagactgagctgtcagagcaagcaattaggggccagcctgcctccacctcccacccccttccacctccatcagtcatgtgtgcagagtcagtgctcgggatcccgggcccagcttttgcctttttggggatgcttggtgagacagatttgccagtcagcccttttgagttcccgcctcacccaggggctcccagcctgcacttgcaggagtggtgatgccccaagtctgcgaatccagggtgcacgtggtcaatatcccctcctgcattcaggagagccatggtagggctagagttgggtcttgcccagccctgcagtttcatagtcccagccttcctggtgctggggagggaggactgtgaatggctgttctcccctcactgctgagtctcccaggaccccctttggagatgcccatggcatgggcactgcccacaggctcagccagaacctcttggtgtacccgataagctgcaggttatcccttgctctgtgcgccttttatttgtccttaaactacctccttagagctctgaaggggtctcctagttccagattttaatttggggaacagatctgggttctttttaaccctcttctttctcagtctatgagaaacttgccctgaggggcacctgggctaggggcttgggactggaagaccatccccgccttgtgccacaactttggtcatgggatctgctctttgtcattcttagccccctactgtggcccccatagccccataacccagagagggagctggacttcagggagcctgagtgatgctttcccaggagcagggcagctggctggaccagaaagtagagggcccatgggagtgactgcacccttggtggctgctggaaggggagaggttctcagcatcaggccacctccaccccaatgccaggatagatgtattctagagtaggggtggaggcggcccaggaggctgaagacaggtgcacagatgcttcccacgaccttgccatttggggtgggctcttcaacatctcaggctgtggctggaacaggacaggatgatctaaaacacacgtaccattggctgtaaaacagtatgagcccagactgacgctgaaatccctcatgagccaaccttagctacaaggtagggagttctgagggaagccgcgtgctcctcaggagagagctgtttaggttttccgatctttttgctcaggggccaaacactgaaggcacgtactgcccaacccactgagcgcctgaggccattccctccttttccgcatgcctcctgcctcctgggctattcctctccacccagaaggctgggaatcccagctgattccctgacaggagccgacttcacacacaggtgactctcaggcattggctcatgttttcagccagggataaaccatcccttcttggggctttaagtccctggggagctttccctgtaggtctcctgggtgttgagagacaagttggagaccaacctccaatgaatgagccgcggtcattcattaattcactcacgtaatttactgagtagctgcaacatgccagcctctacgttaggttctgcggataaaggaggaataagacagagtcaggagaactgttccttgtggtttccgtcccttggggaccacaggcatcagcagtcccattcaagtcacctgaggcaaagtgtctgcatcttcgtccagcgaccctttgcttttcggctcctagaatccttagagtctgaattcctttagctgggaacagctgtcatggtcacccctggataacatttgccaccaagtatagatgctggatcttgggttccaggcagacatcatccaggtccatctggaactttcagtgatagctgccttcagccagcatctttgggggactctataatagcagcttgagatcagtgtctagaagactgttctgcaatttgctgccaaatgcatctcaggtttttaaagtcattgtttcttgctcatggtggctcatttattacatagtcccctcaccccactaatggataatgggaggaaaagttgctgcttccttcagcatcaaagcctttccttgggaatctgcctccctccatggcaggggtggattcgggagctgggagtaaccaggcaaagtcaaccagatgcctagctcctgctgagacccaggtcctatggcagctcctcattagattaaaggagaccacttccaaagcaggtgctgcatggctcaccatcatatgccccaaacaactgaaagttggcggttatcaccagactgtgagtttctggcaagtagcttggggaagctgaataaactctaggcccagggctactaaagacttcaggatagaattctccatcaaatatacagcataagtaaaactgctctgcactgtttaatccatttccaaggggcttagaaaagctaacaagggtgtgtcccctgtcctgccccaccggtttgctggctttgtaataacataagaccattgtggttgttggtgtcagataccttcccatcctgagctctctcacctacctgctctctctcctagagcaggatactggggtacttttaagaagggtgctccttttaagatgcccagaaaagctgtatttaactcttgctatttgtaacttggggatggtctcccctgccccagggcacataagagcaaaggctccaatggtcagtggatgactctgcaaaagtgaccccctgtgccagaagctatagccctctccccaacaggtctctcttgttggccagagggcctgcttcccatgggcattgcaagtgccaccgtgcggggcctggctctgcacacccaggaaaagtctgcagacccccagccctccgcaataattcaccagaccagaagccactggtgtacagagaacacttaaaaaaatgtattttatgtgaaaaaaaattaaaactctgtatactgtatcagcagctttgtgtaaaaatggcaatcaagagagtctaatatatttaaaacttttttaaaaaaaatcttcgcagatctttgatatcgtactgaggtaacttccacgtagccccttgccacgcggcaccggtgggccttgggtccaaaactgtggctcagccacatcccaaagggggcacatgtccctggagttgcttccagctgccaaggcctgtgacagaattcgctgttaagagtttttaattaaaattattaaattccttttaataaca

SEQ ID NO: 16451 - DNA, 6106 bp, Homo sapiens
  ENST00000373331
gctgcggctcggggacccacagacacagccggggtcgggagccgcccggggcagggctcgggagagcgggccacaccatgaggccccagccccaccagaggccccgcgctgccctggcccccggtgcaccgtgctagcccccagccagggcgttggggagggcggtggccatggccagtcacgtggacctgctgacggagctgcagctgctggagaaggtgcccacgctggagcggctgcgggctgcccagaagcgccgggcccagcagctgaagaaatgggcacagtacgagcaggacttgcagcaccgcaagcgaaagcatgagcggaagcgcagcacgggcggccgccgcaagaaagtgtccttcgaggccagcgtggccctgctggaggcctcgctgaggaacgacgccgaggaagtacgctacttcctgaagaataaggtcagccctgatttgtgcaatgaggacggactcacagccctacaccagtgctgcatcgacaactttgaggaaattgtgaagctgctcctctcccatggtgccaatgtgaacgccaaggacaacgagctgtggacacctctccatgctgcagccacctgcggccacatcaacctggtgaagatcctcgttcagtatggggccgacttgcttgctgtcaactcggatgggaacatgccatatgacctctgcgaggatgaacccaccctggatgtcatcgagacctgcatggcataccagggcatcacccaagagaaaatcaacgagatgcgggtggctcctgagcagcagatgattgcggacatccactgcatgatcgcagcgggccaggacctggactggatagatgcccagggtgccacactgatgcagatggcagagctattggtgtcccatggagctagtctcagtgcaaggacatccatggatgagatgccaatagacctgtgcgaggaggaagagttcaaggtcctgctgctggagctaaaacacaagcatgatgtgatcatgaagtcacagctgaggcacaagtcatccttgagccggaggacctccagcgcaggcagccgtgggaaggtggtgcggcgagccagcctgtcggacaggaccaacctgtataggaaggagtatgagggagaggccatcctgtggcagcggagtgcagctgaggatcagcggacctccacctacaacggggacatcagggagaccaggacagaccaagagaataaggaccctaaccccaggctggagaagcccgtgctactctccgaatttcctaccaagatcccacgaggtgaactggacatgcctgttgagaatggcctccgggctccggtcagtgcctaccagtatgcgctggccaacggggatgtctggaaggtgcatgaggtgcctgactacagcatggcctatggcaaccctggcgtggccgacgccaccccgccctggagcagctacaaggaacagagccctcagacgcttctggagctgaagcggcagcgggctgcagccaagctgctcagccaccccttccttagcacacacctgggcagcagcatggccaggacgggcgagagtagcagtgaaggcaaggcccccttgatcggaggcagaacttcaccgtacagcagcaatgggacctcggtatattacacggtcaccagcggagatcccccactcttaaagttcaaggcccccatagaggagatggaggagaaggtgcatggctgttgccgtatctcctagtctccgtgtgatggaggagggagatgcctggggaggggctcctggaatccaggccagcccaacagccctggctggggaggtgtcagggcagctggggagaggtgggctctgcttttcagaggaactcagaccccagccctcagctggctgcccatagcatcccatgtcccacgtcccgtggttctgcttcctgctgcatcgtctgccatctgacacaaggcctgtcgtggcctcctggttcactctgctgtctgatcttgggagggtgggcttgagatcccagctctattcttggtataaaggcttctccggatcagtacatgcatgtcacattaacacacacacacacacacatatacacacacacacaagctcgatcagtgtgtgtaggaatgacatacctgggctcaggggaagcaagggggcttagaatttgtggggtattcccaaaaggatggaagttaagactcagagtctcattaccactgccaatgtggttttagcaggggaggggacctgctaagctgagacccatagtcctgctcagagttatcccaaagtctgagccaccagccacacctgacaggggtgagaagtcctcgctgtgttcagagggagccaggaatctacatgggtagatgagatagacacagacctgctccccgcagccttgttgagagccacacttctgcccatgccaggagccagctgtgtgaccatccaggggtggagggggaaaaccaggcaatttcgttcctggaatcaaccaaatcatgttttcctcttggatggaagtgtcaaaggcagaagggtgtgggagggggacaaggtcagtatttaccaaagtgtatctgattttaaaaattcctttagtctgtaaaactcctagagggagggaggtaactgaattcacttctttttgtggatcgtatcaaggtcactgggttttactggctggtgctgggaaaatgaagctaagtgaggagcttccattggaatgcttttccagggagagaggccagttaatttaaaaaaaacagtcgctagttaacagcgacagagcccagcaccctggggtctttgtgaatatccagactgtttcagcccagcccatctcagccaaccctccttagactgagctgtcagagcaagcaattaggggccagcctgcctccacctcccacccccttccacctccatcagtcatgtgtgcagagtcagtgctcgggatcccgggcccagcttttgcctttttggggatgcttggtgagacagatttgccagtcagcccttttgagttcccgcctcacccaggggctcccagcctgcacttgcaggagtggtgatgccccaagtctgcgaatccagggtgcacgtggtcaatatcccctcctgcattcaggagagccatggtagggctagagttgggtcttgcccagccctgcagtttcatagtcccagccttcctggtgctggggagggaggactgtgaatggctgttctcccctcactgctgagtctcccaggaccccctttggagatgcccatggcatgggcactgcccacaggctcagccagaacctcttggtgtacccgataagctgcaggttatcccttgctctgtgcgccttttatttgtccttaaactacctccttagagctctgaaggggtctcctagttccagattttaatttggggaacagatctgggttctttttaaccctcttctttctcagtctatgagaaacttgccctgaggggcacctgggctaggggcttgggactggaagaccatccccgccttgtgccacaactttggtcatgggatctgctctttgtcattcttagccccctactgtggcccccatagccccataacccagagagggagctggacttcagggagcctgagtgatgctttcccaggagcagggcagctggctggaccagaaagtagagggcccatgggagtgactgcacccttggtggctgctggaaggggagaggttctcagcatcaggccacctccaccccaatgccaggatagatgtattctagagtaggggtggaggcggcccaggaggctgaagacaggtgcacagatgcttcccacgaccttgccatttggggtgggctcttcaacatctcaggctgtggctggaacaggacaggatgatctaaaacacacgtaccattggctgtaaaacagtatgagcccagactgacgctgaaatccctcatgagccaaccttagctacaaggtagggagttctgagggaagccgcgtgctcctcaggagagagctgtttaggttttccgatctttttgctcaggggccaaacactgaaggcacgtactgcccaacccactgagcgcctgaggccattccctccttttccgcatgcctcctgcctcctgggctattcctctccacccagaaggctgggaatcccagctgattccctgacaggagccgacttcacacacaggtgactctcaggcattggctcatgttttcagccagggataaaccatcccttcttggggctttaagtccctggggagctttccctgtaggtctcctgggtgttgagagacaagttggagaccaacctccaatgaatgagccgcggtcattcattaattcactcacgtaatttactgagtagctgcaacatgccagcctctacgttaggttctgcggataaaggaggaataagacagagtcaggagaactgttccttgtggtttccgtcccttggggaccacaggcatcagcagtcccattcaagtcacctgaggcaaagtgtctgcatcttcgtccagcgaccctttgcttttcggctcctagaatccttagagtctgaattcctttagctgggaacagctgtcatggtcacccctggataacatttgccaccaagtatagatgctggatcttgggttccaggcagacatcatccaggtccatctggaactttcagtgatagctgccttcagccagcatctttgggggactctataatagcagcttgagatcagtgtctagaagactgttctgcaatttgctgccaaatgcatctcaggtttttaaagtcattgtttcttgctcatggtggctcatttattacatagtcccctcaccccactaatggataatgggaggaaaagttgctgcttccttcagcatcaaagcctttccttgggaatctgcctccctccatggcaggggtggattcgggagctgggagtaaccaggcaaagtcaaccagatgcctagctcctgctgagacccaggtcctatggcagctcctcattagattaaaggagaccacttccaaagcaggtgctgcatggctcaccatcatatgccccaaacaactgaaagttggcggttatcaccagactgtgagtttctggcaagtagcttggggaagctgaataaactctaggcccagggctactaaagacttcaggatagaattctccatcaaatatacagcataagtaaaactgctctgcactgtttaatccatttccaaggggcttagaaaagctaacaagggtgtgtcccctgtcctgccccaccggtttgctggctttgtaataacataagaccattgtggttgttggtgtcagataccttcccatcctgagctctctcacctacctgctctctctcctagagcaggatactggggtacttttaagaagggtgctccttttaagatgcccagaaaagctgtatttaactcttgctatttgtaacttggggatggtctcccctgccccagggcacataagagcaaaggctccaatggtcagtggatgactctgcaaaagtgaccccctgtgccagaagctatagccctctccccaacaggtctctcttgttggccagagggcctgcttcccatgggcattgcaagtgccaccgtgcggggcctggctctgcacacccaggaaaagtctgcagacccccagccctccgcaataattcaccagaccagaagccactggtgtacagagaacacttaaaaaaatgtattttatgtgaaaaaaaattaaaactctgtatactgtatcagcagctttgtgtaaaaatggcaatcaagagagtctaatatatttaaaacttttttaaaaaaaatcttcgcagatctttgatatcgtactgaggtaacttccacgtagccccttgccacgcggcaccggtgggccttgggtccaaaactgtggctcagccacatcccaaagggggcacatgtccctggagttgcttccagctgccaaggcctgtgacagaattcgctgttaagagtttttaattaaaattattaaattccttttaataaca

SEQ ID NO: 16452 - DNA, 299 bp, Homo sapiens
  ENST00000468265
tgtccttcgaggccagcgtggccctgctggaggcctcgctgaggaacgacgccgaggaaggaatgaatggagaatccatgatgtaaccacagcccccttccctgggcttgttcagaggcggtctcgcctgctcattgtgagccaagtacgctacttcctgaagaataaggtcagccctgatttgtgcaatgaggacggactcacagccctacaccagtgctgcatcgacaactttgaggaaattgtgaagctgctcctctcccatggtgccaatgtgaacgccaaggacaacgagctgt

SEQ ID NO: 16453 - DNA, 268 bp, Homo sapiens
  ENST00000463749
gaaacgagccaagaggcatccctggaaccactctgctgggagctgctccgctgaaagcctgggtacgctacttcctgaagaataaggtcagccctgatttgtgcaatgaggacggactcacagccctacaccagtgctgcatcgacaactttgaggaaattgtgaagctgctcctctcccatggtgccaatgtgaacgccaaggacaacgagctgtggacacctctccatgctgcagccacctgcggccacatcaacctggtgaagat

SEQ ID NO: 16454 - DNA, 2268 bp, Homo sapiens
  ENST00000342032
gtaagtagatatgtgtgaagtctctagaagagtgtctggcattttggtagccttacataaatgttagcagtagctacccttctcttcctcctcatgatagtactttgagaagcagcaatagtgattgaaagtactctggatttaaacttaaatagctttgagagtcgaaattagctgtggcctctcttgggcatatcacttaacttcttgtgcctcagtttccatatttacaaaatcaggccaaaaaaaatctatcgcatgggaattcaatgatgtagctggtttgtctgaatttctctggtgtgcacaccggaaactcaaagcacgactctatactgtacttttgtaatgtacaatgattgccgtggagagcagcgatggagatgttagtcctctttccttctccatcccccttgccctggtgcctgtgaaacagagcatccccatggcaacagcagcagctggtccctagataagaggagctggagccggccagcagcagccactgccgcagaggagccaggcccagcctcggtgagcacacacgccctccctgtctctcgccttcgcttccctgcatctgcgctgattgtgctggagaagaaatacatccacccaccctcctttgatgatgtccactgagcaaatgcagccactggaactctcagaagacagactggacaagctagaccctcgttgcagccacttagatgatctttcagaccagttcattaaggactgtgatctcaaaaagaagcctagaaagggaaaaaatgtacaggccaccctgaatgttgagtcagaccaaaaaaaaccaaggaggaaagatacaccggcgctgcacatcccacctttcataccaggtgtgttttcagaacatttaattaaaagatacgatgttcaagagagacatccaaagggcaaaatgatccctgttcttcataacactgacctggaacagaaaaagccaaggagaaaagacacacctgccctgcacatgtccccctttgcagcaggtgtgacattgctcagggacgagagacccaaagcaatcgtggaagatgacgaaaaggatggtgacaagatagctatttaaagatagttcccctgagaccacttgtaaataggttagattggttccctgtggtgacctagagaaaaaatagacttgtttctgctctcatttttgtcatcgtctgacttgaagattcagacaccttctccccaggagatgtatgccatcaaattgccagtcacctctttgtctctctcttctttctgagtatggtttctattctgtgttttgaatttttattttctaatgcagtggaaaagaaacagatcatcctaaatgaggaggtaacagggaaagcactggggttcggtttctgcatcttctggatcaattcacggaacagagatcgtggattacatgggctccttcttggtttttgctgctgggcaggacttgacttagcattatccaagcaccagtccaagtggggttccctgttgccagttagagaggtgagaatgtttggactctaactcaccgattgctttgcagacaaaggtcttttatttctcctgtcctatcttaagagtccaaatgtctctggtgatgttcctaagacccttgtcccagatactctaaatgtgaatgtatgagctgggggagtcaacccagcccaccatgccttggctgatgataccagaggcagagagtgctggtctgtctgggaagcttagcaatgtatcttcaaatttatttttgtttttaaaaatatttcttaaacatgctgtcccaacatttgtgagttgtgtcacaagtgagtcattatcaatggtagataaaatatcaatgtttgtgatgaatttactgtaaaaaaattaaggtcaatgaaagccattctgttatttttagcattctcacttatttagactctattacactttcttggatgagaggggagagtgtggtgttagctagtgagcagaggtctgtatattgtccttgccccagcctgcaatctgtggatgcccaggggaaggcatacaggcctcatccaccaggcaatagacaggagagaggtgagaactatttttagaaggaggaaaagtagatacgcaaattgtcacaactaagagtgataatttggtagctctgtatgtatgctggttccaactgtttaatcccttctgtctttctgttctcacaaagatggaaaagatacaagagcttgccggaaataaagctacatctatcca

SEQ ID NO: 16455 - DNA, 569 bp, Homo sapiens
  ENST00000409146
agccactgccgcagaggagccaggcccagcctcggtgagcacacacgccctccctgtctctcgccttcgcttccctgcatctgcgctgattgtgctggagaagaaatacatccacccaccctcctttgatgatgtccactgagcaaatgcagccactggaactctcagaagacagactggacaagctagaccctcgttgcagccacttaggtgtgttttcagaacatttaattaaaagatacgatgttcaagagagacatccaaagggcaaaatgatccctgttcttcataacactgacctggaacagaaaaagccaaggagaaaagacacacctgccctgcacatgtccccctttgcagcaggtgtgacattgctcagggacgagagacccaaagcaatcgtggaagatgacgaaaaggatggtgacaagatagctatttaaagatagttcccctgagaccacttgtaaataggttagattggttccctgtggtgacctagagaaaaaatagacttgtttctgctctcatttttgtcatcgtctgacttgaagattcagacaccttct

SEQ ID NO: 16456 - DNA, 568 bp, Homo sapiens
  ENST00000498609
agtcacgatgagtaccaaggtccagcaggcatgggaggtagacagagtggaggactgacagggagatttacgtgaaccaggccttcttcagtcacgaggcctcaccagacaatgaggtgtgttttcagaacatttaattaaaagatacgatgttcaagagagacatccaaagggcaaaatgatccctgttcttcataacactgacctggaacagaaaaagccaaggagaaaagacacacctgccctgcacatgtccccctttgcagcaggtgtgacattgctcagggacgagagacccaaagcaatcgtggaagatgacgaaaaggatggtgacaagatagctatttaaagatagttcccctgagaccacttgtaaataggttagattggttccctgtggtgacctagagaaaaaatagacttgtttctgctctcatttttgtcatcgtctgacttgaagattcagacaccttctccccaggagattggaaaagaaacagatcatcctaaatgaggaggtaacagggaaagcactggggttcggtttctgcatcttctggatcaattc

SEQ ID NO: 16457 - DNA, 851 bp, Homo sapiens
  ENST00000495820
actacccgctaaccgcctcccgccacacacacacacacacacacacacacacacaccccgcgcgcgcgcacacacacacaccccaccccaccaccccgacctccacatacattcccccgaccccctccagcagtgaagtctaagagcaccgcgaagtaatttaaattttcgagggaaagcacagcgccatctgtcggacatcatgccaattactcttgttaagttcctacctgacggttactttatactttgaactgctaggtactccttttggcctaaggacacagtgaaaaatgtaccgagaccttggagagccacgaaccaagaaacttcagaaacctctgatatctgatcaagagttaagagacgtcagaatcatcacaactgacaaaagaatgttttctctcttcaagattctcttttgaaagacatctaaaaagaaatagatgacaagagggggcccaacacacaaggggaattacagaatgcatcccctaagcaaaggaagcagagtgtgtacacaccacccaccataaaaggggttaagcatctgaaaggccagaatgaatcagcattccctgaagaagaagaaggcaccaatgaaagagaggagcagcgggaccattaattactggtctgcagcaagaaggcttcttggaaataactgaactattaacttttctgagtataccatggaattccactgcttgacttccagaagcatcctccatctctgcaccccacactcatacagtagctatgcacatcctggaagtctccttgactgaactttagaactaagtacacattgttccacatcacttataattaaagaataagcatttatttta

SEQ ID NO: 16458 - DNA, 722 bp, Homo sapiens
  ENST00000486067
gaactgctaggtactccttttggcctaaggacacagtgaaaaatgtaccgagaccttggagagccacgaaccaagaaacttcagaaacctctgatatctgatcaagagttaagagacgtcagaatcatcacaactgacaaaaggtgctcccggattttgctctccagcttccggttcttggtctccaggctcctcactctgtccagaatgttttctctcttcaagattctcttttgaaagacatctaaaaagatcaggaaaagaagacctacaccagcatcacttgtgattctcaatgagcataaccccccagaaatagatgacaagagggggcccaacacacaaggggaattacagaatgcatcccctaagcaaaggaagcagagtgtgtacacaccacccaccataaaaggggttaagcatctgaaaggccagaatgaatcagcattccctgaagaagaagaaggcaccaatgaaagagaggagcagcgggaccattaattactggtctgcagcaagaaggcttcttggaaataactgaactattaacttttctgagtataccatggaattccactgcttgacttccagaagcatcctccatctctgcaccccacactcatacagtagctatgcacatcctggaagtctccttgactgaactttagaactaagtacacattgttccacatcacttataattaaagaataagcatttattt

SEQ ID NO: 16459 - DNA, 1477 bp, Homo sapiens
  ENST00000475249
tgctaggtactccttttggcctaaggacacagtgaaaaatgtaccgagaccttggagagccacgaaccaagaaacttcagaaacctctgatatctgatcaagagttaagagacgtcagaatcatcacaactgacaaaagaatgttttctctcttcaagattctcttttgaaagacatctaaaaagaaatagatgacaagagggggcccaacacacaaggggaattacagaatgcatcccctaagcaaaggaagcagagtgtgtacacaccacccaccataaaaggtgcaaaatgagttgataacaaccagaagttgacttgttagtgctgtgcttctactcgagcttggaaaaatcccaacacaaaacaaacaccacctccgattccatcatgatgccacgttgctttctactggattacctcctgaagcactttagatattttatacataagtattgacatgtttttcagaagctgtttcttcacttattgcttttttctaataatttttattacaccatttgccaagtccttccctttggttttagtttattcctctctacaactaaaaaagggatcttgagtttaggtacattttaagtgattcatttttagtttttctaattctggaatctgagccttctcttacaacagggagtctttcaaaaacatttttttgtttctttttcaaattccactgtgtttatttattgccttgtttctttttcaaattccattggtcttgatttaatttagttccacagattttactgatagtctactacctgccaactactgaattatgcagcagacttataaaaataaaaaggctattttattgttattgccatcctgctagtaaagatttattcaattatttataattaattaagtggcttcacctatatttctgttaataatcacattaattatgtatgacaggtaggatttatgttatagataagaaaactagagtccaaagaaaataagtgtccccaaatgaaccaataatccaacaaacgcttccactaactagcttctgacctgtttgagttgtgatagattttagaataaaaaagcctatcctccttaggagccatagacttttattctttcttatactgtcttatatattgacttagagctaaacttcctccaattcagacataaagcataggcagatacttttgctaatgaggctaagctgggaagaaaaccctgagttctactttaattcttgggcattgacttcaaactaagatgacttataagaaataaaagaagtaaatttgaaactttaataaaaaaagtacatggttcatttaaaaatgtttcctatgtctaaatctatattttaaaaataacctttatcatgtaaaatgagagaattgctgagtttatgacaatcttaggtataaccttttcttaaagaacaaggcatcaatctttaatttgtttccctttcttgatttctcat

SEQ ID NO: 16460 - DNA, 411 bp, Homo sapiens
  ENST00000464264
acagtgaaaaatgtaccgagaccttggagagccacgaaccaagaaacttcagaaacctctgatatctgatcaagagttaagagacgtcagaatcatcacaactgacaaaagaatgttttctctcttcaagattctcttttgaaagacatctaaaaagatcaggaaaagaagacctacaccagcatcacttgtgattctcaatgagcataaccccccagaaatagatgacaagagggggcccaacacacaaggggaattacagaatgcatcccctaagcaaaggaagcagagtgtgtacacaccacccaccataaaaggtgcaaaatgagttgataacaaccagaagttgacttgttagtgctgtgcttctactcgagcttggaaaaatcccaacacaaaacaaacaccacc

SEQ ID NO: 16461 - DNA, 791 bp, Homo sapiens
  ENST00000490645
aaaatgtaccgagaccttggagagccacgaaccaagaaacttcagaaacctctgatatctgatcaagagttaagagacgtcagaatcatcacaactgacaaaaggtgctcccggattttgctctccagcttccggttcttggtctccaggctcctcactctgtccagaatgttttctctcttcaagattctcttttgaaagacatctaaaaagaaatagatgacaagagggggcccaacacacaaggggaattacagaatgcatcccctaagcaaaggaagcagagtgtgtacacaccacccaccataaaaggggttaagcatctgaaaggccagaatgaatcagcattccctgaagaagaagaaggcaccaatgaaagagaggagcagcgggaccattaattactggtctgcagcaagaaggcttcttggaaataactgaactattaacttttctgagtataccatggaattccactgcttgacttccagaagcatcctccatctctgcaccccacactcatacagtagctatgcacatcctggaagtctccttgactgaactttagaactaagtacacattgttccacatcacttataattaaagaataagcatttattttacagtgattcttctttttaactatgtaaaaatttgcatacatgtgactgttctaactttaatactgccagagcttaatccttgatgtcctactgataaggtttgcattctaacaacacatgtaaataacatcactttaagagtaaaaaataaatagtaaacacattta

SEQ ID NO: 16462 - DNA, 551 bp, Homo sapiens
  ENST00000465612
gaaccaagaaacttcagaaacctctgatatctgatcaagagttaagagacgtcagaatcatcacaactgacaaaagaatgttttctctcttcaagattctcttttgaaagacatctaaaaagaaaccaggtctcactgttttgccaggctggtcttgaactcctgtgctcaagcaatcctcccaccttggcctctcagagtgctggggttacagaaatagatgacaagagggggcccaacacacaaggggaattacagaatgcatcccctaagcaaaggaagcagagtgtgtacacaccacccaccataaaaggggttaagcatctgaaaggccagaatgaatcagcattccctgaagaagaagaaggcaccaatgaaagagaggagcagcgggaccattaattactggtctgcagcaagaaggcttcttggaaataactgaactattaacttttctgagtataccatggaattccactgcttgacttccagaagcatcctccatctctgcaccccacactcatacagtagctatgcacatcctggaagtc

SEQ ID NO: 16463 - DNA, 3004 bp, Homo sapiens
  ENST00000409137
attgtgctgagaggatccaagggattggtgggggaacaggcaagccaggcatcaccgtggatgttgaagaagggggttactcaaacctcggcatcttcacttgctcgatctggaattacagctatttattacgaagcactctgtgtggcttagtggagtgtgtctgaggaaacacatcccggacaccacttagggttagtctttctgagctcttcacatctctgactaattatcatcattaccatggagcccaacagtcccaaaaagatacagtttgccgtgcctgtattccagagtcagattgcacctgaagcagcagagcagatcaggaaaagaagacctacaccagcatcacttgtgattctcaatgagcataaccccccagaaatagatgacaagagggggcccaacacacaaggggaattacagaatgcatcccctaagcaaaggaagcagagtgtgtacacaccacccaccataaaaggggttaagcatctgaaaggccagaatgaatcagcattccctgaagaagaagaaggcaccaatgaaagagaggagcagcgggaccattaattactggtgcaaaatgagttgataacaaccagaagttgacttgttagtgctgtgcttctactcgagcttggaaaaatcccaacacaaaacaaacaccacctccgattccatcatgatgccacgttgctttctactggattacctcctgaagcactttagatattttatacataagtattgacatgtttttcagaagctgtttcttcacttattgcttttttctaataatttttattacaccatttgccaagtccttccctttggttttagtttattcctctctacaactaaaaaagggatcttgagtttaggtacattttaagtgattcatttttagtttttctaattctggaatctgagccttctcttacaacagggagtctttcaaaaacatttttttgtttctttttcaaattccactgtgtttatttattgccttgtttctttttcaaattccattggtcttgatttaatttagttccacagattttactgatagtctactacctgccaactactgaattatgcagcagacttataaaaataaaaaggctattttattgttattgccatcctgctagtaaagatttattcaattatttataattaattaagtggcttcacctatatttctgttaataatcacattaattatgtatgacaggtaggatttatgttatagataagaaaactagagtccaaagaaaataagtgtccccaaatgaaccaataatccaacaaacgcttccactaactagcttctgacctgtttgagttgtgatagattttagaataaaaaagcctatcctccttaggagccatagacttttattctttcttatactgtcttatatattgacttagagctaaacttcctccaattcagacataaagcataggcagatacttttgctaatgaggctaagctgggaagaaaaccctgagttctactttaattcttgggcattgacttcaaactaagatgacttataagaaataaaagaagtaaatttgaaactttaataaaaaaagtacatggttcatttaaaaatgtttcctatgtctaaatctatattttaaaaataacctttatcatgtaaaatgagagaattgctgagtttatgacaatcttaggtataaccttttcttaaagaacaaggcatcaatctttaatttgtttccctttcttgatttctcataagttgcaaaataaaaataaaaataatttcacaaattgttcattattattatcctccctacttgccccaggatttaagtactaacttttacttcctactcttagactttgtattgccaaagaaataaaatatgaaaaagcataatcacccagacctacctgcggaattgtggattatgctgtagatattagatcattgaaaggaacaatatactacttaatgaggagccaaagacaacattctacctgctgctcccttcaagctgaggaatgagtttaattgacttcaaagtcccattattctcaaaagtagcaaaggtacaacatggctttgcatgaatcaaaggaagggaacaacaagaacttaaaaaaatagtttgcagatggttgaacatctctttaataattagagaagaatatcttttctttctttattgtttacagataccaacatttttcaaagccttgcagtagatgagtgagtctcctgttacatttctcctgcagcatatattctgtggatgtgttttcctaagcagactaattatatgttgctctcttcttttaccctaatgaaacatagatttttctgttttgaatttgtcacttgtttgttacatttgtcaagtgttttaaatattacattggtcctttatttgcttttgagaacacccaatagtttaaaaattaaaatgacatgaaggtcaattctaagacaggaatgatactactaaatcctggacttgcctatgataacaagctcgagctacacacttttattgtcagaataaatggaatatataggaaggagttaattggaactggttagtacctaaataagatttttcaaagtaagttttttgtcgtattggcagaacagtgttaaaaaatagacattgtcatcataaacacccacaactatatctgtagaagataatttaatgcaatattctggggaaaatacagttgccaaaattaatctccttgttttctttcattgtgcaatgtggagttaaattttttttctattgagcagtgtgtgtgtgtgtttgtgtctataatttatatatgtgcttgtatacatttctatatacacatgtatgtgtatgcaaaatatgtatatatacacatatatataaaatgtacactaaatatgtatatatgtatattcataaaatgttttgctgtatggaaataaaaaagaaggtttctaaaggaaagatagagaagaaa

SEQ ID NO: 16464 - DNA, 1636 bp, Homo sapiens
  ENST00000280295
agaggatccaagggattggtgggggaacaggcaagccaggcatcaccgtggatgttgaagaagggggttactcaaacctcggcatcttcacttgctcgatctggaattacagctatttattacgaagcactctgtgtggcttagtggagtgtgtctgaggaaacacatcccggacaccacttagggttagtctttctgagctcttcacatctctgactaattatcatcattaccatggagcccaacagtcccaaaaagatacagtttgccgtgcctgtattccagagtcagattgcacctgaagcagcagagcagctgggcttttgtcgttcacagatcaggaaaagaagacctacaccagcatcacttgtgattctcaatgagcataaccccccagaaatagatgacaagagggggcccaacacacaaggggaattacagaatgcatcccctaagcaaaggaagcagagtgtgtacacaccacccaccataaaaggggttaagcatctgaaaggccagaatgaatcagcattccctgaagaagaagaaggcaccaatgaaagagaggagcagcgggaccattaattactggtgcaaaatgagttgataacaaccagaagttgacttgttagtgctgtgcttctactcgagcttggaaaaatcccaacacaaaacaaacaccacctccgattccatcatgatgccacgttgctttctactggattacctcctgaagcactttagatattttatacataagtattgacatgtttttcagaagctgtttcttcacttattgcttttttctaataatttttattacaccatttgccaagtccttccctttggttttagtttattcctctctacaactaaaaaagggatcttgagtttaggtacattttaagtgattcatttttagtttttctaattctggaatctgagccttctcttacaacagggagtctttcaaaaacatttttttgtttctttttcaaattccactgtgtttatttattgccttgtttctttttcaaattccattggtcttgatttaatttagttccacagattttactgatagtctactacctgccaactactgaattatgcagcagacttataaaaataaaaaggctattttattgttattgccatcctgctagtaaagatttattcaattatttataattaattaagtggcttcacctatatttctgttaataatcacattaattatgtatgacaggtaggatttatgttatagataagaaaactagagtccaaagaaaataagtgtccccaaatgaaccaataatccaacaaacgcttccactaactagcttctgacctgtttgagttgtgatagattttagaataaaaaagcctatcctccttaggagccatagacttttattctttcttatactgtcttatatattgacttagagctaaacttcctccaattcagacataaagcataggcagatacttttgctaatgaggctaagctgggaagaaaaccctgagttctactttaattcttgggcattgacttcaaactaagatgacttataagaaataaaagaagtaaatttgaaactttaataaaaaaagtacatggttcatttaaaaa

SEQ ID NO: 16465 - DNA, 1157 bp, Homo sapiens
  ENST00000409702
ggagtgtgtctgaggaaacacatcccggacaccacttagggttagtctttctgagctcttcacatctctgactaattatcatcattaccatggagcccaacagtcccaaaaagatacagtttgccgtgcctgtattccagagtcagattgcacctgaagcagcagagcagatcaggaaaagaagacctacaccagcatcacttgtgattctcaatgagcataaccccccagaaatagatgacaagagggggcccaacacacaaggggaattacagaatgcatcccctaagcaaaggaagcagagtgtgtacacaccacccaccataaaaggggttaagcatctgaaaggccagaatgaatcagcattccctgaagaagaagaaggcaccaatgaaagagaggagcagcgggaccattaattactggtctgcagcaagaaggcttcttggaaataactgaactattaacttttctgagtataccatggaattccactgcttgacttccagaagcatcctccatctctgcaccccacactcatacagtagctatgcacatcctggaagtctccttgactgaactttagaactaagtgcaaaatgagttgataacaaccagaagttgacttgttagtgctgtgcttctactcgagcttggaaaaatcccaacacaaaacaaacaccacctccgattccatcatgatgccacgttgctttctactggattacctcctgaagcactttagatattttatacataagtattgacatgtttttcagaagctgtttcttcacttattgcttttttctaataatttttattacaccatttgccaagtccttccctttggttttagtttattcctctctacaactaaaaaagggatcttgagtttaggtacattttaagtgattcatttttagtttttctaattctggaatctgagccttctcttacaacagggagtctttcaaaaacatttttttgtttctttttcaaattccactgtgtttatttattgccttgtttctttttcaaattccattggtcttgatttaatttagttccacagattttactgatagtctactacctgccaactactgaattatgcagcagacttataaaaataaaaaggctattttattgttattgcc

SEQ ID NO: 16466 - DNA, 501 bp, Homo sapiens
  ENST00000479855
cctctgagccaggtgccggatataatctcgtggtgcgccgttttttaagccggtccgaaaagcacaatattcgggtgggagtgacccgatttcccagaaatagatgacaagagggggcccaacacacaaggggaattacagaatgcatcccctaagcaaaggaagcagagtgtgtacacaccacccaccataaaaggggttaagcatctgaaaggccagaatgaatcagcattccctgaagaagaagaaggcaccaatgaaagagaggagcagcgggaccattaattactggtctgcagcaagaaggcttcttggaaataactgaactattaacttttctgagtataccatggaattccactgcttgacttccagaagcatcctccatctctgcaccccacactcatacagtagctatgcacatcctggaagtctccttgactgaactttagaactaagtacacattgttccacatcacttataattaaagaataagcatt

SEQ ID NO: 16467 - DNA, 410 bp, Homo sapiens
  ENST00000461410
ccaacacacaaggggaattacagaatgcatcccctaagcaaaggaagcagagtgtgtacacaccacccaccataaaaggtactgttcaggtactgtttcgggttgtcatgagtggtgaatcatggctggtcggccgtctgttctctaggaccacatatctgatgataagctagatctagtctcagctctacaacttaacagtgttatgttcagtaagatatcttatctacttaaaacttagtttcatcaagagtaaaatatggggttgaaaaagaaatagctagtgatctcagaatttcagtctagaaattcagtttccaaaataatgacaaagatttttttttaccgttattcgcatacttccttaaagagattttcccagaagccctaattactcttgccagtgttgg

SEQ ID NO: 16468 - DNA, 933 bp, Homo sapiens
  ENST00000494189
agagagtaaaactgcctgtgaacaagaatgcttaagtgaacaatggtaaatctgatagaaaagcagggtcagagcaaaacagttgcaaagctcagagtgtaaactgcatgtcctcaggtcaagcagaggatgaaaagcagaacaatctcctcattcaagaaacttcctggcggccagcaagctgagtaatgagaaacaaactgagtggaggccttccacagagggttaagcatctgaaaggccagaatgaatcagcattccctgaagaagaagaaggcaccaatgaaagagaggagcagcgggaccattaattactggtctgcagcaagaaggcttcttggaaataactgaactattaacttttctgagtataccatggaattccactgcttgacttccagaagcatcctccatctctgcaccccacactcatacagtagctatgcacatcctggaagtctccttgactgaactttagaactaagtacacattgttccacatcacttataattaaagaataagcatttattttacagtgattcttctttttaactatgtaaaaatttgcatacatgtgactgttctaactttaatactgccagagcttaatccttgatgtcctactgataaggtttgcattctaacaacacatgtaaataacatcactttaagagtaaaaaataaatagtaaacacatttagacatgagtgtgtgtgtgtgtgtgtgtgggtttagcttaaagagaaatatctaataaagcttttagcttgagatttgcattgatcatatttctgtattcagaacagaacacaatgttcatttttaaatgatgaagaaatgccagttttcttgattcaatacaccacaatattagatactaaacatctttttcccaccaacaacacattaatggttgattatacaactacaga

SEQ ID NO: 16469 - DNA, 1405 bp, Homo sapiens
  ENST00000298705
agcgacgccccgccccgctccgcgccccgggcagccgtgtgcaggcgcctgcgggcggtatcctcggcgacgccgtatggcttccagggcgaggccatgtaccgggtgcccgagttttatgcgaggaggaagcggttaggtgggcagaccccttacttgatggatcagttgggattacgattagggatgtggtactggaaagatgaaaccagaactcttgaattcagaaggtttgccgcagaagattctgtccagtggctcctgaaacatcaccctcattttacacctgcagcagaagtcaaggaaaaaggaaagaaaggcaaagcagttcactttgcagaaactgatggtccagcttcagacaggttgacagataaaagacttgctgcaaaagatgataagtcagctaaagctgtagagaaacgaggtcaacagggcaccattacactggatgatgttaaatttgttactttgcttttgctacaagatactgagatgcagcggatctgttcttttacaacatttatgaggaataagaatcttgataatttcctcatggcattattgtactacttatcccattacttggaaaaaaactcactggaaaagaaacccaaaagctatatggtaggccttgtagagaaaaaagaaatggaattggttttaagtgaattagaagcagcacagaggtacttggcgcagaagtactgtatccttgtgctgggcttggccgtgccggataagcatcacatgtgctgtggaaaggagaaaatatcagatacacagaaagactggaagttctttgagtccttttatactttctgtacatatgtggcttggattgtcttccgacgtcaacacttgacagagattgaagaagaagtagggagactctttcgtaccaatatgttcaacattcctcgcaggaggcgtgaagatgaggaatcaggaggggaaaagaaacgcatgacttttgttcagttcaggagaatgatggcaaaacgcccagcaattaaaaaagctatcaacatgcgttctccagtcatgtctactctgctgccatctctcagagaaaaagctcaaaacgtctttgagaaaaagtatcatcaagtagacgtcagattcccagccgagatgcaaaagcatgtgggaactctggactctgtgcccatgccggtagttggcatcttgggggagcctcgatgtctattcaacccacatacgcttcacccccttgatccagaagaaaacacaaaatcatttgggagatatccttccttgatggaaaacaataacatgaggattcaggatacactggacttggtcatgaaaacactgtcctctcatacatcatgccctaagtaacctggtacattccatatctcaagtaaactactttgacttt

SEQ ID NO: 16470 - DNA, 576 bp, Homo sapiens
  ENST00000555645
tccgcgccccgggcagccgtgtgcaggcgcctgcgggcggtatcctcggcgacgccgtatggcttccagggcgaggccatgtaccgggtgcccgagttttatgcgaggaggaagcggttaggtgggcagaccccttacttgatggatcagttgggattacgattagggatgtggtactggaaagatgaaaccagaactcttgaattcagaaggtttgccgcagaagattctgtccagtggctcctgaaacatcaccctcatgcccctattccaaagctggcagagaaccagcagtctgcctgaatgtttgccaaggtcatggactcccctgaggacataaaaccaaggaaaccctactctttcgtcatggcctgagagaagactctctgagaaccatcaaagaggtctaacttgtgtggaagccaagagtggtccagccctctgcatttacgtgatggattctagagagaaaatatgaatttctttcctgtttacttcaagttttacacctgcagcagaagtcaaggaaaaaggaaagaaaggcaaagcagttcactttgcagaaactgatggtcc

SEQ ID NO: 16471 - DNA, 1400 bp, Homo sapiens
  ENST00000467261
gtgcaggcgcctgcgggcggtatcctcggcgacgccgtatggcttccagggcgaggccatgtaccgggtgcccgagttttatgcgaggaggaagcggttaggtgggcagaccccttacttgatggatcagttgggattacgattagggatgtggtactggaaagatgaaaccagaactcttgaattcagaagatgaagaaacaaggctcagggagattaagcaactgaaccaaagtcatacagccagtttgccgcagaagattctgtccagtggctcctgaaacatcaccctcattttacacctgcagcagaagtcaaggaaaaaggaaagaaaggcaaagcagttcactttgcagaaactgatggtccagcttcagacaggttgacagataaaagacttgctgcaaaagatgataagtcagctaaagctgtagagaaacgaggtcaacagggcaccattacactggatgatgttaaatttgttactttgcttttgctacaagatactgagatgcagcggatctgttcttttacaacatttatgaggaataagaatcttgataatttcctcatggcattattgtactacttatcccattacttggaaaaaaactcactggaaaagaaacccaaaagctatatggtaggccttgtagagaaaaaagaaatggaattggttttaagtgaattagaagcagcacagaggtacttggcgcagaagtactgtatccttgtgctgggcttggccgtgccggataagcatcacatgtgctgtggaaaggagaaaatatcagatacacagaaagactggaagttctttgagtccttttatactttctgtacatatgtggcttggattgtcttccgacgtcaacacttgacagagattgaagaagaagtagggagactctttcgtaccaatatgttcaacattcctcgcaggaggcgtgaagatgaggaatcaggaggggaaaagaaacgcatgacttttgttcagttcaggagaatgatggcaaaacgcccagcaattaaaaaagctatcaacatgcgttctccagtcatgtctactctgctgccatctctcagagaaaaagctcaaaacgtctttgagaaaaagtatcatcaagtagacgtcagattcccagccgagatgcaaaagcatgtgggaactctggactctgtgcccatgccggtagttggcatcttgggggagcctcgatgtctattcaacccacatacgcttcacccccttgatccagaagaaaacacaaaatcatttgggagatatccttccttgatggaaaacaataacatgaggattcaggatacactggacttggtcatgaaaacactgtcctctcatacatcatgccctaagtaacctggtacattccatatct

SEQ ID NO: 16472 - DNA, 596 bp, Homo sapiens
  ENST00000557202
gccatatttgcctagaaaaaaaaaaaactctggtgtatttgacagatggtcagaattgaattctggctccctgcgcagcagttgggattacgattagggatgtggtactggaaagatgaaaccagaactcttgaattcagaagatgaagaaacaaggctcagggagattaagcaactgaaccaaagtcatacagccagtttgccgcagaagattctgtccagtggctcctgaaacatcaccctcattttacacctgcagcagaagtcaaggaaaaaggaaagaaaggcaaagcagttcactttgcagaaactgatggtccagcttcagacaggttgacagataaaagacttgctgcaaaagatgataagtcagctaaagctgtagagaaacgaggtcaacagggcaccattacactggatgatgttaaatttgttactttgcttttgctacaagatactgagatgcagcggatctgttcttttacaacatttatgaggaataagaatcttgataatttcctcatggcattattgtactacttatcccattacttggaaaaaaactcactggaaaagaaacccaaaagctatatggt

SEQ ID NO: 16473 - DNA, 1686 bp, Homo sapiens
  ENST00000554400
ttttgtacttttagtagagctaatttttgtacttttagtacttttagtactttaacagcgtcaccatgttggccaggctggtctgaaactcctggcctcaagtgatccacgcacctcggcctcccaaagtgctaattacaggcgtaagccactgcatcttgccaagtatagtattcttaacattgaatttgtgttgcaaggactcctgggaagagagaagactcaggtttgtccatgcccatcagaaggaggagcacactgccgttctcagtctattggttgttttggcatagatctttgtggattttgtttctgtttctttttgtacccaatagccataactattgtttgctaattcttttccttttctttattgcagacttaccctctagttctctgcttcctctttaccacctttccactctccttacctccccaacactcaaattaccagaagcctttggaagaatacatttcctcactggtttgtttaccccaaatttatattgattaactttttaccattctaggagttttgatctgggtaacgtaggaggttgaataagaaagtattgagactctttatcaatgccttttgatagcatttgtgtagctgaaaataatcttggggccaagataatgaccctaactttagagaaagataaggactagtaccctgaaagattgaacttccctctcaacctatagttgtgacttgttatattacagggagaaaatatcagatacacagaaagactggaagttctttgaggtgagtcacttatgttttggtgctttttgatatgaaacaatatataccaacaaccaatggccatttgtcaggcacttatttttagtgaatatcctttctaaaagacggtgctaacaagctatatgctataccttaaattgttggtctgattttcctcatgcaaaagtgagtatgtgtataatttttcattgtttcaggaatattgggaaattgggtcatctgggtttgtgtctgcttagctgtgttatacagacaggtaagagttttccatttcacagctaaggatcgtgattcttgtctattttttgttgtagtccttttatactttctgtacatatgtggcttggattgtcttccgacgtcaacacttgacagagattgaagaagaagtagggagactctttcgtaccaatatgttcaacattcctcgcaggaggcgtgaagatgaggaatcaggaggggaaaagaaacgcatgacttttgttcagttcaggagaatgatggcaaaacgcccagcaattaaaaaagctatcaacatgcgttctccagtcatgtctactctgctgccatctctcagagaaaaagctcaaaacgtctttgagaaaaagtatcatcaagtagacgtcagattcccagccgagatgcaaaagcatgtgggaactctggactctgtgcccatgccggtagttggcatcttgggggagcctcgatgtctattcaacccacatacgcttcacccccttgatccagaagaaaacacaaaatcatttgggagatatccttccttgatggaaaacaataacatgaggattcaggatacactggacttggtcatgaaaacactgtcctctcatacatcatgccctaagtaacctggtacattccatatctcaagtaaactactttgactttat

SEQ ID NO: 16474 - DNA, 696 bp, Homo sapiens
  ENST00000556023
gttatattacagggagaaaatatcagatacacagaaagactggaagttctttgagtccttttatactttctgtacatatgtggcttggattgtcttccgacgtcaacacttgacagagattgaagaagaagtagggagactctttcgtaccaatatgttcaacattcctcgcaggaggcgtgaagatgaggaatcaggaggggaaaagaaacgcatgacttttgttcagttcaggagaatgatggcaaaacgcccagcaattaaaaaagctatcaacatgcgttctccagtcatgtctactctgctgccatctctcagagaaaaagctcaaaacgtctttgagaaaaagtatcatcaagtagacgtcagattcccagccgagatgcaaaagcatgtgggaactctggactctgtgcccatgccggtgtaagtggcttggcaagagaagcatgagtgccttgaggtggcatcccaggtggggctggaaggggcaggggcccaggcaccatgcctctgccagggaatcgagccatgatgacagcccccattttcttacttctgccctgctcccctcctagtttcctttctagagaatcttgaggtacacccatctagaccagaaaaacaattgctagaaagtggtgctagactccaaatagttctagtttggaggagtgagtaactgatttttttttt

SEQ ID NO: 16475 - DNA, 4649 bp, Homo sapiens
  ENST00000481195
cttttcccctccgctccccgccgcctcctgacgccgggcgtgacgtcaccacgcccggcggccgccattacagagagccgagctctggagcctcagcgagcggaggaggaggcgcagcggccgacggccgagtactgcggtgagagccagcgggccagcgccagcctcaacagccgccagaagtacacgaggaaccggcggcggcgtgtgcgtgtaggcccgtgtgcgggcggcggcgcgggagcagcgcggagcggcagccggctggggcgggtggcatcatggacgagaaggtgttcaccaaggagctggaccagtggatcgagcagctgaacgagtgcaagcagctgtccgagtcccaggtcaagagcctctgcgagaaggctaaagaaatcctgacaaaagaatccaacgtgcaagaggttcgatgtccagttactgtctgtggagatgtgcatgggcaatttcatgatctcatggaactgtttagaattggtggcaaatcaccagatacaaattacttgtttatgggagattatgttgacagaggatattattcagttgaaacagttacactgcttgtagctcttaaggttcgttaccgtgaacgcatcaccattcttcgagggaatcatgagagcagacagatcacacaagtttatggtttctatgatgaatgtttaagaaaatatggaaatgcaaatgtttggaaatattttacagatctttttgactatcttcctctcactgccttggtggatgggcagatcttctgtctacatggtggtctctcgccatctatagatacactggatcatatcagagcacttgatcgcctacaagaagttccccatgagggtccaatgtgtgacttgctgtggtcagatccagatgaccgtggtggttggggtatatctcctcgaggagctggttacacctttgggcaagatatttctgagacatttaatcatgccaatggcctcacgttggtgtctagagctcaccagctagtgatggagggatataactggtgccatgaccggaatgtagtaacgattttcagtgctccaaactattgttatcgttgtggtaaccaagctgcaatcatggaacttgacgatactctaaaatactctttcttgcagtttgacccagcacctcgtagaggcgagccacatgttactcgtcgtaccccagactacttcctgtaatgaaattttaaacttgtacagtattgccatgaaccatatatcgacctaatggaaatgggaagagcaacagtaactccaaagtgtcagaaaatagttaacattcaaaaaacttgttttcacatggaccaaaagatgtgccatataaaaatacaaagcctcttgtcatcaacagccgtgaccactttagaatgaaccagttcattgcatgctgaagcgacattgttggtcaagaaaccagtttctggcatagcgctatttgtagttacttttgctttctctgagagactgcagataataagatgtaaacattaacacctcgtgaatacaatttaacttccatttagctatagctttactcagcatgactgtagataaggatagcagcaaacaatcattggagcttaatgaacatttttaaaaataattaccaaggcctcccttctacttgtgagttttgaaattgttctttttattttcagggataccgtttaatttaattatatgatttgtctgcactcagtttattccctactcaaatctcagccccatgttgttctttgttattgtcagaacctggtgagttgttttgaacagaactgttttttccccttcctgtaagacgatgtgactgcacaagagcactgcagtgtttttcataataaacttgtgaactaagaactgagaaggtcaaattttaattgtatcaatgggcaagactggtgctgtttattaaaaaagttaaatcaattgagtaaattttagaatttgtagacttgtaggtaaaataaaaatcaagggcactacataacctctctggtaactccttgacattcttcagattaacttcaggatttatttgtatttcacatattacaatttgtcacattgttggtgtgcactttgtgggttcttcctgcatattaacttgtttgtaagaaaggaaatctgtgctgcttcagtaagacttaattgtaaaaccatataacttgagatttaagtctttgggttttgttttaataaaacagcatgttttcaggtagagcttaaactaaatgatgtgtttacttagtgcagtttctggttatgaatattatattgctatgtgtatattatatggactctttaaaatgattgacagattggcaaattcttaaatctttgtacattgttgagtcatatgttcttagagttaaatttgtctcagataagaaagtgttaaagcattagcctgtgtcaagttctttgagtgatactagtgaaaccaaatagaaaactattgttggatcatgatttagtcttatgtacattcacccgaagacaaaaatggtacttaaagtggcagtgttcaacatttaatgagtttttccccttttatccttcgaataggattagatgtttaaaaaaaagttcttctgtgggaactaatatttgatattttaacctaccagagtaaacaggaacacttaatcatacttgtgagtgtagtaaataaaagttttcttgctttgtgctgtgttgaatctggaaccaacagggaagttatagcatatcccctttctaaaatgcttgaggaacacatacataccgaatgtcttttctgatctaattgatagtatttttagtggcttgtggagttaattttccaaagcaaaaggccattagggtttctacatttcatttcatttcattcttttctttcacaagaaatacattctctgtgtgtctttttgttgctctgtcactctatgccctttctctccgactgaacaaatagcttatccatgtgcagtggttttaatacccaaacaatctagacaccaagcagctattttttccggtcctgtgatatcagaattgaccaaggaatacgtatattgtaattgacacgtggtggtatcttccaggtacaaattctctaaattttgtggttagcagaatgggacttgtgataagaatagcttggttttagcataactagggtttaaaataattgtttaattatagagactgaccgggctttggccatctaaactggaaagtgttagtaccctaccttcttttgaaaatggctatggtaaggaaaatgtgttagtaaattatgtattttcttgaaaaatacataattatggttggatgggaatcactaagttgggtgttaactgatgtctcaattagtaacattaggattttcattaataaacctaaaaagctttccctaagaacaggcctggcacagtggctcatgcctgtaatcccagcactttgggagaccagggtgggtggatcccttgaggtcaggagttgaagagcagcctggccaacatggcaaaaccccatctctacaaaaaatatgaaaatcagccgggcttggtggcataccatagtcccagctacttgggaggctgaggtgagaggatcgcctgagcccaggagatggaggttgcagtgggctgagattgtgccactgtactccagtctgggtgacagagccagaccctgtctcaaaaataaagaggattctgagtttgtatagtgagggcttgcagaaattttgaaacttattttgtaagtttacaatgaatttgtacatgatgtgctcatgtcttgggttgagtatcctagacatgattttttcatttgctgcatattaaacatttgttggttgtagtcggtatttcttaaatagaagtttgtcaatattagattagtttcaagaaggacttagctcaggaaaaggatagttatttctgtggttctcagctttgatgcctacagagattctgatttaaattgctggaggagggcccaggcatacattttttaagtttcccaagtgattctaatttacatctagggttaaaaacagccaggcgcggtggctcatgcctgtaatcccagcacttggggaggccggggtgggtggatcacctgatgtcaggagatcgagaccagcctggccagcgtggtgaaaccccatctctattaaaaatacaaaactgaccggtgtggtggcaggagcctgtaatcccagctacttgggaggctgaggcaggagaatcacttgaactcaggaggaggaggttacagtgagcccagatcgtgccattgcactccagcctgggcaaaaagagcaaaactccatctcaaaaaacaaaaacacctcactgctgtttcctaagtacatacttaagaaaattgggatacatggtggtggttcatggatgttgataaggaattaaaatgtaccgtgcgactctctgtttcagtggtgacttttacctgtttagtataaatattcctttgcttccaaccataaatgtgttcttagaaatgggcctatagtttagtaacctatagtttggtaataggcttgtttgttttcagatggattttggttctgtgagctaaagctattttgcattaaagccttcgtcctca

SEQ ID NO: 16476 - DNA, 574 bp, Homo sapiens
  ENST00000472253
tttttttttttaaagtactaaaaaaaaaacaagttttgtaattagggggaaaataaatacatgtgtaccttacaggttgtataaagtacaggagattattaagtcatccagaaaaaaagcattaacatttcttaagcccctttggcaggggtgggaatgagtagagatttttttctctcttgagtgaagtaacatttagttgaattgagggagtaaagtaagatttttgtctccttttccttgcagggatataactggtgccatgaccggaatgtagtaacgattttcagtgctccaaactattgttatcgttgtggtaaccaagctgcaatcatggaacttgacgatactctaaaatactctttcttgcagtttgacccagcacctcgtagaggcgagccacatgttactcgtcgtaccccagactacttcctgtaatgaaattttaaacttgtacagtattgccatgaaccatatatcgacctaatggaaatgggaagagcaacagtaactccaaagtgtcagaaaatagttaacattcaaaaaacttgttttcacatggaccaaaagatgt

SEQ ID NO: 16477 - DNA, 739 bp, Homo sapiens
  ENST00000495833
ttttgtattccatttatatgacatttctagaaaagacaaactcaagacagtaaatcagtggttgccaggagctggagtgggagtggagagtgactgcaggagggatctttttgggataatggaaaggttctaaaactggattgtggtgattgttgcataactataaatttgtgaaaaattactgaaccgtaaagtaatttatggggttttaatagcccattgatttatgtttggtataaagttggtggtagagggagtttgattttagttgagatgaggtgggcaaacaccccatgggcatttaaaaattctgtagagctgtggttttggttcactatgatatgaggatgtgtgctgttttttcaacaaaattgtaactgcatttttttctatagaaagtttcttgaattttcattggtttttgaaagagctagttgtttatgttttgcattttattgttttaggttcgttaccgtgaacgcatcaccattcttcgagggaatcatgagagcagacagatcacacaagtttatggtttctatgatgaatgtttaagaaaatatggaaatgcaaatgtttggaaatattttacagatctttttgactatcttcctctcactgccttggtggatgggcagatcttctgtctacatggtggtctctcgccatctatagatacactggatcatatcagagcacttgatcgcctacaagaagttccccatgaggtatgactttt

SEQ ID NO: 16478 - DNA, 585 bp, Homo sapiens
  ENST00000522385
aaaatggcgccgttcactcgactcctgggcttttgagtcagccggccttggcgccagacgaggtggcagggggagcggagaccctgtgggtcatcgtcagggacggttttgagggctaaagaaatcctgacaaaagaatccaacgtgcaagaggttcgatgtccagttactgtctgtggagatgtgcatgggcaatttcatgatctcatggaactgtttagaattggtggcaaatcaccagatacaaattacttgtttatgggagattatgttgacagaggatattattcagttgaaacagttacactgcttgtagctcttaaggttcgttaccgtgaacgcatcaccattcttcgagggaatcatgagagcagacagatcacacaagtttatggtttctatgatgaatgtttaagaaaatatggaaatgcaaatgtttggaaatattttacagatctttttgactatcttcctctcactgccttggtggatgggcagatcttctgtctacatggtggtctctcgccatctatagatacactggatcatatcagagcacttgatcgcctacaagaagttccccat

SEQ ID NO: 16479 - DNA, 510 bp, Homo sapiens
  ENST00000523082
agatttagatttgtttctcccaagcctgaacaaaactactactagtggatgaggtggcacatcatctgttggagatgccttttaatggtagcgatgtattgaatctcctgtttctttaccctctcacgtcaaatgaggctaaagaaatcctgacaaaagaatccaacgtgcaagaggttcgatgtccagttactgtctgtggagatgtgcatgggcaatttcatgatctcatggaactgtttagaattggtggcaaatcaccagatacaaattacttgtttatgggagattatgttgacagaggatattattcagttgaaacagttacactgcttgtagctcttaaggttcgttaccgtgaacgcatcaccattcttcgagggaatcatgagagcagacagatcacacaagtttatggtttctatgatgaatgtttaagaaaatatggaaatgcaaatgtttggaaatattttacagatctttttgactatcttcctctcactgccttgg

SEQ ID NO: 16480 - DNA, 564 bp, Homo sapiens
  ENST00000231504
acagagagccgagctctggagcctcagcgagcggaggaggaggcgcagcggccgacggccgagtactgcggtgagagccagcgggccagcgccagcctcaacagccgccagaagtacacgaggaaccggcggcggcgtgtgcgtgtaggcccgtgtgcgggcggcggcgcgggagcagcgcggagcggcagccggctggggcgggtggcatcatggacgagaaggtgttcaccaaggagctggaccagtggatcgagcagctgaacgagtgcaagcagctgtccgagtcccaggtcaagagcctctgcgagaaggctaaagaaatcctgacaaaagaatccaacgtgcaagaggttcgatgtccagttactgtctgtggagatgtgcatgggcaatttcatgatctcatggaactgtttagaattggtggcaaatcaccagatacaaattacttgtttatgggagattatgttgacagaggatattattcagttgaaacagttacactgcttgtagctcttaagagattaggacacagatggggagaagataagacagatggag

SEQ ID NO: 16481 - DNA, 4092 bp, Homo sapiens
  ENST00000335585
acatgcaaaaagtggggcctggagatggggctgtcttttttctccaaacacttgcccatccaggaaggccagccctgggcattgaagactccagctgacatcatctctaccgttgagttcaaccacacgggagagctgctggccacaggtgacaagggcggccgggtcgtcatcttccagcgggaaccagagagtaaaaatgcgccccacagccagggcgaatacgacgtgtacagcactttccagagccacgagccggagtttgactatctcaagagcctggagatagaggagaagatcaacaagatcaagtggctcccacagcagaacgccgcccactcactcctgtccaccaacgataaaactatcaaattatggaagattaccgaacgagataaaaggcccgaaggatacaacctgaaggatgaagaggggaaacttaaggacctgtccacggtgacgtcactgcaggtgccagtgctgaagcccatggatctgatggtggaggtgagccctcggaggatctttgccaatggccacacctaccacatcaactccatctccgtcaacagtgactgcgagacctacatgtcggcggatgacctgcgcatcaacctctggcacctggccatcaccgacaggagcttcaacatcgtggacatcaagccggccaacatggaggaccttacggaggtgatcacagcatctgagttccatccgcaccactgcaacctcttcgtctacagcagcagcaagggctccctgcggctctgcgacatgcgggcagctgccctgtgtgacaagcattccaagctctttgaagagcctgaggaccccagtaaccgctcattcttctcggaaatcatctcctccgtgtccgacgtgaagttcagccacagcggccgctacatgctcacccgggactaccttacagtcaaggtctgggacctgaacatggaggcaagacccatagagacctaccaggtccatgactaccttcggagcaagctctgttccctgtacgagaacgactgcattttcgacaagtttgaatgtgcctggaacgggagcgacagcgtcatcatgaccggggcctacaacaacttcttccgcatgttcgatcggaacaccaagcgggacgtgaccctggaggcctcgagggaaagcagcaagccccgggctgtgctcaagccacggcgcgtgtgcgtggggggcaagcgccggcgtgatgacatcagtgtggacagcttggacttcaccaagaagatcctgcacacggcctggcacccggctgagaacatcattgccatcgccgccaccaacaacctgtacatcttccaggacaaggtaaactctgacatgcactaggtatgtgcagttcccggcccctgccacccagcctcatgcaagtcatccccgacatgaccttcacgaccgcaatgcaaggaggggaagaaagtcacagcactgatgaggacagctgcagaggtggcagtgtgtggacacaggaagtttgggccccctccctgccccagctttcctaggccagaattgtgtttggcagtaattgtctgtttaaaaaaataaaaaggaaaggaagcgttcaccgccacaaatcataaaatggacatgactgtggagtcttacagttcagggttctttcattcacgtcccttcctgtctcggtctgcggtctttaccacatcaataggactttttatgcgtccgggttaatttttcactccagtgcgtcctgttgcagggaccggagctgatgggagctgcttctcccccatgcctcactggtcccagatcagggctccagggacagatgatgagtctcaaacgagccagccaggggttcttttggttataaatggggcaattcgccctgtctcagagctgatgacctcaccgttgttttttggatggtgaattcatgctgagaatttgcagatgcaagctcctctcctaggtcttctgaatgtcttgaaacatcccaggtcccaggtctggtgcggtttcccgagaggagcggagtggggtttgtcttctgtgtgcctgtgtcctcatctgattcacctgccatttgctgagcctctgctgtgtaccaggcgtggtgctcagccctagaggcagttgacttaccctctgcagccctccctgccgcctcacccttcagcattcactgggcaccttcccggagcggacactgactcccatgcacgattttttggaatcttcctcctgactgtgaggtgggtgttcattcatttcctccataaacaccaacttctcgaagcgtgccaggctctgggctggatgctggggataagcgggaacccttaggatcccctctgtccacgagaagaagctgaggctctgagcggatgcacaggtcacccatggcaggtgccgtgcagtggtgtcaggaacccgtccgggtcttcacacaaggttctctccagtccatctcgtgggcggctcatgttagagcgacattcaaatggaaggtttggaaaggaatgcctctgtcttgtgaagtaggacatggcagacttggcgacgacaagggtccaggagaactgagacgcaggatggaagacagagaagaccccccggagctcctcgctctgcttggtggcttcaggagtgtggccctccccaggactccacttcatcctgggcttgcaccctccttgagccaatgcactgaactgcctttgaaaggaaattgcatgttctgaccattttaggatacctttactttaaggaccacacagtcccagaggacacatccctcgggaactctgcccctctgacaatgagggccacagagaaggtggtgtttccatggtagatgctcctgttctggtgataccaaacctgcccacccctctgagtcgtctttgctcatggacttgcagcagagccacgtagtttggcattttgattcagaaagtggggagcagagacccagccaaatccaaactttttttttggttttgttttgttttgttttttacaagatataacataacccaggaaacagacccagctgaggttattctcagtggattacagtatacttttgtgtgtgtaaaagcacaaagtgcatgtgtactcacttctggccatataacatttacacagggaaatggatcattgatttttttttaatcaacgtgaatgaagaatgtttgtttatatatcactataaaatccagttgacctggacagtattatatgtacatatctattctaattaaatttaacaatcaaaggattggattacttttttcccccttgtaaagaggttcgagaatgtggtcaattgtatagatagcgtgttaaagccaaaacccagctctgagggccttacccattacttggatatttgctacgatccatctccctttgtgagtcaaatgttaagagaagaaacttgtatttgcagctagaggttactgtcacatcatagatttaacatttaccatcttcaaagtacaaatcttacatgtccttcaaaaggaggtcttaatacagttcctagttccttacttctgttttaaactttgggtaccaaaccaaaaagaagaaaaaagaaaggaaaagatcttctttgaagaaaagtatgtctctggatccctggaaaataatgatgtccaaagcaaattgtgaagatcaaatgtgtgttaagaaaaggtgtcgaggggagggacaaaaccagaaacggtggaaggaccagtgtaatagtcacagacttgcatcctggctctgcttacatttcctggtactctcgaatgtacgggcgttcacatagtcattgtgaagttgttggggtttttttggttttgtttttaatttagctcttctctgaggacgaagctgttggtggtggtggtggtgggggtggtggtgtgggatacatggtggtcaagttgtcagccctgatcagtttggactctgtaactcataggtgcattctttttttctttggtgtctcacaaattacccaattgttgaataaaactataaatatgttaataccagctttttccaataaaataacaaatgttacatcaaaaacga

SEQ ID NO: 16482 - DNA, 1780 bp, Homo sapiens
  ENST00000506140
gtgccagctcaatggggccgccgacctcgaagtttccgaagaagtaaaatagaaagaagaccttttttgaaatgacctgtgttagtcacctctctcaggatgcgtgaggcggacacgttgaggccacctcagctgatggaagtttccgctgacatcatctctaccgttgagttcaaccacacgggagagctgctggccacaggtgacaagggcggccgggtcgtcatcttccagcgggaaccagagagtaaaaatgcgccccacagccagggcgaatacgacgtgtacagcactttccagagccacgagccggagtttgactatctcaagagcctggagatagaggagaagatcaacaagatcaagtggctcccacagcagaacgccgcccactcactcctgtccaccaacgataaaactatcaaattatggaagattaccgaacgagataaaaggcccgaaggatacaacctgaaggatgaagaggggaaacttaaggacctgtccacggtgacgtcactgcaggtgccagtgctgaagcccatggatctgatggtggaggtgagccctcggaggatctttgccaatggccacacctaccacatcaactccatctccgtcaacagtgactgcgagacctacatgtcggcggatgacctgcgcatcaacctctggcacctggccatcaccgacaggagcttcaacatcgtggacatcaagccggccaacatggaggaccttacggaggtgatcacagcatctgagttccatccgcaccactgcaacctcttcgtctacagcagcagcaagggctccctgcggctctgcgacatgcgggcagctgccctgtgtgacaagcattccaagctctttgaagagcctgaggaccccagtaaccgctcattcttctcggaaatcatctcctccgtgtccgacgtgaagttcagccacagcggccgctacatgctcacccgggactaccttacagtcaaggtctgggacctgaacatggaggcaagacccatagagacctaccaggtccatgactaccttcggagcaagctctgttccctgtacgagaacgactgcattttcgacaagtttgaatgtgcctggaacgggagcgacagcgtcatcatgaccggggcctacaacaacttcttccgcatgttcgatcggaacaccaagcgggacgtgaccctggaggcctcgagggaaagcagcaagccccgggctgtgctcaagccacggcgcgtgtgcgtggggggcaagcgccggcgtgatgacatcagtgtggacagcttggacttcaccaagaagatcctgcacacggcctggcacccggctgagaacatcattgccatcgccgccaccaacaacctgtacatcttccaggacaaggtaaactctgacatgcactaggtatgtgcagttcccggcccctgccacccagcctcatgcaagtcatccccgacatgaccttcacgaccgcaatgcaaggaggggaagaaagtcacagcactgatgaggacagctgcagaggtggcagtgtgtggacacaggaagtttgggccccctccctgccccagctttcctaggccagaattgtgtttggcagtaattgtctgtttaaaaaaataaaaaggaaaggaagcgttcaccgccacaaatcataaaatggacatgactgtggagtcttacagttcagggttctttcattcacgtcccttcctgtctcggtctgcggtctttaccacatcaataggactttttatgcgtc

SEQ ID NO: 16483 - DNA, 1832 bp, Homo sapiens
  ENST00000515571
atgtgttttgggggaaacagagagaaaggtgtggcctctccacttctgtggacaccccaaataggaagaagggtgcacacaaagcaccgcttcctccacgaagccctcctcaggcacatcgaggagaaccagctgcccaagctcttggctgctgcccttctgaggcctgcctgatttgggccacatagatctggttttggccattgactggcaacatggcagtagccaactgcagagccaccagggagcagcctcattctgattgagtataacgaagacgctgatgggaaagagagacacggctgacatcatctctaccgttgagttcaaccacacgggagagctgctggccacaggtgacaagggcggccgggtcgtcatcttccagcgggaaccagagagtaaaaatgcgccccacagccagggcgaatacgacgtgtacagcactttccagagccacgagccggagtttgactatctcaagagcctggagatagaggagaagatcaacaagatcaagtggctcccacagcagaacgccgcccactcactcctgtccaccaacgataaaactatcaaattatggaagattaccgaacgagataaaaggcccgaaggatacaacctgaaggatgaagaggggaaacttaaggacctgtccacggtgacgtcactgcaggtgccagtgctgaagcccatggatctgatggtggaggtgagccctcggaggatctttgccaatggccacacctaccacatcaactccatctccgtcaacagtgactgcgagacctacatgtcggcggatgacctgcgcatcaacctctggcacctggccatcaccgacaggagcttcaacatcgtggacatcaagccggccaacatggaggaccttacggaggtgatcacagcatctgagttccatccgcaccactgcaacctcttcgtctacagcagcagcaagggctccctgcggctctgcgacatgcgggcagctgccctgtgtgacaagcattccaagctctttgaagagcctgaggaccccagtaaccgctcattcttctcggaaatcatctcctccgtgtccgacgtgaagttcagccacagcggccgctacatgctcacccgggactaccttacagtcaaggtctgggacctgaacatggaggcaagacccatagagacctaccaggtccatgactaccttcggagcaagctctgttccctgtacgagaacgactgcattttcgacaagtttgaatgtgcctggaacgggagcgacagcgtcatcatgaccggggcctacaacaacttcttccgcatgttcgatcggaacaccaagcgggacgtgaccctggaggcctcgagggaaagcagcaagccccgggctgtgctcaagccacggcgcgtgtgcgtggggggcaagcgccggcgtgatgacatcagtgtggacagcttggacttcaccaagaagatcctgcacacggcctggcacccggctgagaacatcattgccatcgccgccaccaacaacctgtacatcttccaggacaaggtaaactctgacatgcactaggtatgtgcagttcccggcccctgccacccagcctcatgcaagtcatccccgacatgaccttcacgaccgcaatgcaaggaggggaagaaagtcacagcactgatgaggacagctgcagaggtggcagtgtgtggacacaggaagtttgggccccctccctgccccagctttcctaggccagaattgtgtttggcagtaattgtctgtttaaaaaaataaaaaggaaaggaagcgttcaccgccacaaatcataaaa

SEQ ID NO: 16484 - DNA, 1807 bp, Homo sapiens
  ENST00000382599
gcggccgccgcccgcccaccgcgcgctcgcttgaccgcggcgcccgcccccggccgcccccgcccgtccccctgccgcgatgccctcccttcggggccccggcggcccgcgcccctgctaggctgcggcggcatggcccgcgcgcccggcgcgacctctgcggattgcatcggtgtgtggcggcggggcatgcccagagcaccgggcacggccttcaatgggcgaggacacggacacgcggaaaattaaccacagcttcctgcgggaccacagctatgtgactgaagctgacatcatctctaccgttgagttcaaccacacgggagagctgctggccacaggtgacaagggcggccgggtcgtcatcttccagcgggaaccagagagtaaaaatgcgccccacagccagggcgaatacgacgtgtacagcactttccagagccacgagccggagtttgactatctcaagagcctggagatagaggagaagatcaacaagatcaagtggctcccacagcagaacgccgcccactcactcctgtccaccaacgataaaactatcaaattatggaagattaccgaacgagataaaaggcccgaaggatacaacctgaaggatgaagaggggaaacttaaggacctgtccacggtgacgtcactgcaggtgccagtgctgaagcccatggatctgatggtggaggtgagccctcggaggatctttgccaatggccacacctaccacatcaactccatctccgtcaacagtgactgcgagacctacatgtcggcggatgacctgcgcatcaacctctggcacctggccatcaccgacaggagcttcaacatcgtggacatcaagccggccaacatggaggaccttacggaggtgatcacagcatctgagttccatccgcaccactgcaacctcttcgtctacagcagcagcaagggctccctgcggctctgcgacatgcgggcagctgccctgtgtgacaagcattccaagctctttgaagagcctgaggaccccagtaaccgctcattcttctcggaaatcatctcctccgtgtccgacgtgaagttcagccacagcggccgctacatgctcacccgggactaccttacagtcaaggtctgggacctgaacatggaggcaagacccatagagacctaccaggtccatgactaccttcggagcaagctctgttccctgtacgagaacgactgcattttcgacaagtttgaatgtgcctggaacgggagcgacagcgtcatcatgaccggggcctacaacaacttcttccgcatgttcgatcggaacaccaagcgggacgtgaccctggaggcctcgagggaaagcagcaagccccgggctgtgctcaagccacggcgcgtgtgcgtggggggcaagcgccggcgtgatgacatcagtgtggacagcttggacttcaccaagaagatcctgcacacggcctggcacccggctgagaacatcattgccatcgccgccaccaacaacctgtacatcttccaggacaaggtaaactctgacatgcactaggtatgtgcagttcccggcccctgccacccagcctcatgcaagtcatccccgacatgaccttcacgaccgcaatgcaaggaggggaagaaagtcacagcactgatgaggacagctgcagaggtggcagtgtgtggacacaggaagtttgggccccctccctgccccagctttcctaggccagaattgtgtttggcagtaattgtctgtttaaaaaaataaaaaggaaaggaagcgttcaccgccaca

SEQ ID NO: 16485 - DNA, 1667 bp, Homo sapiens
  ENST00000507294
atcattcaaaggattcctgcggtggtgcagagctgcggcaaagggccctcgcccgtggggttcactctcatcacccagaagcagggagaagggcctgcggctgcaggcctggctgccacaccggcctccagacaacacacagcagaagtaaaatagaaagaagaccttttttgaaatgacctgtgttagtcacctctctcaggatgcgtgaggcggacacgttgaggccacctcagctgatggaagtttccgctgacatcatctctaccgttgagttcaaccacacgggagagctgctggccacaggtgacaagggcggccgggtcgtcatcttccagcgggaaccagagagtaaaaatgcgccccacagccagggcgaatacgacgtgtacagcactttccagagccacgagccggagtttgactatctcaagagcctggagatagaggagaagatcaacaagatcaagtggctcccacagcagaacgccgcccactcactcctgtccaccaacgataaaactatcaaattatggaagattaccgaacgagataaaaggcccgaaggatacaacctgaaggatgaagaggggaaacttaaggacctgtccacggtgacgtcactgcaggtgccagtgctgaagcccatggatctgatggtggaggtgagccctcggaggatctttgccaatggccacacctaccacatcaactccatctccgtcaacagtgactgcgagacctacatgtcggcggatgacctgcgcatcaacctctggcacctggccatcaccgacaggagcttcaacatcgtggacatcaagccggccaacatggaggaccttacggaggtgatcacagcatctgagttccatccgcaccactgcaacctcttcgtctacagcagcagcaagggctccctgcggctctgcgacatgcgggcagctgccctgtgtgacaagcattccaagctctttgaagagcctgaggaccccagtaaccgctcattcttctcggaaatcatctcctccgtgtccgacgtgaagttcagccacagcggccgctacatgctcacccgggactaccttacagtcaaggtctgggacctgaacatggaggcaagacccatagagacctaccaggtccatgactaccttcggagcaagctctgttccctgtacgagaacgactgcattttcgacaagtttgaatgtgcctggaacgggagcgacagcgtcatcatgaccggggcctacaacaacttcttccgcatgttcgatcggaacaccaagcgggacgtgaccctggaggcctcgagggaaagcagcaagccccgggctgtgctcaagccacggcgcgtgtgcgtggggggcaagcgccggcgtgatgacatcagtgtggacagcttggacttcaccaagaagatcctgcacacggcctggcacccggctgagaacatcattgccatcgccgccaccaacaacctgtacatcttccaggacaaggtaaactctgacatgcactaggtatgtgcagttcccggcccctgccacccagcctcatgcaagtcatccccgacatgaccttcacgaccgcaatgcaaggaggggaagaaagtcacagcactgatgaggacagctgcagaggtggcagtgtgtggacacagg

SEQ ID NO: 16486 - DNA, 4538 bp, Homo sapiens
  ENST00000513943
gagggagcctccatctcctctgctgccaaatggaaatcacagtagtgtctcccgcaggggctggcgtgaggttaaaggaggtagcagatatgaaaatgacatataaattgtaaattgcccacagacattagtgtgtgttgcctggtaaccacccagcatttgtggactgcatttacttgggatagcaatagttatattggcattttaatttaatagcattgttatgttcccatcataaaaataatatacactgtgtgtatgcccaccctcatcaaattatatacattaagtatgtgcagcgttttatatattgattgtacctcaatacagctattaaaaaatgatgtaacttcattatagaaaatctagaaaatatggacaagttgaaagaggaggaaatattattttgttccagctaccctaaagctacctccgttcacattttggagaattctcttccagcttttttccccactgcccagtttctttgcttatttcacatggctataatcactgatgtagatcattacaagcattttatacccaattttatatcccgttccttcaccctcagggggttttaatatgaaatagcaagaaccagcgccccatcggggaccctagcacagctgggctgggtggttctggcttctgcccagatgtgtctgggtgtccctgggccagggcaggctgccccacggagggacaatgtcaggacagctgggacctgaccctgttctgactccatgcccggtgggcgtttccgtgttcccacagagctgcttttcttatcttgtctttttaagttcagtgacatgtgcatctgtcttgatggatggatggatacgtccagcccgtcatcccacttctaaccaccctctctcaatcttttctgttgcctcaaagctggcattgactcatggctcagaaggccagggcaggccaggagctgtcctaaaaggcccagactggaaaaagaaaaggcatttcttggatagatatctctggcctggctactgcatacaggcaccatttgaagccgtgaattaagcctgaggctcctgccctcatgaagtttacgttctggccaggaagagagcctacagatgataaaagcctttacagaaagaaaaacatcagattaggttggggcagggatggtcagggtgtcctgtatgagggtgctggggtgcagacagcagtttcagcaaggtgatccaagctgtgctcacgggaaggcagcagtggggcagaattggaagaataggaaggagccatgctggtacccagggaaagccactgcaggccgagagagcaggtcttgggacagcaggtggccaggacttttgggaaagggcaaggagcctggtgtttggaggggaataagcaggtggagagcagtagatgaggctggggaaggggaggaggtaccttttgctgagttaaaaacacgagaccccgtgcatacaacagtaaatgttttcatcatcttgcatctgcgattctgtggtctgggcttggctgggcttgccctgctctgtgggtcagtggggccctgctggaggctgggcttggccgggggttgggggggttcttctgcacccactcttcctcctccccctcaggggccagtgggccagcctgcgcaggtcctgctcctggtaccgccagaggcgttgatggcaacccccagtacctaagcccctttgcatctctgtttgcggcttgtcgaattgccgttctgcaggccaaagcaaaacacagggacaagcccagaatcaaggtggggggcagagaacaggtcacctggcccaccatgggaggggtgaaggtttggctccagatgcggcccacctgggcctcggcaggtgggggctgcctttagaacactctgtgcttttctctgagtacacaatgggagccgctggagggttttgagcaggggagtgccaggatcagtcctgggtgttaccagcctctctgctgccagtctgttgaggctacgtcatagccagggagaaagagctgtggcagtcatccagtgagaggtgggagagtggctggcatcccgatatgctgtgaaggctgagcaggcaggattggatgtggggtgtgtgtgtgtgtgtgtgtgtgtgtgtgtgtgtgtgtgtgagagagagagagagagagagagagagagagagagagagagagagagagagagaacgagaaactccaaggcttgggcctgagcaagtgaacaatagagctgtcatcacctgagactggggaagctgcagaggatgaggctgaggagggatcagaattcagttatggtgaccaatgaagggttttgaatagagggacacagggatgcactggctcaggagtttggtcatcacgttggccgccagagggagaacagaggctgggacagggaaccctgtggagtgtcctctctgtggctacagggagcaacggtcagatctgtggctggtttgaaagtagatccattttgctaaaggtggtatcacagattttggagactacagaatccaggccaggagagcaaagaacgacagaggtcccattcacagcagcgggccatcccgggctcctactagcttttgctgcttgggcctatggggatggtattctagaactttccatcttccaagacatactggaaatgtggatttttataggaaatcttctacttttcaaatattaagaatgacttcaaattaaaagtaataatcattttggggctgcagtaaaacttgttggtggagcaggcctcaggcttcaggttggtgagctgtcctccagtgggggtttctcttccaggctagggccttgtcctcccctgctctcccccactcccagggctggccacccagaatgtgcaggccactcatctctgtgactcgtagaacctgagaatgttggtgatggaaggggtgttcccctagttcccacatgcaaaaagtggggcctggagatggggctgtcttttttctccaaacacttgcccatccaggaaggccagccctgggcattgaagactccaggtatgggggtgactccataaggagaggttcctgagtgacctgaagaaacatggttgggatgaagtgcagggagggtcagggcaggcagggctgagcttcgcttctgcgagcagagattagagagcgatcccagaggcctgcctggaggtggggccacagagcaggagtctgaaggagagggggtaattcacctctgtcctactgtgtgggaagccctgagtgggcccctagcagagggttgccttgcgcttatctatggagatattgggaagggcttccctgacccaggttgctggagcatgggggcctgggtggcaggggtaggtgtgggagattcaagacaggaggatgaggccacatccaggtggcttcagataccaccgtgagtcccatagagtgtccagttactataaagtctgccagccactgtggtcgccccaggcctgtgccaagtcccgagatctctgccctgcagccagtgcagagggaagaggagggcaggaggggacaggttggtggcccctcgccgatgctcctgacccctcaggctccctgctgcctcctgcccagggctgtggggcctcggggagcggggagctcgccattgctgtggcactgttgagcacccgggagaggcgggttctgacagccaccccttcccgtcttgctgttcccctcccagctgacatcatctctaccgttgagttcaaccacacgggagagctgctggccacaggtgacaagggcggccgggtcgtcatcttccagcgggaaccagagagtaaaaatgcgccccacagccagggcgaatacgacgtgtacagcactttccagagccacgagccggagtttgactatctcaagagcctggagatagaggagaagatcaacaagatcaagtggctcccacagcagaacgccgcccactcactcctgtccaccaacgataaaactatcaaattatggaagattaccgaacgagataaaaggcccgaaggatacaacctgaaggatgaagaggggaaacttaaggacctgtccacggtgacgtcactgcaggtgccagtgctgaagcccatggatctgatggtggaggtgagccctcggaggatctttgccaatggccacacctaccacatcaactccatctccgtcaacagtgactgcgagacctacatgtcggcggatgacctgcgcatcaacctctggcacctggccatcaccgacaggagcttcaacatcgtggacatcaagccggccaacatggaggaccttacggaggtgatcacagcatctgagttccatccgcaccactgcaacctcttcgtctacagcagcagcaagggctccctgcggctctgcgacatgcgggcagctgccctgtgtgacaagcattccaagctctttgaagagcctgaggaccccagtaaccgctcattcttctcggaaatcatctcctccgtgtccgacgtgaagttcagccacagc

SEQ ID NO: 16487 - DNA, 579 bp, Homo sapiens
  ENST00000314348
atcctcgtgggtgtgcgttgtctcattgtgactttgatttggatttccctaatgactcatcacgttgagcaacctttcctgtgcatgctgaccattcggtgaaatctgacatcatctctaccgttgagttcaaccacacgggagagctgctggccacaggtgacaagggcggccgggtcgtcatcttccagcgggaaccagagataaaactatcaaattatggaagattaccgaacgagataaaaggcccgaaggatacaacctgaaggatgaagaggggaaacttaaggacctgtccacggtgacgtcactgcaggtgccagtgctgaagcccatggatctgatggtggaggtgagccctcggaggatctttgccaatggccacacctaccacatcaactccatctccgtcaacagtgactgcgagacctacatgtcggcggatgacctgcgcatcaacctctggcacctggccatcaccgacaggagcttcaacatcgtggacatcaagccggccaacatggaggaccttacggaggtgatcacagcatctgagttccatccgcaccactgcaacct

SEQ ID NO: 16488 - DNA, 533 bp, Homo sapiens
  ENST00000509917
tgcaaaaagtggggcctggagatggggctgtcttttttctccaaacacttgcccatccaggaaggccagccctgggcattgaagactccagctgacatcatctctaccgttgagttcaaccacacgggagagctgctggccacagagtaaaaatgcgccccacagccagggcgaatacgacgtgtacagcactttccagagccacgagccggagtttgactatctcaagagcctggagatagaggagaagatcaacaagatcaagtggctcccacagcagaacgccgcccactcactcctgtccaccaacgataaaactatcaaattatggaagattaccgaacgagataaaaggcccgaaggatacaacctgaaggatgaagaggggaaacttaaggacctgtccacggtgacgtcactgcaggtgccagtgctgaagcccatggatctgatggtggaggtgagccctcggaggatctttgccaatggccacacctaccacatcaactccatctccgtcaacagtgactgcg

SEQ ID NO: 16489 - DNA, 579 bp, Homo sapiens
  ENST00000507028
ataatccattgccagatcctcctgggaggcccgcctgcccgggcccctccctgtcctccagaggcagggtccctgagtgggagggagaaggcggctggtttggggctggcctttttattcctgctgacatcatctctaccgttgagttcaaccacacgggagagctgctggccacaggtgacaagggcggccgggtcgtcatcttccagcgggaaccagagaactctgggtaagacagcagtggcctggacaacctgcccaggaccacgtttctggaacactgaaagagcctcgggacaaaagcccatttactgagaacacttgctaagtattctggagttgcttctggtttactctgcactgctcacctccgagggccagatccacacccctgtgacagatgcggaaactcagagaagccacccagctagtgaacagcagacctggctgcccgacgccaggacagtggccagcaacgtcacacaccacccggcctcagagagggcgtctccccccgcaaacacggactgtgcctggaattagatgcagaagacatccaggaaaccaaggaggagggag

SEQ ID NO: 16490 - DNA, 3868 bp, Homo sapiens
  ENST00000304338
gggccgtgctcttgctcccgccgcctggcagcctcacgctcggctccagcggccaagagccggagaaagtcctgctggtgggcggccgcggggctgagggcgtccggcatcccggggccgctccggcccgggcggcgagagtgcccggcggtccatgcatccgccgccgcccgccgccgcgatggatttcagtcagaacagcctgttcggttacatggaggacctgcaggagctcaccatcatcgagaggccggtccgccggagcctcaagacaccggaagaaatagaaagattgacagtcgatgaagacctcagtgatattgaaagggctgtttatctgctcagtgctggtcaagatgtccaaggaacaagtgtgattgcaaatctcccatttttgatgcgacagaatcccactgagacgcttcggagagtgttgccaaaagtcagagaagccctgcatgttgcaggagtggaaatgcagttaacggctgcgatgtcatttctgaccattctgcaggacgaatcagtgtcaattcatgcatatacccactcattcctccaagtcattctcctgcatctggagcacagggacacaggtgtcagcaatgcatggctggaaactcttctgtctgttatagaagtattgccaaaagaaaccctacggcatgagattttgaatccacttgtttccaaggcacaactttcccaaacagtccagtctcgtttagttagttgtaaaattttaggaaaattgaccaacaaatttgatgcccacaccattaagcgagaaatacttcctctggtaaaatcactctgtcaagatgtagaatatgaagttcgatcttgtatgtgtcggcaattagaaaatatagcccagggcattgggacagaacttacaaaaagtgtggtgctccctgaattaatagaactttctagggatgaaggcagcagtgtacgacttgcagcttttgaaactttggttaatctgcttgatatatttgatacagatgacagaagtcaaactatacttcccttagtgaaatcattttgtgaaaaatctttcaaagcagatgaatcaattcttatttctttatctttccatttaggaaaactatgtcatggactatatggaattttcactccagatcagcacttgagatttttggaattttataagaaactttgtacattgggtttgcaacaagaaaatggacacaatgaaaaccagattccaccccaaatcctagagcaggagaagaaatatatttcagtacggaagaactgtgcttataactttccggccatgattgtttttgttgatcctaaaaacttccacatggaactctattctacattcttctgcctttgccatgaccctgaagtaccagtcagatacactattgctatttgcttttatgaagtatctaagcttctgaattctggagtatatttaatacataaagaactaataacattattacaagatgaatcactggaggtactagatgctcttatagatcatcttccagaaatcttggaacttatgtctactggtggagaaagcagtgttcaagaaaataagttatcttctctgcctgacttgattccagcactcacagctgctgaacagcgagctgcagcctctttaaaatggagaactcatgagaagctacttcagaaatatgcctgcctgccacatgtcatatcaagcgatcagatttattaccgtttcttacaaagaatgttcacaatcatgatgacaaataatgttttacctgtccaaaaggcggcttcacgaactctatgcatttttctgcgttataatcgtaaacaagaacagagacatgaggtcattcaaaaattaattgaacaattgggccaaggaaaaagttactggaatagacttcgatttttggatacctgtgaatttattatagagatattttcaaaatcatttttctgtaaatatttctttctacctgctattgaactgacacatgatccagtagcaaatgtgagaatgaaactttgctacctgttgcccaaagtgaaatctactctgaagattcctgctgataagcatctacttcagcagttagaaatgtgtgtgaggaaactcctgtgtcaagaaaaagataaagatgttctggctattgtaaaaagaactgtattagagttggacagaatggaaatgtctatggatgcttttcagaaaaagttttatgagaaagatttgttggatcaagagaaagaaagagaagaactacttcttttggaaatggaacaattagagaaagaaaagcaacagaatgatggaaggcccatgagtgataaaatgtttgaaaagaaacgtagagacactaagacaccaacgcaaagtctgcccaagaacatccccatttctgttcctggaccctcttctgtcaccccatcgacaagtaaagaaatcaagaaatccaaactgattcgaagccagtcttttaataatcaagcttttcatgcaaaatatggcaacttagagaaatgtgctagtaaaagttctacaacaggatatacaacttctgtctcagggttaggaaagacttctgtgctttcactagctgatgattcattccggactcgtaatgccagtagcgttccatcttccttttctcctaatactcccttaccgagtacttcccgtgggacaggtaactcagttgaccccaagagcagtggaagtaaagatacacaaccacggaaggctaccttaaaatccagaaaatccaatccttaaatcaactgcttgatgaaggaggcaaaacaaaggcagcaggagataatgtgattggtacacaaaagctaaagcagtggctggggctttgtttttaaattttgggtttttttttttgttgttgttaatgagcagaaagagagacataatgacagctgatgttaaacttttcatatttcaaattagattccctaggaggtataatatatatttcttgagtaataatgtggttacggaattccaatgttatagtgaagtgtaatgaaaaacatctctaggaatgtgctttaaccactgctgcaaaagagacaagtctgcatttatttgtgcaggaaaccagccatttaattgttctagagttttagcatttaaaaatcgtatgaaagtctacatcagctgaattgtcctagcttgataagcacttggagggggacttggaaggtgagaaagatactgcattttctcatgagtctccaagcccacttgaaaagtcacactgaaaggatgcaaatagccgtctgcgattttggcggccctccggattgtggtgacaatatgttgtacccggacattcccaaatttaaatttggcagtgaaaattccacaaagatttctggtaactttgagctataaataccttaaaaataatagattgatgattttctttatttcctagagaatttattttataaatactttgtttacattttagattgtacttgtctttatttaaaatgatgaatctagtctgaatcagctgttattccaagctatcatgcttaagctatgtcaacagcatttatttgtactaatgctaatatttccatcaaaatttgcctgtggaatatatacagttcttaattttaaactgtcagttcttgagatataccgtgtgaagctattgtcagcttctctatttcaaaatgcaatcagcatataactatattgatattagaagatatttgttttttaaaatatattgatgtatgataaagatgatctaatttgtgaatgcatatgtatgtgtggttactttttataatgtgaaataatgaataatgaatttactcaaaataaaacataggttaatgagat

SEQ ID NO: 16491 - DNA, 876 bp, Homo sapiens
  ENST00000328839
ggcagcctcacgctcggctccagcggccaagagccggagaaagtcctgctggtgggcggccgcggggctgagggcgtccggcatcccggggccgctccggcccgggcggcgagagtgcccggcggtccatgcatccgccgccgcccgccgccgcgatggatttcagtcagaacagcctgttcggttacatggaggacctgcaggagctcaccatcatcgagaggccggtccgccggagcctcaagacaccggaagaaatagaaagattgacagtcgatgaagacctcagtgatattgaaagggctgtttatctgctcagtgctggtcaagatgtccaaggaacaagtgtgattgcaaatctcccatttttgatgcgacagaatcccactgagacgcttcggagagtgttgccaaaagtcagagtccatgaggatgcacacttatttatccagagagtatggatctcacatatgtttgtccagagggtgtgactctgtggaggagaacacttactgtggacagtcccagatgttgaagtcagcacaacaagagaaaaacccaaatcctgataagacttgaggatttttcgaaaattaaatgcaaaatagttggggcaaatgttgctgcgggagtcaagactaagtaatacagtaagaagatatgaagttggagagcttctcatgttcttcctttgtataaagtttgcatacgtacaaaacccaggactttaatgactttaagagggggcagaattgcatctcttggaagttaacagactcatgtgaactggaatgtacgttgtggccctcacaattgattttaatatttatttgcaaagtcctttctgtttctaaataaaagctgtgccttctgaaa

SEQ ID NO: 16492 - DNA, 564 bp, Homo sapiens
  ENST00000553661
agcgccagcaaacctagtttacggaccggacccctttcccctggccattgcttaattagctgccttagcgcctctcactcccacctgccgcaatatctcaaatctctggtttttttccagccccggagtttatttccttccctcccccactccagatcttgtccttttcatgcctactcggctgcagtcttcatccatctcccttttagcatttcttggggtggaaaatgctggagaaatagccttgaagtattagagataaaaagtacaccggaagaaatagaaagattgacagtcgatgaagacctcagtgatattgaaagggctgtttatctgctcagtgctggtcaagatgtccaaggaacaagtgtgattgcaaatctcccatttttgatgcgacagaatcccactgagacgcttcggagagtgttgccaaaagtcagagaagccctgcatgttgcaggagtggaaatgcagttaacggctgcgatgtcatttctgaccattctgcaggacgaatcagtgtcaattcatgcatatacccactcattcctccaagtcatt

SEQ ID NO: 16493 - DNA, 564 bp, Homo sapiens
  ENST00000556884
agtgccattctgcaactgctgcagccagctgtctgtctgtaattatgaccttacggaagtccggcccagcagaaggaggacttactgctcattaacatcaagggtggccatcactattaagctccctgggtgccactgcatttatgcccattacctctaataatcaccggaattttgcaaggttcacgttggctatgttggggacaactttagaagaggaaaggcagaagcagaggcacccttgatccagacaccggaagaaatagaaagattgacagtcgatgaagacctcagtgatattgaaagggctgtttatctgctcagtgctggtcaagatgtccaaggaacaagtgtgattgcaaatctcccatttttgatgcgacagaatcccactgagacgcttcggagagtgttgccaaaagtcagatgtcttccaaggtccatgaggatgcacacttatttatccagagagtatggatctcacatatgtttgtccagagggtgtgactctgtggaggagaacacttactggaagccctgcatgttgcaggagtggaaatgcag

SEQ ID NO: 16494 - DNA, 680 bp, Homo sapiens
  ENST00000555690
gggccgtgctcttgctcccgccgcctggcagcctcacgctcggctccagcggccaagagccggagaaagtcctgctggtgggcggccgcggggctgagggcgtccggcatcccggggccgctccggcccgggcggcgagagtgcccggcggtccatgcatccgccgccgcccgccgccgcgatggatttcagtcagaacagcctgttcggttacatggaggacctgcaggagctcaccatcatcgagaggccggtccgccggagcctcaagacaccggaagaaatagaaagattgacagtcgatgaagacctcagtgatattgaaagggctgtttatctgctcagtgctggtcaagatgtccaaggaacaagtgtgattgcaaatctcccatttttgatgcgacagaatcccactgagacgcttcggagagtgttgccaaaagtcagatgtcttccaaggtccatgaggatgcacacttatttatccagagagtatggatctcacatatgtttgtccagagggtgtgactctgtggaggagaacacttactggaagccctgcatgttgcaggagtggaaatgcagttaacggctgcgatgtcatttctgaccattctgcaggacgaatcagtgtcaattcatgcatatacccactcattcctccaagtcattctcctgca

SEQ ID NO: 16495 - DNA, 589 bp, Homo sapiens
  ENST00000556470
gaagccacgatgtgattttcaagctgcagtccaggagctagaaggataaaaacagaaaaatacagccccctccccaaactccccaaaccacccaattagagacctccgtgattgatgtcgcctgacaccggaagaaatagaaagattgacagtcgatgaagacctcagtgatattgaaagggctgtttatctgctcagtgctggtcaagatgtccaaggaacaagtgtgattgcaaatctcccatttttgatgcgacagaatcccactgagacgcttcggagagtgttgccaaaagtcagagaagccctgcatgttgcaggagtggaaatgcagttaacggctgcgatgtcatttctgaccattctgcaggacgaatcagtgtcaattcatgcatatacccactcattcctccaagtcattctcctgcatctggagcacagggacacaggtgtcagcaatgcatggctggaaactcttctgtctgttatagaagtattgccaaaagaaaccctacggcatgagattttgaatccacttgtttccaaggcacaactttcccaaacagtccagtctcgtttagttagttgt

SEQ ID NO: 16496 - DNA, 564 bp, Homo sapiens; identical to SEQ ID NO: 16493
  ENST00000630860

SEQ ID NO: 16497 - DNA, 3868 bp, Homo sapiens; identical to SEQ ID NO: 16490
  ENST00000619905

SEQ ID NO: 16498 - DNA, 876 bp, Homo sapiens; identical to SEQ ID NO: 16491
  ENST00000614957

SEQ ID NO: 16499 - DNA, 564 bp, Homo sapiens; identical to SEQ ID NO: 16492
  ENST00000628432

SEQ ID NO: 16500 - DNA, 589 bp, Homo sapiens; identical to SEQ ID NO: 16495
  ENST00000630154

SEQ ID NO: 16501 - DNA, 4035 bp, Homo sapiens
  ENST00000359139
ggagcgcgtgcccgtgcgccgccgccgccattttggagcgatcggagtgccgcccgcggccccgagtcggtctcgagccgccggccggccgtgccggtgtccgtaggcgctgcgccctcggccgggcccatgtgtgtgcggcccgcccgaggccgcccgggctttgcctccaccagcgccctggcctccgctcgggcctccacacgggcctccgaagagctgccgcgacgcccggcccgcagggcaggtaaagagattataaatcttccactgaatgaaaaaaattttcttaaagctgcatatactccaagaaaaaaaccacaaatgtttttctgttttgcctgaatacatgatttaaacaagagatttccacagaagctctgcggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtcgcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaccaccattggtgtgctggaggagcccctggggaatgcccgtctgcatggcgcccgcctcatggcagcactgctgcacacaaacacacccagcatcaaccaggagctctgccggctcaacacgatggacttactgctggacttgttctttaagtacacctggaataactttttgcacttccaagtggaactatgcatagccgctattctctcccacgctgcccgtgaggagaggacagaagccagcggatccgagagcagggtggagcctccgcatgagaacgggaaccggagcctggagactccccagccggccgccagcctccctgacaacacaatggtgacccacctgttccagaagtgctgcctggtgcagaggatcctggaggcctgggaagccaacgaccacacgcaggcagcgggtggcatgagacgtgggaacatgggccacctcacacggatcgccaacgcggtggtgcagaacctggagcggggccctgtgcagacgcacatcagcgaggtcatccgagggctccctgcggactgccgtggccgctgggagagcttcgtggaggagacgctgacggagacgaaccgcaggaacactgtggacctggccttctctgactaccagatccagcagatgacagccaacttcgtggatcagtttggcttcaatgatgaggagtttgccgaccaggacgacaacatcaatgccccgtttgacaggatcgcagagatcaacttcaacatcgacgctgacgaggacagtcccagcgcagctctgtttgaggcctgctgcagtgaccgcatccagccctttgatgatgatgaggacgaggacatctgggaggacagtgacactcgctgtgctgcccgggtgatggccagacccaggtttggagccccccatgcttcagagagttgctcaaagaatggcccagagcgtggaggccaggatgggaaggcgagcttggaagcacacagagatgcacctggggcaggtgccccaccggcccccgggaagaaggaagcgccccctgtggagggtgactcagaagcaggcgccatgtggacggcagtgtttgatgagccagcgaactcaacgcccacagccccaggagtggtgagggacgtgggttccagtgtgtgggcagctggcacctcagctccagaggagaaaggctgggccaagttcactgacttccaacctttctgctgctccgagtcagggcccaggtgcagctctccggtggacacagaatgcagccatgctgagggcagccggagccaaggccctgagaaagccttcagcccggcttctccatgtgcctggaacgtgtgtgtcaccaggaaggcccccctgctggcctctgacagtagctcctctgggggctcccacagcgaggatggcgaccagaaggcagcgagtgccatggatgcggtgagcaggggtcccggccgggaggcccccccgctgcccacagtggccaggacagaggaggctgtcggcagggtcgggtgtgctgacagccggctgttaagccctgcctgccccgcgccaaaggaagtgactgctgccccagccgtggctgtgccccccgaggctactgtggccatcaccacagcactgagcaaggctggccccgccatacccaccccagcagtctcttctgcactggccgtggcggtccccctagggcccatcatggcagtcacagcagccccagccatggtggccaccctggggacagtgacaaaggacggacagatgccccgccagaaggagctgccttaaatggcccagtgtgatgctgctgccgcccggccacggcccaccctggtcaggctgcctccttaatcgagaaaactacctggtgatgcaatcttttttttttttaatttaatttaattttaaaataaatgctgcattggtaaagctggcagttgaaaccagttggacggcccagcttgcgtctcttctgcctgagtgggcctctcaggtcactcgtgccctgctggaggacagaggggcacctcagccgcccccaagcccagagcacagcaataaggtcggcctgcaggagccggggtgggggtgggggtggggggggcaggaccctgagatgccaccaggacctgatgggccaggaagggcgtggacatggaggctgtttttacagttttttttttgttgttgttttgtttttaaagaatacagaaggagccaagcttttttgcactttgtatccagctgcaagctcagggcagagtcaagggcctgggttggaaaaacctgactcacaggaatgcataattgacccttgcagctacccaatagcccttggagctggcactgaaccaggctgcaagatttgactgccttaaaaacacaaggccctctaggcctggcagggatgtccctgtgcccagcacagggtgcctggcagggggagaccacaggtatgcaggtggggggacatggtgtggcactaggggctcgaagactggtttctagcactaccggtcacggccatgtcgtcctagaagggtccagaagattattttacgttgagtccatttttaatgttctgatcacctgacagggcaccccaaacccccaactcccaataaaagccgtgacgttcggacaaa

SEQ ID NO: 16502 - DNA, 3304 bp, Homo sapiens
  ENST00000395741
cgccgccgccattttggagcgatcggagtgccgcccgcggccccgagtcggtctcgagccgccggccggccgtgccggtgtccgtaggcgctgcgccctcggccgggcccatgtgtgtgcggcccgcccgaggccgcccgggctttgcctccaccagcgccctggcctccgctcgggcctccacacgggcctccgaagagctgccgcgacgcccggcccgcagggcaggtaaagagattataaatcttccactgaatgaaaaaaattttcttaaagctgcatatactccaagaaaaaaaccacaaatgtttttctgttttgcctgaatacatgatttaaacaagagatttccacagaagctctgcggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtccaggcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaccaccattggtgtgctggaggagcccctggggaatgcccgtctgcatggcgcccgcctcatggcagcactgctgcacacaaacacacccagcatcaaccaggagctctgccggctcaacacgatggacttactgctggacttgttctttaagtacacctggaataactttttgcacttccaagtggaactatgcatagccgctattctctcccacgctgcccgtgaggagaggacagaagccagcggatccgagagcagggtggagcctccgcatgagaacgggaaccggagcctggagactccccagccggccgccagcctccctgacaacacaatggtgacccacctgttccagaagtgctgcctggtgcagaggatcctggaggcctgggaagccaacgaccacacgcaggcagcgggtggcatgagacgtgggaacatgggccacctcacacggatcgccaacgcggtggtgcagaacctggagcggggccctgtgcagacgcacatcagcgaggtcatccgagggctccctgcggactgccgtggccgctgggagagcttcgtggaggagacgctgacggagacgaaccgcaggaacactgtggacctggccttctctgactaccagatccagcagatgacagccaacttcgtggatcagtttggcttcaatgatgaggagtttgccgaccaggacgacaacatcaatgccccgtttgacaggatcgcagagatcaacttcaacatcgacgctgacgaggacagtcccagcgcagctctgtttgaggcctgctgcagtgaccgcatccagccctttgatgatgatgaggacgaggacatctgggaggacagtgacactcgctgtgctgcccgggtgatggccagacccaggtttggagccccccatgcttcagagagttgctcaaagaatggcccagagcgtggaggccaggatgggaaggcgagcttggaagcacacagagatgcacctggggcaggtgccccaccggcccccgggaagaaggaagcgccccctgtggagggtgactcagaaggcgccatgtggacggcagtgtttgatgagccagcgaactcaacgcccacagccccaggagtggtgagggacgtgggttccagtgtgtgggcagctggcacctcagctccagaggagaaaggctgggccaagttcactgacttccaacctttctgctgctccgagtcagggcccaggtgcagctctccggtggacacagaatgcagccatgctgagggcagccggagccaaggccctgagaaagccttcagcccggcttctccatgtgcctggaacgtgtgtgtcaccaggaaggcccccctgctggcctctgacagtagctcctctgggggctcccacagcgaggatggcgaccagaaggcagcgagtgccatggatgcggtgagcaggggtcccggccgggaggcccccccgctgcccacagtggccaggacagaggaggctgtcggcagggtcgggtgtgctgacagccggctgttaagccctgcctgccccgcgccaaaggaagtgactgctgccccagccgtggctgtgccccccgaggctactgtggccatcaccacagcactgagcaaggctggccccgccatacccaccccagcagtctcttctgcactggccgtggcggtccccctagggcccatcatggcagtcacagcagccccagccatggtggccaccctggggacagtgacaaaggacgggaagacagatgccccgccagaaggagctgccttaaatggcccagtgtgatgctgctgccgcccggccacggcccaccctggtcaggctgcctccttaatcgagaaaactacctggtgatgcaatcttttttttttttaatttaatttaattttaaaataaatgctgcattggtaaa

SEQ ID NO: 16503 - DNA, 3293 bp, Homo sapiens
  ENST00000395744
ccattttggagcgatcggagtgccgcccgcggccccgagtcggtctcgagccgccggccggccgtgccggtgtccgtaggcgctgcgccctcggccgggcccatgtgtgtgcggcccgcccgaggccgcccgggctttgcctccaccagcgccctggcctccgctcgggcctccacacgggcctccgaagagctgccgcgacgcccggcccgcagggcaggtaaagagattataaatcttccactgaatgaaaaaaattttcttaaagctgcatatactccaagaaaaaaaccacaaatgtttttctgttttgcctgaatacatgatttaaacaagagatttccacagaagctctgcggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtcgcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaccaccattggtgtgctggaggagcccctggggaatgcccgtctgcatggcgcccgcctcatggcagcactgctgcacacaaacacacccagcatcaaccaggagctctgccggctcaacacgatggacttactgctggacttgttctttaagtacacctggaataactttttgcacttccaagtggaactatgcatagccgctattctctcccacgctgcccgtgaggagaggacagaagccagcggatccgagagcagggtggagcctccgcatgagaacgggaaccggagcctggagactccccagccggccgccagcctccctgacaacacaatggtgacccacctgttccagaagtgctgcctggtgcagaggatcctggaggcctgggaagccaacgaccacacgcaggcagcgggtggcatgagacgtgggaacatgggccacctcacacggatcgccaacgcggtggtgcagaacctggagcggggccctgtgcagacgcacatcagcgaggtcatccgagggctccctgcggactgccgtggccgctgggagagcttcgtggaggagacgctgacggagacgaaccgcaggaacactgtggacctggccttctctgactaccagatccagcagatgacagccaacttcgtggatcagtttggcttcaatgatgaggagtttgccgaccaggacgacaacatcaatgccccgtttgacaggatcgcagagatcaacttcaacatcgacgctgacgaggacagtcccagcgcagctctgtttgaggcctgctgcagtgaccgcatccagccctttgatgatgatgaggacgaggacatctgggaggacagtgacactcgctgtgctgcccgggtgatggccagacccaggtttggagccccccatgcttcagagagttgctcaaagaatggcccagagcgtggaggccaggatgggaaggcgagcttggaagcacacagagatgcacctggggcaggtgccccaccggcccccgggaagaaggaagcgccccctgtggagggtgactcagaaggcgccatgtggacggcagtgtttgatgagccagcgaactcaacgcccacagccccaggagtggtgagggacgtgggttccagtgtgtgggcagctggcacctcagctccagaggagaaaggctgggccaagttcactgacttccaacctttctgctgctccgagtcagggcccaggtgcagctctccggtggacacagaatgcagccatgctgagggcagccggagccaaggccctgagaaagccttcagcccggcttctccatgtgcctggaacgtgtgtgtcaccaggaaggcccccctgctggcctctgacagtagctcctctgggggctcccacagcgaggatggcgaccagaaggcagcgagtgccatggatgcggtgagcaggggtcccggccgggaggcccccccgctgcccacagtggccaggacagaggaggctgtcggcagggtcgggtgtgctgacagccggctgttaagccctgcctgccccgcgccaaaggaagtgactgctgccccagccgtggctgtgccccccgaggctactgtggccatcaccacagcactgagcaaggctggccccgccatacccaccccagcagtctcttctgcactggccgtggcggtccccctagggcccatcatggcagtcacagcagccccagccatggtggccaccctggggacagtgacaaaggacgggaagacagatgccccgccagaaggagctgccttaaatggcccagtgtgatgctgctgccgcccggccacggcccaccctggtcaggctgcctccttaatcgagaaaactacctggtgatgcaatcttttttttttttaatttaatttaattttaaaataaatgctgcattggtaaa

SEQ ID NO: 16504 - DNA, 3415 bp, Homo sapiens
  ENST00000216061
atatactccaagaaaaaaaccacaaatgtttttctgttttgcctgaatacatgatttaaacaagagatttccacagaagggcgctttcatggaactatatgatcatatgggcaacattctgttgcagtctaccttctgtctgacggatatgccatcctgaaaaaggaaagaagctgaacttcaagttcctttcatttagccttgggcttccaccttctctgtggctagaaacaggaccgtccagaagtcacctgtaactgccctatcttgcaagttctgattttggcaaaaaaaaaaaaaaaaagccttgacaaggttggattcacttctttccctggattgtgtgtcatccaactctgcggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtcgcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaccaccattggtgtgctggaggagcccctggggaatgcccgtctgcatggcgcccgcctcatggcagcactgctgcacacaaacacacccagcatcaaccaggagctctgccggctcaacacgatggacttactgctggacttgttctttaagtacacctggaataactttttgcacttccaagtggaactatgcatagccgctattctctcccacgctgcccgtgaggagaggacagaagccagcggatccgagagcagggtggagcctccgcatgagaacgggaaccggagcctggagactccccagccggccgccagcctccctgacaacacaatggtgacccacctgttccagaagtgctgcctggtgcagaggatcctggaggcctgggaagccaacgaccacacgcaggcagcgggtggcatgagacgtgggaacatgggccacctcacacggatcgccaacgcggtggtgcagaacctggagcggggccctgtgcagacgcacatcagcgaggtcatccgagggctccctgcggactgccgtggccgctgggagagcttcgtggaggagacgctgacggagacgaaccgcaggaacactgtggacctggtgagcactcaccaccttcactcctcaagtgaggacgaggacattgagggtgctttccctaacgagctgtcccttcagcaggccttctctgactaccagatccagcagatgacagccaacttcgtggatcagtttggcttcaatgatgaggagtttgccgaccaggacgacaacatcaatgccccgtttgacaggatcgcagagatcaacttcaacatcgacgctgacgaggacagtcccagcgcagctctgtttgaggcctgctgcagtgaccgcatccagccctttgatgatgatgaggacgaggacatctgggaggacagtgacactcgctgtgctgcccgggtgatggccagacccaggtttggagccccccatgcttcagagagttgctcaaagaatggcccagagcgtggaggccaggatgggaaggcgagcttggaagcacacagagatgcacctggggcaggtgccccaccggcccccgggaagaaggaagcgccccctgtggagggtgactcagaaggcgccatgtggacggcagtgtttgatgagccagcgaactcaacgcccacagccccaggagtggtgagggacgtgggttccagtgtgtgggcagctggcacctcagctccagaggagaaaggctgggccaagttcactgacttccaacctttctgctgctccgagtcagggcccaggtgcagctctccggtggacacagaatgcagccatgctgagggcagccggagccaaggccctgagaaagcctcacaggcctcctactttgcagtcagcccggcttctccatgtgcctggaacgtgtgtgtcaccaggaaggcccccctgctggcctctgacagtagctcctctgggggctcccacagcgaggatggcgaccagaaggcagcgagtgccatggatgcggtgagcaggggtcccggccgggaggcccccccgctgcccacagtggccaggacagaggaggctgtcggcagggtcgggtgtgctgacagccggctgttaagccctgcctgccccgcgccaaaggaagtgactgctgccccagccgtggctgtgccccccgaggctactgtggccatcaccacagcactgagcaaggctggccccgccatacccaccccagcagtctcttctgcactggccgtggcggtccccctagggcccatcatggcagtcacagcagccccagccatggtggccaccctggggacagtgacaaaggacgggaagacagatgccccgccagaaggagctgccttaaatggcccagtgtgatgctgctgccgcccggccacggcccaccctggtcaggctgcctccttaatcgagaaaactacctggtgatgcaatcttttttttttttaatttaatttaattttaaaataaatgctgcattggtaaagctggcagttgaaacca

SEQ ID NO: 16505 - DNA, 2199 bp, Homo sapiens
  ENST00000401672
gctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaccaccattggtgtgctggaggagcccctggggaatgcccgtctgcatggcgcccgcctcatggcagcactgctgcacacaaacacacccagcatcaaccaggagctctgccggctcaacacgatggacttactgctggacttgttctttaagtacacctggaataactttttgcacttccaagtggaactatgcatagccgctattctctcccacgctgcccgtgaggagaggacagaagccagcggatccgagagcagggtggagcctccgcatgagaacgggaaccggagcctggagactccccagccggccgccagcctccctgacaacacaatggtgacccacctgttccagaagtgctgcctggtgcagaggatcctggaggcctgggaagccaacgaccacacgcaggcagcgggtggcatgagacgtgggaacatgggccacctcacacggatcgccaacgcggtggtgcagaacctggagcggggccctgtgcagacgcacatcagcgaggtcatccgagggctccctgcggactgccgtggccgctgggagagcttcgtggaggagacgctgacggagacgaaccgcaggaacactgtggacctggtgagcactcaccaccttcactcctcaagtgaggacgaggacattgagggtgctttccctaacgagctgtcccttcagcaggccttctctgactaccagatccagcagatgacagccaacttcgtggatcagtttggcttcaatgatgaggagtttgccgaccaggacgacaacatcaatgccccgtttgacaggatcgcagagatcaacttcaacatcgacgctgacgaggacagtcccagcgcagctctgtttgaggcctgctgcagtgaccgcatccagccctttgatgatgatgaggacgaggacatctgggaggacagtgacactcgctgtgctgcccgggtgatggccagacccaggtttggagccccccatgcttcagagagttgctcaaagaatggcccagagcgtggaggccaggatgggaaggcgagcttggaagcacacagagatgcacctggggcaggtgccccaccggcccccgggaagaaggaagcgccccctgtggagggtgactcagaaggcgccatgtggacggcagtgtttgatgagccagcgaactcaacgcccacagccccaggagtggtgagggacgtgggttccagtgtgtgggcagctggcacctcagctccagaggagaaaggctgggccaagttcactgacttccaacctttctgctgctccgagtcagggcccaggtgcagctctccggtggacacagaatgcagccatgctgagggcagccggagccaaggccctgagaaagccttcagcccggcttctccatgtgcctggaacgtgtgtgtcaccaggaaggcccccctgctggcctctgacagtagctcctctgggggctcccacagcgaggatggcgaccagaaggcagcgagtgccatggatgcggtgagcaggggtcccggccgggaggcccccccgctgcccacagtggccaggacagaggaggctgtcggcagggtcgggtgtgctgacagccggctgttaagccctgcctgccccgcgccaaaggaagtgactgctgccccagccgtggctgtgccccccgaggctactgtggccatcaccacagcactgagcaaggctggccccgccatacccaccccagcagtctcttctgcactggccgtggcggtccccctagggcccatcatggcagtcacagcagccccagccatggtggccaccctggggacagtgacaaaggacgggaagacagatgccccgccagaaggagctgccttaaatggcccagtgtgatgctgctgccgcccggccacggcccaccctggtcaggctgcctccttaatcgagaaaactacctggtgatgcaatcttttttttttttaatttaatttaattttaaaataaatgctgcattggtaaagctggcagttgaaacc

SEQ ID NO: 16506 - DNA, 1811 bp, Homo sapiens
  ENST00000427222
cttactgctggacttgttctttaagtacacctggaataactttttgcacttccaagtggaactatgcatagccgctattctctcccacgctgcccgtgaggagaggacagaagccagcggatccgagagcagggtggagcctccgcatgagaacgggaaccggagcctggagactccccagccggccgccagcctccctgacaacacaatggtgacccacctgttccagaagtgctgcctggtgcagaggatcctggaggcctgggaagccaacgaccacacgcaggcagcgggtggcatgagacgtgggaacatgggccacctcacacggatcgccaacgcggtggtgcagaacctggagcggggccctgtgcagacgcacatcagcgaggtcatccgagggctccctgcggactgccgtggccgctgggagagcttcgtggaggagacgctgacggagacgaaccgcaggaacactgtggacctggccttctctgactaccagatccagcagatgacagccaacttcgtggatcagtttggcttcaatgatgaggagtttgccgaccaggacgacaacatcaatgccccgtttgacaggatcgcagagatcaacttcaacatcgacgctgacgaggacagtcccagcgcagctctgtttgaggcctgctgcagtgaccgcatccagccctttgatgatgatgaggacgaggacatctgggaggacagtgacactcgctgtgctgcccgggtgatggccagacccaggtttggagccccccatgcttcagagagttgctcaaagaatggcccagagcgtggaggccaggatgggaaggcgagcttggaagcacacagagatgcacctggggcaggtgccccaccggcccccgggaagaaggaagcgccccctgtggagggtgactcagaagcaggcgccatgtggacggcagtgtttgatgagccagcgaactcaacgcccacagccccaggagtggtgagggacgtgggttccagtgtgtgggcagctggcacctcagctccagaggagaaaggctgggccaagttcactgacttccaacctttctgctgctccgagtcagggcccaggtgcagctctccggtggacacagaatgcagccatgctgagggcagccggagccaaggccctgagaaagccttcagcccggcttctccatgtgcctggaacgtgtgtgtcaccaggaaggcccccctgctggcctctgacagtagctcctctgggggctcccacagcgaggatggcgaccagaaggcagcgagtgccatggatgcggtgagcaggggtcccggccgggaggcccccccgctgcccacagtggccaggacagaggaggctgtcggcagggtcgggtgtgctgacagccggctgttaagccctgcctgccccgcgccaaaggaagtgactgctgccccagccgtggctgtgccccccgaggctactgtggccatcaccacagcactgagcaaggctggccccgccatacccaccccagcagtctcttctgcactggccgtggcggtccccctagggcccatcatggcagtcacagcagccccagccatggtggccaccctggggacagtgacaaaggacgggaagacagatgccccgccagaaggagctgccttaaatggcccagtgtgatgctgctgccgcccggccacggcccaccctggtcaggctgcctccttaatcgagaaaactacctggtgatgcaatcttttttttttttaatttaatttaattttaaaataaatgctgcattggt

SEQ ID NO: 16507 - DNA, 550 bp, Homo sapiens
  ENST00000473283
cccaggagtggtgagggacgtgggttccagtgtgtgggcagctggcacctcagctccagaggagaaaggctgggccaagttcactgacttccaacctttctgctggtaacaaatgcgctggcaggagggggctgtgccaggaagtgcctgtcagggccaggaggcacctgtcccccaggactgatcctgtcctcgtccttgtatgcagctccgagtcagggcccaggtgcagctctccggtggacacagaatgcagccatgctgagggcagccggagccaaggccctgagaaagccttcagcccggcttctccatgtgcctggaacgtgtgtgtcaccaggaaggcccccctgctggcctctgacagtagctcctctgggggctcccacagcgaggatggcgaccagaaggcagcgagtgccatggatgcggtgagcaggggtcccggccgggaggcccccccgctgcccacagtggccaggacagaggaggctgtcggcaggtgtgtggggcgtggcgggggcgggcctgccgggtgcatagggcgtgg

SEQ ID NO: 16508 - DNA, 1211 bp, Homo sapiens
  ENST00000470046
ccagtgagccgagatcacgccactgcactccggcctgcgcatgagagagactgactgtcggcaaaaacaaaaccaaaacaaacctttacccacttctcctaaacaacccctaaaaaactgctctgaaaagcagggaatatcattgtgcaaagtaagttgtttttttccacggggctgtctgcgtaaaacttgccacttagagccctgcctgcaccgtcgtcacggcccagcctgcaggtgagcttcctcgcgcccccgcctgacctgagtgcccctccctcagtcagacacagtgtcgtcgccctgcaggaagccagggggcccgtctgctgctcgtggccaggctgggccttggggtgcccgaccccctccagagcaagccccttagatgcccggcagggtcctctctaccctcccatcccctgggaggtttccccagactgtgtccagtgtgaggctgaagttgagatcatagcacaggaggctctggggtccttgaagaatgaggcgcttgatgatgagcaggatctgagtgctgcctggaggaggtttgaggtcatcaatggacaggcagcttgtcccagtacttggaacttggggcagcagagctgcctagctgggcacaacctgggccaccccacaaagggcaggagtgagaggggccaaagatggtgctcccaggccgcctggacctttttgtccagctggtccttgggcatgaggcggggtggcactgagggtgggggtgcccgtaaccggagtccatgtttgccacacagggtcgggtgtgctgacagccggctgttaagccctgcctgccccgcgccaaaggaagtgactgctgccccagccgtggctgtgccccccgaggctactgtggccatcaccacagcactgagcaaggctggccccgccatacccaccccagcagtctcttctgcactggccgtggcggtccccctagggcccatcatggcagtcacagcagccccagccatggtggccaccctggggacagtgacaaaggacgggaagacagatgccccgccagaaggagctgccttaaatggcccagtgtgatgctgctgccgcccggccacggcccaccctggtcaggctgcctccttaatcgagaaaactacctggtgatgcaatcttttttttttttaatttaatttaattttaaaataaatgctgcattggtaaagctg

SEQ ID NO: 16509 - DNA, 4104 bp, Homo sapiens
  ENST00000612753
gtgcgccgccgccgccattttggagcgatcggagtgccgcccgcggccccgagtcggtctcgagccgccggccggccgtgccggtgtccgtaggcgctgcgccctcggccgggcccatgtgtgtgcggcccgcccgaggccgcccgggctttgcctccaccagcgccctggcctccgctcgggcctccacacgggcctccgaagagctgccgcgacgcccggcccgcagggcaggtaaagagattataaatcttccactgaatgaaaaaaattttcttaaagctgcatatactccaagaaaaaaaccacaaatgtttttctgttttgcctgaatacatgatttaaacaagagatttccacagaagctctgcggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtcgcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaccaccattggtgtgctggaggagcccctggggaatgcccgtctgcatggcgcccgcctcatggcagcactgctgcacacaaacacacccagcatcaaccaggagctctgccggctcaacacgatggacttactgctggacttgttctttaagtacacctggaataactttttgcacttccaagtggaactatgcatagccgctattctctcccacgctgcccgtgaggagaggacagaagccagcggatccgagagcagggtggagcctccgcatgagaacgggaaccggagcctggagactccccagccggccgccagcctccctgacaacacaatggtgacccacctgttccagaagtgctgcctggtgcagaggatcctggaggcctgggaagccaacgaccacacgcaggcagcgggtggcatgagacgtgggaacatgggccacctcacacggatcgccaacgcggtggtgcagaacctggagcggggccctgtgcagacgcacatcagcgaggtcatccgagggctccctgcggactgccgtggccgctgggagagcttcgtggaggagacgctgacggagacgaaccgcaggaacactgtggacctggtgagcactcaccaccttcactcctcaagtgaggacgaggacattgagggtgctttccctaacgagctgtcccttcagcaggccttctctgactaccagatccagcagatgacagccaacttcgtggatcagtttggcttcaatgatgaggagtttgccgaccaggacgacaacatcaatgccccgtttgacaggatcgcagagatcaacttcaacatcgacgctgacgaggacagtcccagcgcagctctgtttgaggcctgctgcagtgaccgcatccagccctttgatgatgatgaggacgaggacatctgggaggacagtgacactcgctgtgctgcccgggtgatggccagacccaggtttggagccccccatgcttcagagagttgctcaaagaatggcccagagcgtggaggccaggatgggaaggcgagcttggaagcacacagagatgcacctggggcaggtgccccaccggcccccgggaagaaggaagcgccccctgtggagggtgactcagaaggcgccatgtggacggcagtgtttgatgagccagcgaactcaacgcccacagccccaggagtggtgagggacgtgggttccagtgtgtgggcagctggcacctcagctccagaggagaaaggctgggccaagttcactgacttccaacctttctgctgctccgagtcagggcccaggtgcagctctccggtggacacagaatgcagccatgctgagggcagccggagccaaggccctgagaaagccttcagcccggcttctccatgtgcctggaacgtgtgtgtcaccaggaaggcccccctgctggcctctgacagtagctcctctgggggctcccacagcgaggatggcgaccagaaggcagcgagtgccatggatgcggtgagcaggggtcccggccgggaggcccccccgctgcccacagtggccaggacagaggaggctgtcggcagggtcgggtgtgctgacagccggctgttaagccctgcctgccccgcgccaaaggaagtgactgctgccccagccgtggctgtgccccccgaggctactgtggccatcaccacagcactgagcaaggctggccccgccatacccaccccagcagtctcttctgcactggccgtggcggtccccctagggcccatcatggcagtcacagcagccccagccatggtggccaccctggggacagtgacaaaggacgggaagacagatgccccgccagaaggagctgccttaaatggcccagtgtgatgctgctgccgcccggccacggcccaccctggtcaggctgcctccttaatcgagaaaactacctggtgatgcaatcttttttttttttaatttaatttaattttaaaataaatgctgcattggtaaagctggcagttgaaaccagttggacggcccagcttgcgtctcttctgcctgagtgggcctctcaggtcactcgtgccctgctggaggacagaggggcacctcagccgcccccaagcccagagcacagcaataaggtcggcctgcaggagccggggtgggggtgggggtggggggggcaggaccctgagatgccaccaggacctgatgggccaggaagggcgtggacatggaggctgtttttacagttttttttttgttgttgttttgtttttaaagaatacagaaggagccaagcttttttgcactttgtatccagctgcaagctcagggcagagtcaagggcctgggttggaaaaacctgactcacaggaatgcataattgacccttgcagctacccaatagcccttggagctggcactgaaccaggctgcaagatttgactgccttaaaaacacaaggccctctaggcctggcagggatgtccctgtgcccagcacagggtgcctggcagggggagaccacaggtatgcaggtggggggacatggtgtggcactaggggctcgaagactggtttctagcactaccggtcacggccatgtcgtcctagaagggtccagaagattattttacgttgagtccatttttaatgttctgatcacctgacagggcaccccaaacccccaactcccaataaaagccgtgacgttcggacaaa

SEQ ID NO: 16510 - DNA, 4903 bp, Homo sapiens
  ENST00000615670
ccggaggcggagggggcggagccgcgctcacagctgccacccggccgccgggcccaggcagaagccacccgcccgcggccgggcacgcaccgcgcgcagaccttctgcgaacaatgctccggccgggcggctggcggctcggagaccgacggaggggccgggggagcgcagcccagaggaagccgctctgtgacccacctctgaatcccacaaaactgcaccagagagccgggcgcaagatgaaccagcaccctgtcggctcaagatgcaccagaccctctgcctgaaccccgagagcctgaaaatgtctgcgtgcagtgactttgtggagcacatctggaaacccgggtcctgcaagaactgcttctgcctgcggagcgaccaccagctggtggccggccctccccagcccagagcgggcagcctgccccctccaccgcgcctgcctcccaggcctgagaactgccgcctggaagatgaaggtgtgaacagctcaccttactccaagcccacaattgccgtgaagcccaccatgatgagctccgaggcctctgatgtgtggacagaggccaacctgagtgccgaagtctcgcaggtcatctggagacgagcccctggcaagctccccctcccgaagcaggaggatgcccccgtcgtctacctgggcagcttccgaggtgtacagaagcctgctggtccctctacctcccctgatggcaattctcgctgtcccccagcttacaccatggtcggcctgcacaaccttgagccccgcggcgagaggaacattgccttccacccggtgagcttcccggaggagaaggctgtgcacaaagaaaaaccctcatttccttaccaagaccggccctccacccaggagagcttccgccagaaactggctgcctttgctgggaccacatctggctgtcaccagggccctgggcccctgcgggaatccctgccctcggaggatgacagtgatcaaaggtgctcgccctccggggacagcgagggtggagagtactgctccatcctggactgctgccctgggagccctgttgccaaggctgcctcccagactgcaggttcccggggcaggcatggtggcagggactgctcacccacgtgctgggagcaggggaagtgttccgggcccgcagagcaggagaagcggggcccgagcttccccaaggagtgctgtagccagggccccactgcccacccatcctgcctgggccccaagaaactgtccctcacctcggaggctgccatttcttccgacggcctctcttgtggcagcggcagcggcagcggcagcggcgccagtagccccttcgtcccccacctcgagagtgattactgctccctcatgaaggaacctgccccagagaagcagcaggaccctggctgcccaggggtgacccctagcagatgccttgggctgacgggggagccccagcccccggcccacccccgggaggctacacagcctgaacccatctatgctgagagcaccaagaggaagaaggcagctccggtgccttccaagtcacaggccaagatagaacatgcagctgctgcccagggccaaggccaggtatgcacaggtaatgcctgggcccagaaagcagcatctggctggggccgggacagcccagacccaactccccaggtgtcagccaccatcacagtcatggcggcccacccggaagaggaccatcggacgatctacctgagcagccctgactctgcagtgggggtgcagtggccacgagggcctgtgagccagaactccgaggtaggtgaagaggagacttcggctgggcaggggctgagctccagggaaagccatgctcacagtgccagcgagagcaagcccaaggagaggcccgccattccccccaagttgtccaagagtagccctgtagggtccccggtgtcaccgtctgctggagggcccccagtgtcaccgctggctgaccttagtgatgggagctctggcggcagcagcattgggccccagcctccatcccaaggtcctgctgaccccgctccttcctgccggaccaacggtgtcgctatcagtgacccatccaggtgtccccagcctgccgcctcgtcagcctcggaacagaggcggcccaggttccaggcaggcacctggagtcgtcagtgccggatagaggaagaagaggaggtggagcaggaattgctgagtcacagctggggaagagagaccaaaaatggccccacggaccattcaaactccacgacctggcaccgtctccaccccacagatggctcctctgggcagaacagcaaagttgggaccgggatgagcaaatccgcctcttttgcctttgagttccccaaggacagaagtgggattgagacattctcacctcctcctccgcctccaaagtcgcggcaccttctaaaaatgaacaagagcagctctgatttggaaaaagtgagccagggctctgcagaaagcctcagcccatccttcaggggtgtccacgtcagcttcaccaccggctccacggacagcctggcctcagactctaggacctgcagcgatggaggtccctcgtctgagctggctcactcgcccaccaacagcgggaagaagctctttgctcccgttccgtttccttcaggctccactgaggacgtgtcccccagtggcccccagcagccccctccactcccccagaaaaagatagtgagccgggcagcctcttcaccggatggcttcttctggacccaaggctcccccaagcccggaacagcaagccccaagctgaacctaagccactcggaaaccaacgtccacgacgaatctcactttagctattcgttgagccccgggaaccgccaccatcctgtcttctcctcttccgatcctctggagaaagctttcaaaggcagtggccactggcttccggcagcagggctggcgggcaacagaggcggctgcgggagccctggcctccagtgcaaaggggccccctccgcctcatcctcccagctgagcgtgtccagtcaagcctccaccgggagcacccagcttcagctgcacggtctcctgagcaacatcagcagcaaggagggcacctatgccaagctggggggactctacacccagtccctggcccgccttgtagccaaatgtgaggacctcttcatgggcggccagaaaaaggagctccacttcaatgagaataactggtcgctcttcaagctgacttgtaacaagccctgctgtgactcgggggatgccatttattactgtgccacctgctctgaggaccccggcagcacctatgctgtgaaaatctgcaaagcccctgagcccaaaacagtctcctactgcagcccgtccgtgcccgtgcactttaacatccagcaggactgcggccacttcgtcgcctcggtgccgtccagcatgctcagctcccccgacgcgcccaaggaccctgtgcctgccctgcccacacacccccctgcccaggagcaggactgcgtggtggtcatcacccgagaggtgccacatcagaccgcctccgacttcgtgcgggactcggcggccagccaccaggcggagcccgaggcgtacgagcggcgcgtgtgcttcctgcttctgcaactctgcaacgggctggagcacctgaaggagcacgggatcatccaccgggacctgtgcctggagaacctgctgctggtgcactgcaccctccaggccggccccgggcccgcccccgcccccgccccggctcccgcccccgccgccgccgcgcctccctgctcctctgccgccccgcctgctggtggcactctcagccccgcagccggccccgcctccccggaagggccccgggagaagcagctgccccggctcatcatcagcaactttttgaaggccaagcagaagccgggcggcaccccaaacctgcagcagaagaagagccaggcccggctggcccccgagatcgtgtctgcttcccagtaccgcaagttcgatgagttccagacaggcatcctcatctacgagctgctgcaccaacccaacccgttcgaggtgcgcgcccagctgcgggagagagactaccggcaggaggacctgccgccgctgcccgcgctgtccctctactcacccggcctgcagcagctggcacatctgctactggaggccgaccccatcaagcgtatccgcatcggcgaggccaagcgcgtgctgcagtgcctgctgtgggggcctcggcgcgagctggtgcagcagccgggcacctcggaggaggcgctgtgcggcacgctgcacaactggatcgacatgaagcgggccctgatgatgatgaagtttgcggagaaggcggtggatcgcaggcggggcgtggagctggaggactggctttgctgccagtacctggcgtctgcggagcccggggccctcttacagtcgctgaagctcctgcagcttctgtgagccaagccccagcctgcaccgtcgctgccccttccctgcctaaccctttcctgtctcgccttggaagcacccatgtctccctgggaaatggtacagatgactgggatacctggatgtaaaatatataaatatatatatagaaaatacatataccatatataaatatgaaagactaaggatgctgttgcccgtccacactcgtctcctctctgcactaagtcctccctgttttcttctgtaattatacacatttccagttccatgcaacgtcctgaggacagttctgtgaactgaatgcagcctggacactggcctcaataccttgtttaggatttcttcacccttttgtcaaattgttatttaaagaaaaaaaaaaaagaagaaaattccattaaaattttttttggttgagtcatg

SEQ ID NO: 16511 - DNA, 4639 bp, Homo sapiens
  ENST00000622241
atgcaccagaccctctgcctgaaccccgagagcctgaaaatgtctgcgtgcagtgactttgtggagcacatctggaaacccgggtcctgcaagaactgcttctgcctgcggagcgaccaccagctggtggccggccctccccagcccagagcgggcagcctgccccctccaccgcgcctgcctcccaggcctgagaactgccgcctggaagatgaaggtgtgaacagctcaccttactccaagcccacaattgccgtgaagcccaccatgatgagctccgaggcctctgatgtgtggacagaggccaacctgagtgccgaagtctcgcaggtcatctggagacgagcccctggcaagctccccctcccgaagcaggaggatgcccccgtcgtctacctgggcagcttccgaggtgtacagaagcctgctggtccctctacctcccctgatggcaattctcgctgtcccccagcttacaccatggtcggcctgcacaaccttgagccccgcggcgagaggaacattgccttccacccggtgagcttcccggaggagaaggctgtgcacaaagaaaaaccctcatttccttaccaagaccggccctccacccaggagagcttccgccagaaactggctgcctttgctgggaccacatctggctgtcaccagggccctgggcccctgcgggaatccctgccctcggaggatgacagtgatcaaaggtgctcgccctccggggacagcgagggtggagagtactgctccatcctggactgctgccctgggagccctgttgccaaggctgcctcccagactgcaggttcccggggcaggcatggtggcagggactgctcacccacgtgctgggagcaggggaagtgttccgggcccgcagagcaggagaagcggggcccgagcttccccaaggagtgctgtagccagggccccactgcccacccatcctgcctgggccccaagaaactgtccctcacctcggaggctgccatttcttccgacggcctctcttgtggcagcggcagcggcagcggcagcggcgccagtagccccttcgtcccccacctcgagagtgattactgctccctcatgaaggaacctgccccagagaagcagcaggaccctggctgcccaggggtgacccctagcagatgccttgggctgacgggggagccccagcccccggcccacccccgggaggctacacagcctgaacccatctatgctgagagcaccaagaggaagaaggcagctccggtgccttccaagtcacaggccaagatagaacatgcagctgctgcccagggccaaggccaggtatgcacaggtaatgcctgggcccagaaagcagcatctggctggggccgggacagcccagacccaactccccaggtgtcagccaccatcacagtcatggcggcccacccggaagaggaccatcggacgatctacctgagcagccctgactctgcagtgggggtgcagtggccacgagggcctgtgagccagaactccgaggtaggtgaagaggagacttcggctgggcaggggctgagctccagggaaagccatgctcacagtgccagcgagagcaagcccaaggagaggcccgccattccccccaagttgtccaagagtagccctgtagggtccccggtgtcaccgtctgctggagggcccccagtgtcaccgctggctgaccttagtgatgggagctctggcggcagcagcattgggccccagcctccatcccaaggtcctgctgaccccgctccttcctgccggaccaacggtgtcgctatcagtgacccatccaggtgtccccagcctgccgcctcgtcagcctcggaacagaggcggcccaggttccaggcaggcacctggagtcgtcagtgccggatagaggaagaagaggaggtggagcaggaattgctgagtcacagctggggaagagagaccaaaaatggccccacggaccattcaaactccacgacctggcaccgtctccaccccacagatggctcctctgggcagaacagcaaagttgggaccgggatgagcaaatccgcctcttttgcctttgagttccccaaggacagaagtgggattgagacattctcacctcctcctccgcctccaaagtcgcggcaccttctaaaaatgaacaagagcagctctgatttggaaaaagtgagccagggctctgcagaaagcctcagcccatccttcaggggtgtccacgtcagcttcaccaccggctccacggacagcctggcctcagactctaggacctgcagcgatggaggtccctcgtctgagctggctcactcgcccaccaacagcgggaagaagctctttgctcccgttccgtttccttcaggctccactgaggacgtgtcccccagtggcccccagcagccccctccactcccccagaaaaagatagtgagccgggcagcctcttcaccggatggcttcttctggacccaaggctcccccaagcccggaacagcaagccccaagctgaacctaagccactcggaaaccaacgtccacgacgaatctcactttagctattcgttgagccccgggaaccgccaccatcctgtcttctcctcttccgatcctctggagaaagctttcaaaggcagtggccactggcttccggcagcagggctggcgggcaacagaggcggctgcgggagccctggcctccagtgcaaaggggccccctccgcctcatcctcccagctgagcgtgtccagtcaagcctccaccgggagcacccagcttcagctgcacggtctcctgagcaacatcagcagcaaggagggcacctatgccaagctggggggactctacacccagtccctggcccgccttgtagccaaatgtgaggacctcttcatgggcggccagaaaaaggagctccacttcaatgagaataactggtcgctcttcaagctgacttgtaacaagccctgctgtgactcgggggatgccatttattactgtgccacctgctctgaggaccccggcagcacctatgctgtgaaaatctgcaaagcccctgagcccaaaacagtctcctactgcagcccgtccgtgcccgtgcactttaacatccagcaggactgcggccacttcgtcgcctcggtgccgtccagcatgctcagctcccccgacgcgcccaaggaccctgtgcctgccctgcccacacacccccctgcccaggagcaggactgcgtggtggtcatcacccgagaggtgccacatcagaccgcctccgacttcgtgcgggactcggcggccagccaccaggcggagcccgaggcgtacgagcggcgcgtgtgcttcctgcttctgcaactctgcaacgggctggagcacctgaaggagcacgggatcatccaccgggacctgtgcctggagaacctgctgctggtgcactgcaccctccaggccggccccgggcccgcccccgcccccgccccggctcccgcccccgccgccgccgcgcctccctgctcctctgccgccccgcctgctggtggcactctcagccccgcagccggccccgcctccccggaagggccccgggagaagcagctgccccggctcatcatcagcaactttttgaaggccaagcagaagccgggcggcaccccaaacctgcagcagaagaagagccaggcccggctggcccccgagatcgtgtctgcttcccagtaccgcaagttcgatgagttccagacaggcatcctcatctacgagctgctgcaccaacccaacccgttcgaggtgcgcgcccagctgcgggagagagactaccggcaggaggacctgccgccgctgcccgcgctgtccctctactcacccggcctgcagcagctggcacatctgctactggaggccgaccccatcaagcgtatccgcatcggcgaggccaagcgcgtgctgcagtgcctgctgtgggggcctcggcgcgagctggtgcagcagccgggcacctcggaggaggcgctgtgcggcacgctgcacaactggatcgacatgaagcgggccctgatgatgatgaagtttgcggagaaggcggtggatcgcaggcggggcgtggagctggaggactggctttgctgccagtacctggcgtctgcggagcccggggccctcttacagtcgctgaagctcctgcagcttctgtgagccaagccccagcctgcaccgtcgctgccccttccctgcctaaccctttcctgtctcgccttggaagcacccatgtctccctgggaaatggtacagatgactgggatacctggatgtaaaatatataaatatatatatagaaaatacatataccatatataaatatgaaagactaaggatgctgttgcccgtccacactcgtctcctctctgcactaagtcctccctgttttcttctgtaattatacacatttccagttccatgcaacgtcctgaggacagttctgtgaactgaatgcagcctggacactggcctcaataccttgtttaggatttcttcacccttttgtcaaattgttatttaaagaaaaaaaaaaaagaagaaaattccattaaaattttttttggttgagtcatga

SEQ ID NO: 16512 - DNA, 2612 bp, Homo sapiens
  ENST00000369091
gggaagccagacggttaacacagacaaagtgctgccgtgacactcggccctccagtgttgcggagaggcaagagcagcgaccgcggcacctgtccgcccggagctgggacgcgggcgcccgggcggccggacgaagcgaggagggaccgccgaggctgcccccaagtgtaactccagcactgtgaggtttcagggattggcagaggggaccaaggggaccatgaaaatggacatggaggatgcggatatgactctgtggacagaggctgagtttgaagagaagtgtacatacattgtgaacgaccacccctgggattctggtgctgatggcggtacttcggttcaggcggaggcatccttaccaaggaatctgcttttcaagtatgccaccaacagtgaagaggttattggagtgatgagtaaagaatacataccaaagggcacacgttttggacccctaataggtgaaatctacaccaatgacacagttcctaagaacgccaacaggaaatatttttggaggatctattccagaggggagcttcaccacttcattgacggctttaatgaagagaaaagcaactggatgcgctatgtgaatccagcacactctccccgggagcaaaacctggctgcgtgtcagaacgggatgaacatctacttctacaccattaagcccatccctgccaaccaggaacttcttgtgtggtattgtcgggactttgcagaaaggcttcactacccttatcccggagagctgacaatgatgaatctcacacaaacacagagcagtctaaagcaaccgagcactgagaaaaatgaactctgcccaaagaatgtcccaaagagagagtacagcgtgaaagaaatcctaaaattggactccaacccctccaaaggaaaggacctctaccgttctaacatttcacccctcacatcagaaaaggacctcgatgactttagaagacgtgggagccccgaaatgcccttctaccctcgggtcgtttaccccatccgggcccctctgccagaagactttttgaaagcttccctggcctacgggatcgagagacccacgtacatcactcgctcccccattccatcctccaccactccaagcccctctgcaagaagcagccccgaccaaagcctcaagagctccagccctcacagcagccctgggaatacggtgtcccctgtgggccccggctctcaagagcaccgggactcctacgcttacttgaacgcgtcctacggcacggaaggtttgggctcctaccctggctacgcacccctgccccacctcccgccagctttcatcccctcgtacaacgctcactaccccaagttcctcttgcccccctacggcatgaattgtaatggcctgagcgctgtgagcagcatgaatggcatcaacaactttggcctcttcccgaggctgtgccctgtctacagcaatctcctcggtgggggcagcctgccccaccccatgctcaaccccacttctctcccgagctcgctgccctcagatggagcccggaggttgctccagccggagcatcccagggaggtgcttgtcccggcgccccacagtgccttctcctttaccggggccgccgccagcatgaaggacaaggcctgtagccccacaagcgggtctcccacggcgggaacagccgccacggcagaacatgtggtgcagcccaaagctacctcagcagcgatggcagcccccagcagcgacgaagccatgaatctcattaaaaacaaaagaaacatgaccggctacaagacccttccctacccgctgaagaagcagaacggcaagatcaagtacgaatgcaacgtttgcgccaagactttcggccagctctccaatctgaaggtccacctgagagtgcacagtggagaacggcctttcaaatgtcagacttgcaacaagggctttactcagctcgcccacctgcagaaacactacctggtacacacgggagaaaagccacatgaatgccaggtctgccacaagagatttagcagcaccagcaatctcaagacccacctgcgactccattctggagagaaaccataccaatgcaaggtgtgccctgccaagttcacccagtttgtgcacctgaaactgcacaagcgtctgcacacccgggagcggccccacaagtgctcccagtgccacaagaactacatccatctctgtagcctcaaggttcacctgaaagggaactgcgctgcggccccggcgcctgggctgcccttggaagatctgacccgaatcaatgaagaaatcgagaagtttgacatcagtgacaatgctgaccggctcgaggacgtggaggatgacatcagtgtgatctctgtagtggagaaggaaattctggccgtggtcagaaaagagaaagaagaaactggcctgaaagtgtctttgcaaagaaacatggggaatggactcctctcctcagggtgcagcctttatgagtcatcagatctacccctcatgaagttgcctcccagcaacccactacctctggtacctgtaaaggtcaaacaagaaacagttgaaccaatggatccttaagattttcagaaaacacttattt

SEQ ID NO: 16513 - DNA, 5164 bp, Homo sapiens
  ENST00000369096
gggaagccagacggttaacacagacaaagtgctgccgtgacactcggccctccagtgttgcggagaggcaagagcagcgaccgcggcacctgtccgcccggagctgggacgcgggcgcccgggcggccggacgaagcgaggagggaccgccgaggtgcgcgtctgtgcggctcagcctggcgggggacgcggggagaatgtggactgggtagagatgaacgagacttttctcagatgttggatatttgcttggaaaaacgtgtgggtacgaccttggctgcccccaagtgtaactccagcactgtgaggtttcagggattggcagaggggaccaaggggaccatgaaaatggacatggaggatgcggatatgactctgtggacagaggctgagtttgaagagaagtgtacatacattgtgaacgaccacccctgggattctggtgctgatggcggtacttcggttcaggcggaggcatccttaccaaggaatctgcttttcaagtatgccaccaacagtgaagaggttattggagtgatgagtaaagaatacataccaaagggcacacgttttggacccctaataggtgaaatctacaccaatgacacagttcctaagaacgccaacaggaaatatttttggaggatctattccagaggggagcttcaccacttcattgacggctttaatgaagagaaaagcaactggatgcgctatgtgaatccagcacactctccccgggagcaaaacctggctgcgtgtcagaacgggatgaacatctacttctacaccattaagcccatccctgccaaccaggaacttcttgtgtggtattgtcgggactttgcagaaaggcttcactacccttatcccggagagctgacaatgatgaatctcacacaaacacagagcagtctaaagcaaccgagcactgagaaaaatgaactctgcccaaagaatgtcccaaagagagagtacagcgtgaaagaaatcctaaaattggactccaacccctccaaaggaaaggacctctaccgttctaacatttcacccctcacatcagaaaaggacctcgatgactttagaagacgtgggagccccgaaatgcccttctaccctcgggtcgtttaccccatccgggcccctctgccagaagactttttgaaagcttccctggcctacgggatcgagagacccacgtacatcactcgctcccccattccatcctccaccactccaagcccctctgcaagaagcagccccgaccaaagcctcaagagctccagccctcacagcagccctgggaatacggtgtcccctgtgggccccggctctcaagagcaccgggactcctacgcttacttgaacgcgtcctacggcacggaaggtttgggctcctaccctggctacgcacccctgccccacctcccgccagctttcatcccctcgtacaacgctcactaccccaagttcctcttgcccccctacggcatgaattgtaatggcctgagcgctgtgagcagcatgaatggcatcaacaactttggcctcttcccgaggctgtgccctgtctacagcaatctcctcggtgggggcagcctgccccaccccatgctcaaccccacttctctcccgagctcgctgccctcagatggagcccggaggttgctccagccggagcatcccagggaggtgcttgtcccggcgccccacagtgccttctcctttaccggggccgccgccagcatgaaggacaaggcctgtagccccacaagcgggtctcccacggcgggaacagccgccacggcagaacatgtggtgcagcccaaagctacctcagcagcgatggcagcccccagcagcgacgaagccatgaatctcattaaaaacaaaagaaacatgaccggctacaagacccttccctacccgctgaagaagcagaacggcaagatcaagtacgaatgcaacgtttgcgccaagactttcggccagctctccaatctgaaggtccacctgagagtgcacagtggagaacggcctttcaaatgtcagacttgcaacaagggctttactcagctcgcccacctgcagaaacactacctggtacacacgggagaaaagccacatgaatgccaggtctgccacaagagatttagcagcaccagcaatctcaagacccacctgcgactccattctggagagaaaccataccaatgcaaggtgtgccctgccaagttcacccagtttgtgcacctgaaactgcacaagcgtctgcacacccgggagcggccccacaagtgctcccagtgccacaagaactacatccatctctgtagcctcaaggttcacctgaaagggaactgcgctgcggccccggcgcctgggctgcccttggaagatctgacccgaatcaatgaagaaatcgagaagtttgacatcagtgacaatgctgaccggctcgaggacgtggaggatgacatcagtgtgatctctgtagtggagaaggaaattctggccgtggtcagaaaagagaaagaagaaactggcctgaaagtgtctttgcaaagaaacatggggaatggactcctctcctcagggtgcagcctttatgagtcatcagatctacccctcatgaagttgcctcccagcaacccactacctctggtacctgtaaaggtcaaacaagaaacagttgaaccaatggatccttaagattttcagaaaacacttattttgtttcttaagttatgacttggtgagtcagggtgcctgtaggaagtggcttgtacataatcccagctctgcaaagctctctcgacagcaaatggtttcccctcacctctggaattaaagaaggaactccaaagttactgaaatctcagggcatgaacaaggcaaaggccatatatatatatatatatatatctgtatacatattatatatacttatttacacctgtgtctatatatttgcccctgtgtattttgaatatttgtgtggacatgtttgcatagccttcccattactaagactattacctagtcataattattttttcaatgataatccttcataatttattatacaatttatcattcagaaagcaataattaaaaaagtttacaatgactggaaagattccttgtaatttgagtataaatgtatttttgtcttgtggccattctttgtagataatttctgcacatctgtataagtacctaagatttagttaaacaaatatatgacttcagtcaacctctctctctaataatggtttgaaaatgaggtttgggtaattgccaatgttggacagttgatgtgttcattcctgggatcctatcatttgaacagcattgtacataacttgggggtatgtgtgcaggattacccaagaataacttaagtagaagaaacaagaaagggaatcttgtatatttttgttgatagttcatgtttttcccccagccacaattttaccggaagggtgacaggaaggctttaccaacctgtctctccctccaaaagagcagaatcctcccaccgccctgccctccccaccgagtcctgtggccattcagagcggccacatgacttttgcatccattgtattatcagaaaatgtgaagaagaaaaaaatgccatgttttaaaaccactgcgaaaatttccccaaagcataggtggctttgtgtgtgtgcgatttgggggcttgagtctgggtggtgttttgttgttggtttttgttgctttttttttttttttttttttaatgtcaaaattgcacaaacatggtgctctaccaggaaggattcgaggtagataggctcaggccacactttaaaaacaaacacacaaacaacaaaaaacgggtattctagtcatcttggggtaaaagcgggtaatgaacattcctatccccaacacatcaattgtattttttctgtaaaactcagattttcctcagtatttgtgtttttacattttatggttaatttaatggaagatgaaagggcattgcaaagttgttcaacaacagttacctcattgagtgtgtccagtagtgcaggaaatgatgtcttatctaatgatttgcttctctagaggagaaaccgagtaaatgtgctccagcaagatagactttgtgttattctatcttttattctgctaagcccaaagattacatgttggtgttcaaagtgtagcaaaaaatgatgtatatttataaatctatttataccactatatcatatgtatatatatttataaccacttaaattgtgagccaagccatgtaaaagatctactttttctaagggcaaaaaaaaaaaaaaaaaaaaaagaacactcctttctgagactttgcttaatacttggtgacctcacaatcacgtcggtatgattgggcacccttgcctactgtaagagaccctaaaaccttggtgcagtggtggggaccacaaaacaaccagggaggaagagatacatcattttttagtattaaggaccatctaagacagctctattttttttttgccactttatgattatgtggtcacacccaagtcacagaaataaaaaactgactttaccgctgcaatttttctgttttcctccttactaaatactgatacattactccaatctattttataattatatttgacattttgttcacatcaactaatgttcacctgtagaagagaacaaatttcgaataatccagggaaacccaagagccttactggtcttctgtaacttccaagactgacagctttttatgtatcagtgtttgataaacacagtccttaactgaaggtaaaccaaagcatcacgttgacattagaccaaatacttttgattcccaactactcgtttgttctttttctccttttgtgctttcccatagtgagaatttttataaagacttcttgcttctctcaccatccatccttctcttttctgcctcttacatgtgaatgttgagcccacaatcaacagtggttttattttttcctctactcaaagttaaaactgaccaaagttactggctttttactttgctagaacaacaaactatcttatgtttacatactggtttacaatgttatttatgtgcaaattgtcaaaatgtaaattaaatataaatgttcatgctttaccaaaa

SEQ ID NO: 16514 - DNA, 583 bp, Homo sapiens
  ENST00000424894
ccttttcagtcttccatgtgagaggatgaaagagagctcgcagcagagggaggaggcagttgttttgaaagttgttttgcgttgggagctggtgggaaagttcggtcttccccatttggaaaaggcaggctgggttccgctcctgcaccacacgcgctttccatttttagcttcattcagaggcagacagagctccttcctcttcctctccttgtttgtgacacttttctgaggcagcttttccacagtgccgagggtctggcggccatgaccccaggcattctgggacactggactgtgtgcccagaacatttttctgccatgagaggctgcccccaagtgtaactccagcactgtgaggtttcagggattggcagaggggaccaaggggaccatgaaaatggacatggaggatgcggatatgactctgtggacagaggctgagtttgaagagaagtgtacatacattgtgaacgaccacccctgggattctggtgctgatggcggtacttcggttcaggcggaggcatccttaccaaggaatctgcttttcaagtatgccaccaacagtgaagaggttatt

SEQ ID NO: 16515 - DNA, 649 bp, Homo sapiens
  ENST00000489365
ccctgggattctggtgctgatggcggtacttcggttcaggcggaggcatccttaccaaggaatctgcttttcaagtatgccaccaacagtgaagaggttattggagtgatgagtaaagaatacataccaaagggcacacgttttggacccctaataggtgaaatctacaccaatgacacagttcctaagaacgccaacaggaaatatttttggagggtaagtaagggaaatttcttcagacccattaaatgttaggaaaaaatggagctaaaagagctgggtggctcacctttctcatcctgtgctgagaaatgctggggctcacccataagtatccagcatccccatggacacagggaattctgaacaaatgtgatgaaaccgatgaaatgtctggcctgtaggtggttagtgatggagatacgggctatatgtgaatcttgatttttgcaattcattagagctttgtaatgaaaggaaacagtttgttgcttgctttaaggataggttcatttgcatttctccgcaaggaagtagtaatgagttaccaagccttagatttcacccctttttgatttcttgctgacttaactttaattgaatggaagagttatcacaaatgaattatctttttggttttttttttttt

SEQ ID NO: 16516 - DNA, 583 bp, Homo sapiens
  ENST00000450060
aagaggaaaagtgacttctcagtaatagactgtcaaattcgggctgctgcccgagtgttcgctttgttatggcaggtgaagttcacctttgccccacccagtgtttccacaaaaagatctattccagaggggagcttcaccacttcattgacggctttaatgaagagaaaagcaactggatgcgctatgtgaatccagcacactctccccgggagcaaaacctggctgcgtgtcagaacgggatgaacatctacttctacaccattaagcccatccctgccaaccaggaacttcttgtgtggtattgtcgggactttgcagaaaggcttcactacccttatcccggagagctgacaatgatgaatctcacacaaacacagagcagtctaaagcaaccgagcactgagaaaaatgaactctgcccaaagaatgtcccaaagagagagtacagcgtgaaagaaatcctaaaattggactccaacccctccaaaggaaaggacctctaccgttctaacatttcacccctcacatcagaaaaggacctcgatgactttagaagacgtgggagccccgaaatgccctt

SEQ ID NO: 16517 - DNA, 580 bp, Homo sapiens
  ENST00000481163
aatcggaactgaagtcagtagcatcgcccatttgccattcactgcagtagcaaaagtagtactctgtggtgggttaatcggtttgaggcagctccttaaatgaacatttgtgtttcatttttctgttattttcccgaacatgaaaagacgataaaactgaaatggaaaagatctattccagaggggagcttcaccacttcattgacggctttaatgaagagaaaagcaactggatgcgctatgtgaatccagcacactctccccgggagcaaaacctggctgcgtgtcagaacgggatgaacatctacttctacaccattaagcccatccctgccaaccaggaacttcttgtgtggtattgtcgggactttgcagaaaggcttcactacccttatcccggagagctgacaatgatgaatctcagtaagtggattacagaacaaaaaaataaaaaatgccagtaatgtcggttctgcccctttgaactaataacatgttgtttaattatacggctttgtcatgtgttggatgaagtaggtggcttaagctagggactaggaagaggaaaaacattttttga

SEQ ID NO: 16518 - DNA, 4675 bp, Homo sapiens
  ENST00000369089
cagtagcatcgcccatttgccattcactgcagtagcaaaagtagtactctgtggtgggttaatcggtttgaggcagctccttaaatgaacatttgtgtttcatttttctgttattttcccgaacatgaaaagacgataaaactgaaatggaaaagatctattccagaggggagcttcaccacttcattgacggctttaatgaagagaaaagcaactggatgcgctatgtgaatccagcacactctccccgggagcaaaacctggctgcgtgtcagaacgggatgaacatctacttctacaccattaagcccatccctgccaaccaggaacttcttgtgtggtattgtcgggactttgcagaaaggcttcactacccttatcccggagagctgacaatgatgaatctcacacaaacacagagcagtctaaagcaaccgagcactgagaaaaatgaactctgcccaaagaatgtcccaaagagagagtacagcgtgaaagaaatcctaaaattggactccaacccctccaaaggaaaggacctctaccgttctaacatttcacccctcacatcagaaaaggacctcgatgactttagaagacgtgggagccccgaaatgcccttctaccctcgggtcgtttaccccatccgggcccctctgccagaagactttttgaaagcttccctggcctacgggatcgagagacccacgtacatcactcgctcccccattccatcctccaccactccaagcccctctgcaagaagcagccccgaccaaagcctcaagagctccagccctcacagcagccctgggaatacggtgtcccctgtgggccccggctctcaagagcaccgggactcctacgcttacttgaacgcgtcctacggcacggaaggtttgggctcctaccctggctacgcacccctgccccacctcccgccagctttcatcccctcgtacaacgctcactaccccaagttcctcttgcccccctacggcatgaattgtaatggcctgagcgctgtgagcagcatgaatggcatcaacaactttggcctcttcccgaggctgtgccctgtctacagcaatctcctcggtgggggcagcctgccccaccccatgctcaaccccacttctctcccgagctcgctgccctcagatggagcccggaggttgctccagccggagcatcccagggaggtgcttgtcccggcgccccacagtgccttctcctttaccggggccgccgccagcatgaaggacaaggcctgtagccccacaagcgggtctcccacggcgggaacagccgccacggcagaacatgtggtgcagcccaaagctacctcagcagcgatggcagcccccagcagcgacgaagccatgaatctcattaaaaacaaaagaaacatgaccggctacaagacccttccctacccgctgaagaagcagaacggcaagatcaagtacgaatgcaacgtttgcgccaagactttcggccagctctccaatctgaaggtccacctgagagtgcacagtggagaacggcctttcaaatgtcagacttgcaacaagggctttactcagctcgcccacctgcagaaacactacctggtacacacgggagaaaagccacatgaatgccaggtctgccacaagagatttagcagcaccagcaatctcaagacccacctgcgactccattctggagagaaaccataccaatgcaaggtgtgccctgccaagttcacccagtttgtgcacctgaaactgcacaagcgtctgcacacccgggagcggccccacaagtgctcccagtgccacaagaactacatccatctctgtagcctcaaggttcacctgaaagggaactgcgctgcggccccggcgcctgggctgcccttggaagatctgacccgaatcaatgaagaaatcgagaagtttgacatcagtgacaatgctgaccggctcgaggacgtggaggatgacatcagtgtgatctctgtagtggagaaggaaattctggccgtggtcagaaaagagaaagaagaaactggcctgaaagtgtctttgcaaagaaacatggggaatggactcctctcctcagggtgcagcctttatgagtcatcagatctacccctcatgaagttgcctcccagcaacccactacctctggtacctgtaaaggtcaaacaagaaacagttgaaccaatggatccttaagattttcagaaaacacttattttgtttcttaagttatgacttggtgagtcagggtgcctgtaggaagtggcttgtacataatcccagctctgcaaagctctctcgacagcaaatggtttcccctcacctctggaattaaagaaggaactccaaagttactgaaatctcagggcatgaacaaggcaaaggccatatatatatatatatatatatctgtatacatattatatatacttatttacacctgtgtctatatatttgcccctgtgtattttgaatatttgtgtggacatgtttgcatagccttcccattactaagactattacctagtcataattattttttcaatgataatccttcataatttattatacaatttatcattcagaaagcaataattaaaaaagtttacaatgactggaaagattccttgtaatttgagtataaatgtatttttgtcttgtggccattctttgtagataatttctgcacatctgtataagtacctaagatttagttaaacaaatatatgacttcagtcaacctctctctctaataatggtttgaaaatgaggtttgggtaattgccaatgttggacagttgatgtgttcattcctgggatcctatcatttgaacagcattgtacataacttgggggtatgtgtgcaggattacccaagaataacttaagtagaagaaacaagaaagggaatcttgtatatttttgttgatagttcatgtttttcccccagccacaattttaccggaagggtgacaggaaggctttaccaacctgtctctccctccaaaagagcagaatcctcccaccgccctgccctccccaccgagtcctgtggccattcagagcggccacatgacttttgcatccattgtattatcagaaaatgtgaagaagaaaaaaatgccatgttttaaaaccactgcgaaaatttccccaaagcataggtggctttgtgtgtgtgcgatttgggggcttgagtctgggtggtgttttgttgttggtttttgttgctttttttttttttttttttttaatgtcaaaattgcacaaacatggtgctctaccaggaaggattcgaggtagataggctcaggccacactttaaaaacaaacacacaaacaacaaaaaacgggtattctagtcatcttggggtaaaagcgggtaatgaacattcctatccccaacacatcaattgtattttttctgtaaaactcagattttcctcagtatttgtgtttttacattttatggttaatttaatggaagatgaaagggcattgcaaagttgttcaacaacagttacctcattgagtgtgtccagtagtgcaggaaatgatgtcttatctaatgatttgcttctctagaggagaaaccgagtaaatgtgctccagcaagatagactttgtgttattctatcttttattctgctaagcccaaagattacatgttggtgttcaaagtgtagcaaaaaatgatgtatatttataaatctatttataccactatatcatatgtatatatatttataaccacttaaattgtgagccaagccatgtaaaagatctactttttctaagggcaaaaaaaaaaaaaaaaaaaaaagaacactcctttctgagactttgcttaatacttggtgacctcacaatcacgtcggtatgattgggcacccttgcctactgtaagagaccctaaaaccttggtgcagtggtggggaccacaaaacaaccagggaggaagagatacatcattttttagtattaaggaccatctaagacagctctattttttttttgccactttatgattatgtggtcacacccaagtcacagaaataaaaaactgactttaccgctgcaatttttctgttttcctccttactaaatactgatacattactccaatctattttataattatatttgacattttgttcacatcaactaatgttcacctgtagaagagaacaaatttcgaataatccagggaaacccaagagccttactggtcttctgtaacttccaagactgacagctttttatgtatcagtgtttgataaacacagtccttaactgaaggtaaaccaaagcatcacgttgacattagaccaaatacttttgattcccaactactcgtttgttctttttctccttttgtgctttcccatagtgagaatttttataaagacttcttgcttctctcaccatccatccttctcttttctgcctcttacatgtgaatgttgagcccacaatcaacagtggttttattttttcctctactcaaagttaaaactgaccaaagttactggctttttactttgctagaacaacaaactatcttatgtttacatactggtttacaatgttatttatgtgcaaattgtcaaaatgtaaattaaatataaatgttcatgctttaccaaaat

SEQ ID NO: 16519 - DNA, 649 bp, Homo sapiens
  ENST00000508965
agacgccgcccggcagcagccggcggtcgctccctccctcccagctgctgcagcagagaccggggccatttcgcgaggcggacgggctcctcggcaggctccgattggggtgggagagcggccgccgaggggcccgcagtagctgcgctcccggggaaggagccccacagtccccagatactatcaaatcagcctgggaagcatcttttcgctcagcaagttcaagagaacaaatatgttacaatccttgcctattcttgcctccacttcataatgtcataaaagccacctggggtgtcatttatcaacctctctccagcccactcttccaaaataacactacagtttcctacatgtgtatttttgccaggactccaaagagccttgctaaagtggaacaaggagtagagaattgaactgtgaaaaagaagcccgagattccccagcgacgtggtgttgcagccccgttgaaggagtcaacttgcaggctgttaaagacctcaagtcattagcatcagctgctgcactaaaggggcaagtcagcgcctctaagtggcttagcgcacaaacgaggctcccgagacggcctcggcaactccatcccctcctccaccacccgctggatgtgaaaagctttccggagcccatc

SEQ ID NO: 16520 - DNA, 584 bp, Homo sapiens
  ENST00000509375
acgccgcccggcagcagccggcggtcgctccctccctcccagctgctgcagcagagaccggggccatttcgcgaggcggacgggctcctcggcaggctccgattggggtgggagagcggccgccgaggggcccgcagtagctgcgctcccggggaaggagccccacagtccccaggagtagagaattgaactgtgaaaaagaagcccgagattccccagcgacgtggtgttgcagccccgttgaaggagtcaacttgcaggctgttaaagacctcaagtcattagcatcagctgctgcactaaaggggcaagtcagcgcctctaagtggcttagcgcacaaacgaggctcccgagacggcctcggcaactccatcccctcctccaccacccgctggatgtgaaaagctttccggagcccatcttgggggaagcttggtagtgttggcgctcctgaagagagacgacgcccgtttatcacccccaggcaactagctgcgcaaatcagcggtggctccagggctagagaatccctggagctaaccgcacccctctccctttcacggaacgcggactccggggaaat

SEQ ID NO: 16521 - DNA, 395 bp, Homo sapiens
  ENST00000506547
ctacagggctggctctgccccggcgtcccgcccccgccccggggaacgctgcctctgccgcaaagatgcccccttccgctggaaagcggtcataaaagccacctggggtgtcatttatcaacctctctccagcccactcttccaaaataacactacagtttcctacatgtgtatttttgccaggactccaaagagccttgctaaagtggaacaagcaaaatcctcccctggcctcctgggactgcagtcaccaggctgtcaaagcctcaataccccactgagttccagagaagggtctcaaagctgggagaggatcaaactaacatggagtagagaattgaactgtgaaaaagaagcccgagattccccagcgacgtggtgttgcagccccgttg

SEQ ID NO: 16522 - DNA, 677 bp, Homo sapiens
  ENST00000511825
ggcgtcccgcccccgccccggggaacgctgcctctgccgcaaagatgcccccttccgctggaaagcggtcataaaagccacctggggtgtcatttatcaacctctctccagcccactcttccaaaataacactacagtttcctacatgtgtatttttgccaggactccaaagagccttgctaaagtggaacaaggagtagagaattgaactgtgaaaaagaagcccgagattccccagcgacgtggtgttgcagccccgttgaaggagtcaacttgcaggctgttaaagacctcaagtcattagcatcagctgctgcactaaaggggcaagtcagcgcctctaagtggcttagcgcacaaacgaggctcccgagacggcctcggcaactccatcccctcctccaccacccgctggatgtgaaaagctttccggagcccatcttgggggaagcttggtagtgttggcgctcctgaagagagacgacgcccgtttatcacccccaggcaactagctgcgcaaatcagcggtggctccagggctagagaatccctggagctaaccgcacccctctccctttcacggaacgcggactccggggaaatacgcacggggtccgcacgcgctgggtgtccagctctctgtcacagcttctccaagtgcctagtgaaacggggaa

SEQ ID NO: 16523 - DNA, 3706 bp, Homo sapiens
  ENST00000504452
ggcgtcccgcccccgccccggggaacgctgcctctgccgcaaagatgcccccttccgctggaaagcggtcataaaagccacctggggtgtcatttatcaacctctctccagcccactcttccaaaataacactacagtttcctacatgtgtatttttgccaggactccaaagagccttgctaaagtggaacaaggagtagagaattgaactgtgaaaaagaagcccgagattccccagcgacgtggtgttgcagccccgttgaaggagtcaacttgcaggctgttaaagacctcaagtcattagcatcagctgctgcactaaaggggcaagtcagcgcctctaagtggcttagcgcacaaacgaggctcccgagacggcctcggcaactccatcccctcctccaccacccgctggatgtgaaaagctttccggagcccatcttgggggaagcttggtagtgttggcgctcctgaagagagacgacgcccgtttatcacccccaggcaactagctgcgcaaatcagcggtggctccagggctagagaatccctggagctaaccgcacccctctccctttcacggaacgcggactccggggaaatacgcacggggtccgcacgcgctgggtgtccagctctctgtcacagcttctccaagtgcctagtgaaacggggaaaggccctctccaatcattttggaagagcctaaaaggcggcaacaccaacacctcttgacatggaaatacactgatacaataggcaaaaggaaacactcgattgcatcttcccggttccaggtggccttatttgggagattctatactgaccttattcctgtgatggaggatactggcatccagcgaggcatctgggatggagatgccaaggctgtccaacaatgtctgacagatatttttaccagcgtttacaccacctgcgacatccctgagaatgctatatttggtccctgtgtcctgagccatacttccctatatgacagcatagctttcatagctctcaagtctactgacaagagaacagtaccgtatatctttcgggtagacacctcagcagcaaatggttcctcagaaggtctcatgtggctgcggttggtccaatcggccagagataaggaagagcagaaccttgaagcctacataaaaaacggacagctgttctaccgctctctccgcaggattgccaaagacgaggagttactagtttggtacgggaaagaactgactgagttactcttgctctgcccctctagatcccacaacaaaatgaatgggtcgtccccttacacatgcctggaatgcagccaacgtttccagtttgagttcccctatgtggcgcatctgcgtttccgctgccccaagagacttcacagcgctgatataagtccccaagacgaacaaggcggcggcgtgggcaccaaggaccacgggggcggcggcggcggtggcaaagaccagcagcagcagcagcaggaggcacctttaggcccgggtcccaagttttgcaaagccggccccctccaccactacccatccccctccccggaaagcagcaacccatccgctgccgccggcggcagcagcgcgaagccatccacagacttccacaacctggccagggagctggaaaactcccggggaggcagcagctgctccccagcccagagcctcagcagcggtagcggcagcggcggcggcggcggccaccaggaggcggagctgagtcccgacggcatcgccacgggcggcggcaaaggaaagaggaaattcccggaggaggcggcggagggcggcggtggcgctggtctggtagggggccggggccgcttcgtagagcggcccctcccggcctccaaggaggatctggtgtgcacaccgcagcagtaccgagcctcgggcagctacttcggcctggaagagaacggccgcctcttcgcgccgccaagtcccgagacgggcgaggcgaagcgcagcgccttcgtggaggtgaagaaggctgcccgcgcggccagcctgcaggaggaggggacagccgacggcgcgggagtcgcctccgaggaccaggacgctggcggcggcggcggctcctccacgcccgcggccgcgtcaccggtgggcgccgagaagctgctggccccgcggcctgggggcccgctgcccagccggctcgagggcggcagtcctgcgaggggcagcgccttcacttcggtgccgcagctgggcagcgcgggcagcaccagcggtgggggcggaacgggcgccggggccgcaggcggcgcgggcgggggccagggcgccgcgtcggacgagcgcaaaagcgccttctcgcagccagcacgctctttctcgcagctgtccccgctggtgctgggccagaagctgggcgcgctcgagccatgccaccccgccgacggcgtgggccccaccagactctatcccgccgccgcggaccctctagcggtgaagctccagggggccgcggacctgaacggaggttgcgggtccctgccgagcggcggcggcggcctgcctaagcagagccccttcctgtacgccaccgccttctggcccaagagctccgctgccgctgcagccgcggctgcggcggcggccgcggggcccttgcagctgcagctgccctcggcgctcacgctgctgccgccctccttcacctcgctgtgtctgcccgcgcagaactggtgcgccaagtgcaatgcctccttccgcatgacctccgacctggtgtaccatatgaggtcgcaccacaaaaaggagtatgcgatggagcccttggtgaagcggcggcgagaggagaaactcaagtgccccatctgcaatgagtccttcagggagcgccaccacctctccaggcacatgacctcgcataattgactcggaaaggaccccagctttccacgcgcgcgcaagcacagttaagccacctgcaggaataaacacgcgagaacatccaccgcttccttgcaccccgaaaccctgcacaaagacacatacattcaccgcccccccgcccccccaacgcgcacacacacgtcctctcctcccaggaacctcattcaaatatttacccgggacacacacccccccccacacacacacacagacacactcacacacaagagccaggatggtggagttttgattgggtgggttgtttgagggggttttcttttgaatgcacgcattttcactttccccaaaacaaaggtacattttttaaaatgtcatatattgcaacatattgatgcatttgtcatacgtttctacttaaattattaagcacttacgatttagatgtaataattatatgtaagggcaaaatttattttagatataaagtaaaggaggagggtgagatgctttctgcatttcttgatgacagtttgtgttcctacaaaaataaacaaaatgaataaaaagggatcaccattcaatttgagtttccagggggaagtgcatgtataatgaaatgataatggacttcaatgaagaatgtcatcaattatgtacatatgtattttcttttaatacaaagtgtaattttgtgccagtgaaatggagtctgaatagttatgtgtttcttttatccctggaaatatttattaaactttatagtttatccgagtatgttggatgctttgacaataaatgactattttcttcaaagcaaa

SEQ ID NO: 16524 - DNA, 783 bp, Homo sapiens
  ENST00000508061
ccggggaacgctgcctctgccgcaaagatgcccccttccgctggaaagcggtgcctccctgggtgctcgcgaaagcagccctgagaatggcagctctcagaggttgaagtcattcttttcgggggacggggcacggcgactgtttgattgggggcctcgctagaggaatgtgcaaggacagaagggaaactgaggagacccgcaactcattagcgaaataatagggtgcacttcaataaaaatgcggtcctgaagtggagcagactcaccggcaaggagcccggaaaatcgtcaggggcggcggcaaaatactatcaaatcagcctgggaagcatcttttcgctcagcaagttcaagagaacaaatatgttacaatccttgcctattcttgcctccacttcataatgtcataaaagccacctggggtgtcatttatcaacctctctccagcccactcttccaaaataacactacagtttcctacatgtgtatttttgccaggactccaaagagccttgctaaagtggaacaaggagtagagaattgaactgtgaaaaagaagcccgagattccccagcgacgtggtgttgcagccccgttgaaggagtcaacttgcaggctgttaaagacctcaagtcattagcatcagctgctgcactaaaggggcaagtcagcgcctctaagtggcttagcgcacaaacgaggctcccgagacggcctcggcaactccatcccctcctccaccacccgctggatgtgaaaagctttccggagcccatcttg

SEQ ID NO: 16525 - DNA, 2514 bp, Homo sapiens
  ENST00000515013
aaaagcagcatcagacaagagctttattaatcccttacacgagcaaatgcgatctctgacctactagacttgttttcctacaatttcacaaaaagcctcgctagaggaatgtgcaaggacagaagggaaactgaggagacccgcaactcattagcgaaataatagggtgcacttcaataaaaatgcggtcctgaagtggagcagactcaccggcaaggagcccggaaaatcgtcaggggcggcggcaaaatactatcaaatcagcctgggaagcatcttttcgctcagcaagttcaagagaacaaatatgttacaatccttgcctattcttgcctccacttcataatgtcataaaagccacctggggtgtcatttatcaacctctctccagcccactcttccaaaataacactacagtttcctacatgtgtatttttgccaggactccaaagagccttgctaaagtggaacaagcaaaatcctcccctggcctcctgggactgcagtcaccaggctgtcaaagcctcaataccccactgagttccagagaagggtctcaaagctgggagaggatcaaactaacatggagtagagaattgaactgtgaaaaagaagcccgagattccccagcgacgtggtgttgcagccccgttgaaggagtcaacttgcaggctgttaaagacctcaagtcattagcatcagctgctgcactaaaggggcaagtcagcgcctctaagtggcttagcgcacaaacgaggctcccgagacggcctcggcaactccatcccctcctccaccacccgctggatgtgaaaagctttccggagcccatcttgggggaagcttggtagtgttggcgctcctgaagagagacgacgcccgtttatcacccccaggcaactagctgcgcaaatcagcggtggctccagggctagagaatccctggagctaaccgcacccctctccctttcacggaacgcggactccggggaaatacgcacggggtccgcacgcgctgggtgtccagctctctgtcacagcttctccaagtgcctagtgaaacggggaaaggccctctccaatcattttggaagagcctaaaaggcggcaacaccaacacctcttgacatggaaatacactgatacaataggcaaaaggaaacactcgattgcatcttcccggttccaggtggccttatttgggagattctatactgaccttattcctgtgatggaggatactggcatccagcgaggcatctgggatggagatgccaaggctgtccaacaatgtctgacagatatttttaccagcgtttacaccacctgcgacatccctgagaatgctatatttggtccctgtgtcctgagccatacttccctatatgacagcatagctttcatagctctcaagtctactgacaagagaacagtaccgtatatctttcgggtagacacctcagcagcaaatggttcctcagaaggtctcatgtggctgcggttggtccaatcggccagagataaggaagagcagaaccttgaagcctacataaaaaacggacagctgttctaccgctctctccgcaggattgccaaagacgaggagttactagtttggtacgggaaagaactgactgagttactcttgctctgcccctctagatcccacaacaaaatgaatgggtcgtccccttacacatgcctggaatgcagccaacgtttccagtttgagttcccctatgtggcgcatctgcgtttccgctgccccaagagacttcacagcgctgatataagtccccaagacgaacaaggcggcggcgtgggcaccaaggaccacgggggcggcggcggcggtggcaaagaccagcagcagcagcagcaggaggcacctttaggcccgggtcccaagttttgcaaagccggccccctccaccactacccatccccctccccggaaagcagcaacccatccgctgccgccggcggcagcagcgcgaagccatccacagacttccacaacctggccagggagctggaaaactcccggggaggcagcagctgctccccagcccagagcctcagcagcggtagcggcagcggcggcggcggcggccaccaggaggcggagctgagtcccgacggcatcgccacgggcggcggcaaaggaaagaggaaattcccggaggaggcggcggagggcggcggtggcgctggtctggtagggggccggggccgcttcgtagagcggcccctcccggcctccaaggaggatctggtgtgcacaccgcagcagtaccgagcctcgggcagctacttcggcctggaagagaacggccgcctcttcgcgccgccaagtcccgagacgggcgaggcgaagcgcagcgccttcgtggaggtgaagaaggctgcccgcgcggccagcctgcaggaggaggggacagccgacggcgcgggagtcgcctccgaggaccaggacgctggcggcggcggcggctcctccacgcccgcggccgc

SEQ ID NO: 16526 - DNA, 634 bp, Homo sapiens
  ENST00000507025
cgctagaggaatgtgcaaggacagaagggaaactgaggagacccgcaactcattagcgaaataatagggtgcacttcaataaaaatgcggtcctgaagtggagcagactcaccggcaaggagcccggaaaatcgtcaggggcggcggcaaaatactatcaaatcagcctgggaagcatcttttcgctcagcaagttcaagagaacaaatatgttacaatccttgcctattcttgcctccacttcataatgtcataaaagccacctggggtgtcatttatcaacctctctccagcccactcttccaaaataacactacagtttcctacatgtgtatttttgccaggactccaaagagccttgctaaagtggaacaagcaaaatcctcccctggcctcctgggactgcagtcaccaggctgtcaaagcctcaataccccactgagttccagagaagggtctcaaagctgggagaggatcaaactaacatggagtagagaattgaactgtgaaaaagaagcccgagattccccagcgacgtggtgttgcagccccgttgaaggagtcaacttgcaggctgttaaagacctcaagtcattagcatcagctgctgcactaaaggggcaagtcagcgcct

SEQ ID NO: 16527 - DNA, 3124 bp, Homo sapiens
  ENST00000415738
gtcactgcatcgggtccatctgtacaactctctccgtttctccgtctctctccctccctccctccctccacccccccaatctttttctccccatctctccatctctctcttatctcttcaggaagagcctaaaaggcggcaacaccaacacctcttgacatggaaatacactgatacaataggcaaaaggaaacactcgattgcatcttcccggttccaggtggccttatttgggagattctatactgaccttattcctgtgatggaggatactggcatccagcgaggcatctgggatggagatgccaaggctgtccaacaatgtctgacagatatttttaccagcgtttacaccacctgcgacatccctgagaatgctatatttggtccctgtgtcctgagccatacttccctatatgacagcatagctttcatagctctcaagtctactgacaagagaacagtaccgtatatctttcgggtagacacctcagcagcaaatggttcctcagaaggtctcatgtggctgcggttggtccaatcggccagagataaggaagagcagaaccttgaagcctacataaaaaacggacagctgttctaccgctctctccgcaggattgccaaagacgaggagttactagtttggtacgggaaagaactgactgagttactcttgctctgcccctctagatcccacaacaaaatgaatgggtcgtccccttacacatgcctggaatgcagccaacgtttccagtttgagttcccctatgtggcgcatctgcgtttccgctgccccaagagacttcacagcgctgatataagtccccaagacgaacaaggcggcggcgtgggcaccaaggaccacgggggcggcggcggcggtggcaaagaccagcagcagcagcagcaggaggcacctttaggcccgggtcccaagttttgcaaagccggccccctccaccactacccatccccctccccggaaagcagcaacccatccgctgccgccggcggcagcagcgcgaagccatccacagacttccacaacctggccagggagctggaaaactcccggggaggcagcagctgctccccagcccagagcctcagcagcggtagcggcagcggcggcggcggcggccaccaggaggcggagctgagtcccgacggcatcgccacgggcggcggcaaaggaaagaggaaattcccggaggaggcggcggagggcggcggtggcgctggtctggtagggggccggggccgcttcgtagagcggcccctcccggcctccaaggaggatctggtgtgcacaccgcagcagtaccgagcctcgggcagctacttcggcctggaagagaacggccgcctcttcgcgccgccaagtcccgagacgggcgaggcgaagcgcagcgccttcgtggaggtgaagaaggctgcccgcgcggccagcctgcaggaggaggggacagccgacggcgcgggagtcgcctccgaggaccaggacgctggcggcggcggcggctcctccacgcccgcggccgcgtcaccggtgggcgccgagaagctgctggccccgcggcctgggggcccgctgcccagccggctcgagggcggcagtcctgcgaggggcagcgccttcacttcggtgccgcagctgggcagcgcgggcagcaccagcggtgggggcggaacgggcgccggggccgcaggcggcgcgggcgggggccagggcgccgcgtcggacgagcgcaaaagcgccttctcgcagccagcacgctctttctcgcagctgtccccgctggtgctgggccagaagctgggcgcgctcgagccatgccaccccgccgacggcgtgggccccaccagactctatcccgccgccgcggaccctctagcggtgaagctccagggggccgcggacctgaacggaggttgcgggtccctgccgagcggcggcggcggcctgcctaagcagagccccttcctgtacgccaccgccttctggcccaagagctccgctgccgctgcagccgcggctgcggcggcggccgcggggcccttgcagctgcagctgccctcggcgctcacgctgctgccgccctccttcacctcgctgtgtctgcccgcgcagaactggtgcgccaagtgcaatgcctccttccgcatgacctccgacctggtgtaccatatgaggtcgcaccacaaaaaggagtatgcgatggagcccttggtgaagcggcggcgagaggagaaactcaagtgccccatctgcaatgagtccttcagggagcgccaccacctctccaggcacatgacctcgcataattgactcggaaaggaccccagctttccacgcgcgcgcaagcacagttaagccacctgcaggaataaacacgcgagaacatccaccgcttccttgcaccccgaaaccctgcacaaagacacatacattcaccgcccccccgcccccccaacgcgcacacacacgtcctctcctcccaggaacctcattcaaatatttacccgggacacacacccccccccacacacacacacagacacactcacacacaagagccaggatggtggagttttgattgggtgggttgtttgagggggttttcttttgaatgcacgcattttcactttccccaaaacaaaggtacattttttaaaatgtcatatattgcaacatattgatgcatttgtcatacgtttctacttaaattattaagcacttacgatttagatgtaataattatatgtaagggcaaaatttattttagatataaagtaaaggaggagggtgagatgctttctgcatttcttgatgacagtttgtgttcctacaaaaataaacaaaatgaataaaaagggatcaccattcaatttgagtttccagggggaagtgcatgtataatgaaatgataatggacttcaatgaagaatgtcatcaattatgtacatatgtattttcttttaatacaaagtgtaattttgtgccagtgaaatggagtctgaatagttatgtgtttcttttatccctggaaatatttattaaactttatagtttatccgagtatgttggatgctttgacaataaatgactattttcttcaaa

SEQ ID NO: 16528 - DNA, 4095 bp, Homo sapiens
  ENST00000339711
aaaagcagcatcagacaagagctttattaatcccttacacgagcaaatgcgatctctgacctactagacttgttttcctacaatttcacaaaaagcctcgctagaggaatgtgcaaggacagaagggaaactgaggagacccgcaactcattagcgaaataatagggtgcacttcaataaaaatgcggtcctgaagtggagcagactcaccggcaaggagcccggaaaatcgtcaggggcggcggcaaaatactatcaaatcagcctgggaagcatcttttcgctcagcaagttcaagagaacaaatatgttacaatccttgcctattcttgcctccacttcataatgtcataaaagccacctggggtgtcatttatcaacctctctccagcccactcttccaaaataacactacagtttcctacatgtgtatttttgccaggactccaaagagccttgctaaagtggaacaagcaaaatcctcccctggcctcctgggactgcagtcaccaggctgtcaaagcctcaataccccactgagttccagagaagggtctcaaagctgggagaggatcaaactaacatggagtagagaattgaactgtgaaaaagaagcccgagattccccagcgacgtggtgttgcagccccgttgaaggagtcaacttgcaggctgttaaagacctcaagtcattagcatcagctgctgcactaaaggggcaagtcagcgcctctaagtggcttagcgcacaaacgaggctcccgagacggcctcggcaactccatcccctcctccaccacccgctggatgtgaaaagctttccggagcccatcttgggggaagcttggtagtgttggcgctcctgaagagagacgacgcccgtttatcacccccaggcaactagctgcgcaaatcagcggtggctccagggctagagaatccctggagctaaccgcacccctctccctttcacggaacgcggactccggggaaatacgcacggggtccgcacgcgctgggtgtccagctctctgtcacagcttctccaagtgcctagtgaaacggggaaaggccctctccaatcattttggaagagcctaaaaggcggcaacaccaacacctcttgacatggaaatacactgatacaataggcaaaaggaaacactcgattgcatcttcccggttccaggtggccttatttgggagattctatactgaccttattcctgtgatggaggatactggcatccagcgaggcatctgggatggagatgccaaggctgtccaacaatgtctgacagatatttttaccagcgtttacaccacctgcgacatccctgagaatgctatatttggtccctgtgtcctgagccatacttccctatatgacagcatagctttcatagctctcaagtctactgacaagagaacagtaccgtatatctttcgggtagacacctcagcagcaaatggttcctcagaaggtctcatgtggctgcggttggtccaatcggccagagataaggaagagcagaaccttgaagcctacataaaaaacggacagctgttctaccgctctctccgcaggattgccaaagacgaggagttactagtttggtacgggaaagaactgactgagttactcttgctctgcccctctagatcccacaacaaaatgaatgggtcgtccccttacacatgcctggaatgcagccaacgtttccagtttgagttcccctatgtggcgcatctgcgtttccgctgccccaagagacttcacagcgctgatataagtccccaagacgaacaaggcggcggcgtgggcaccaaggaccacgggggcggcggcggcggtggcaaagaccagcagcagcagcagcaggaggcacctttaggcccgggtcccaagttttgcaaagccggccccctccaccactacccatccccctccccggaaagcagcaacccatccgctgccgccggcggcagcagcgcgaagccatccacagacttccacaacctggccagggagctggaaaactcccggggaggcagcagctgctccccagcccagagcctcagcagcggtagcggcagcggcggcggcggcggccaccaggaggcggagctgagtcccgacggcatcgccacgggcggcggcaaaggaaagaggaaattcccggaggaggcggcggagggcggcggtggcgctggtctggtagggggccggggccgcttcgtagagcggcccctcccggcctccaaggaggatctggtgtgcacaccgcagcagtaccgagcctcgggcagctacttcggcctggaagagaacggccgcctcttcgcgccgccaagtcccgagacgggcgaggcgaagcgcagcgccttcgtggaggtgaagaaggctgcccgcgcggccagcctgcaggaggaggggacagccgacggcgcgggagtcgcctccgaggaccaggacgctggcggcggcggcggctcctccacgcccgcggccgcgtcaccggtgggcgccgagaagctgctggccccgcggcctgggggcccgctgcccagccggctcgagggcggcagtcctgcgaggggcagcgccttcacttcggtgccgcagctgggcagcgcgggcagcaccagcggtgggggcggaacgggcgccggggccgcaggcggcgcgggcgggggccagggcgccgcgtcggacgagcgcaaaagcgccttctcgcagccagcacgctctttctcgcagctgtccccgctggtgctgggccagaagctgggcgcgctcgagccatgccaccccgccgacggcgtgggccccaccagactctatcccgccgccgcggaccctctagcggtgaagctccagggggccgcggacctgaacggaggttgcgggtccctgccgagcggcggcggcggcctgcctaagcagagccccttcctgtacgccaccgccttctggcccaagagctccgctgccgctgcagccgcggctgcggcggcggccgcggggcccttgcagctgcagctgccctcggcgctcacgctgctgccgccctccttcacctcgctgtgtctgcccgcgcagaactggtgcgccaagtgcaatgcctccttccgcatgacctccgacctggtgtaccatatgaggtcgcaccacaaaaaggagtatgcgatggagcccttggtgaagcggcggcgagaggagaaactcaagtgccccatctgcaatgagtccttcagggagcgccaccacctctccaggcacatgacctcgcataattgactcggaaaggaccccagctttccacgcgcgcgcaagcacagttaagccacctgcaggaataaacacgcgagaacatccaccgcttccttgcaccccgaaaccctgcacaaagacacatacattcaccgcccccccgcccccccaacgcgcacacacacgtcctctcctcccaggaacctcattcaaatatttacccgggacacacacccccccccacacacacacacagacacactcacacacaagagccaggatggtggagttttgattgggtgggttgtttgagggggttttcttttgaatgcacgcattttcactttccccaaaacaaaggtacattttttaaaatgtcatatattgcaacatattgatgcatttgtcatacgtttctacttaaattattaagcacttacgatttagatgtaataattatatgtaagggcaaaatttattttagatataaagtaaaggaggagggtgagatgctttctgcatttcttgatgacagtttgtgttcctacaaaaataaacaaaatgaataaaaagggatcaccattcaatttgagtttccagggggaagtgcatgtataatgaaatgataatggacttcaatgaagaatgtcatcaattatgtacatatgtattttcttttaatacaaagtgtaattttgtgccagtgaaatggagtctgaatagttatgtgtttcttttatccctggaaatatttattaaactttatagtttatccgagtatgttggatgctttgacaataaatgactattttcttcaaagc

SEQ ID NO: 16529 - DNA, 5747 bp, Homo sapiens
  ENST00000343110
ctgggagatcagatcttctagctggctctctgctgccacagctccgccgaagggagggggtggaagaggaggactaaactcagagctgagaggagaggcaggtgtgtgcaggtgcatcacctggatcatgaggtcacccctctgctggctcctcccacttctcatcttggcctcagtggcccaaggccagccaacaagacgaccaagacccgggactgggcccgggcgcagacccaggcccaggcccaggcccacacccagctttcctcagcctgatgaaccagcagagccaacagacctgcctcctcccctccctccaggccctccatctatcttccctgactgtccccgcgaatgctactgcccccctgatttcccatctgccctctactgtgatagccgcaacctgcgaaaggtccctgtcatcccgccccgcatccattacctctatctccagaacaacttcatcactgagctcccggtggagtccttccagaatgccacaggcctgcgatggattaacctggacaacaaccgaatccgcaagatagaccagagggtgctggagaaactgcccggcctggtgttcctctacatggagaagaaccagttggaagaggtcccctcggccctgccccggaacctggagcagctgaggctgagccagaaccacatctccagaatcccgcctggtgtcttcagcaagctggagaacctgctgctcctggatctccagcacaacaggctgagcgacggcgtcttcaagcccgacaccttccatggcctcaagaacctcatgcagctcaacctggcccacaacatcctgagaaagatgccgcccagggtccccaccgccattcaccagctctacctggacagtaacaagattgagaccatccctaacggatacttcaagagctttcccaatcttgccttcattcggcttaactacaacaagctgacagacaggggactccccaagaactcctttaatatctccaacctgcttgtgctccacctgtcccacaacaggatcagcagtgtgcccgccatcaacaacaggctggaacacctgtacctcaacaacaatagcatcgagaaaatcaacggaacccagatttgccccaacgacctagtggcgttccatgacttctcctcggacctggagaacgtgccacacctgcgctacctgcggctggatggaaactacttgaagccgcccatcccgctggacctcatgatgtgcttccgcctcctgcagtccgtggtcatctaggccctactccgccaccggatctgctctgaccgcacttgaaggctggggcccaggcacctgtgccggccattcgttttctctctctccctttctttctcccagctttgcctcccttatcccaccctcgaggcagggaaaagccatctattcttctgcagcctcaggagcgagacttcaaggactcagtttggttccacccagttgaaagacacccagtgcacacccaaactcctggccttctgtggtttccctttgctccagaaacacagatgtgtctaaagacttggtgtccccttctctctcctcccccacccgccactcctgggtacatctgggccgtggactatctgatcttggtcctggccgagcaaacagcccggaggtaaggttcagaaagtccccctggggactcctccatcttcggcagctctggctcaaagaggccgagaaacccagttctcctgggccaaggatcccttctggcaaagctgctgctccgccgcttggttccccggcaccagacatcgccctggccctgctggcccgggtatcgggaaggaggagcgagggaatgacggaggtagggtgcagggtcagggctcccgcaggggcctgcatctggccagcaggacacagggatgcgcagggcgcccccttctgttccagggtgaacatagcacacgccctcctggctgggcctcaggaggaacagccaaggagaagaatggcccaaggaactaggaagcagccatgggagaggggaagggttcaagcccgggatgggcccgcgtgacgtcgatgggtcctgcggcccccttgcccaacctcgggtttagggaggagggttcacagtgtttttgtgggggcgggggaaggaagaggcagccccgcccccgccatctgttctccatcagtgtgcgcggcccagccatttccaccctcgggaggcggctcctgagaaacagggaggaaggggcggagcacctggacgtctcccagaagcccctccacgtttgaaaatgcgcctcctcctcggagacagacgcatcggtgccacctagtggctggtgggagtaacagctggtcccagtcttgcgcctggccctcttcctggggtgattttcctcggtggaggaggcccgtggggtcccaacacggaagagccatgggccgtgtgcatggtgtcgctctcctctagggtctagcgggcacaaacgtccccaggctgggctcattcccatcgtgagtgagcccaggtgaggacatagtcggctcccgtttgttgtaggcccttcccaggtgccttctcagctccctcatctgtaaaccgaggaggtggataagatgctcccggccgggcgcggtggctcacgcctgtaatcccagcactttgggaggccgaggcgggcagattattgcctgagctcaggagttcgaaaccaccctgggcaacatggtgaaacccccgtctctactaaaatacaaaaaaattagccaggcatagtggcgcgcgcctataatcccagctactgggaggctgaggcgggagaatcgcttgagccggggaggcggaggttgcagtgaggcgagattgtgccactgcactccagcttgggcgacagagtgagactccgtctcaaaaaagaaaaaaaaaagatgctcctctgaggtccctccggcgctcatgttccgagtctgcagctccacactttaaatcatactcgaatgcaggacaagtcctaaatatttgccccttcccttgcagtaatttattttctgtatggactgtccctcccccagaggcttccccaccctccattgcctggcccaggtgagcagcttggcaggtctccaagtggaacccggtccagacagggctgcctcgacttcacctttccccctaacttcctccaagggatgctgccccttctcagccccctgcgtgtgtatattggtgggaggcatagaggatggatgttctagaaatgagtaagacacagtgcccacccccaagttaggatgaaaaaagttccagaggtttttaagaaattggattaagctgggtccctaacttcaagaaattcccattatgctccttctcacctttcttttttgctaattatggaaaatagggcccatttcatcatagcctccttcccccgtgctccactacaatcgccgcattctttctagctgcagctggtttcttcaaggctcctgcttaaagtccacacgttattatggccgaaagcaacctggtgcttcggcctggataagagccccttctgcatcttattcacagcttgcagcctcagcccctttgatgaggccctcaggggagaggtcattaccttgatcctgcaaacccagactcgttgagcagcaacgcaatcaccatcatcccactgcccaatctagaatatgtctgctctcctttgctctctgcagctgtaagccagaggggattcaaggtaaataggctttacaggctcccctcctccaaacacacacagaatgggctggtttctttcaagtttaaaaaaagcccccttctccatgcacaagttcattccctccatgctgtcgtcatcgacatatacaggtgtgtacgtaggtgtatgtgtgtactctgcacgtatatctcttctgtcttgaagaccctgttaactttgtgaaataacttccacatttcaacacacttcacagtacaggaaataaagtaatatgaaaaacaccctgcgtgaactcaacggtgtgaacaggtcaagaataacacttcaaagtcatcttgccagccaggcgtggtggatcacgcctgtaatcccagcactctgggaggccaaagcgggcagatcacctgaggtcaggagttcaagaccagcctggccaacatagtgaaaccccttgtttactcaaaatacaaaaattggctgggtgcggtggtacatgcctgtagtcccagctacttgggaggctgaggcaggagaattgcttgaaccctggaggcagaagttgcagtgagccgagatcgcaccactgcactccagcctaggagacaaaacgagacttcatttaaaaaaaataaaaataaaaataaaaataaagtcatcttgccacccaccccctaccattgagccaccatgcccagccccaaagcctcttaattgctctaacaagatgagtggggaaaagattatactcttaagaaattcctacgaaagctatccaaaagccttttctttcctcttttcttattatttttaaatagaggcagggtctcattatgttgcccaggctggtctggaactcctggcctcaagtgatcctcccaccttggcctccccagagtgctgggattacacacgtgagtcaccatgcccagccccaaagccatttcttgaagaatttctcgcaaactcacaaccctcatgaaaaattaatcctcagttccacgagactgcccacccacagacaaaaaaatatatatattcctaaagtcggaccagaaatctgacagctgcctttgaaacccaaagcctcgggttctttcaagctacatgtactaaattgtcgaaggtctcccaggagctctgtactgaggcagacacagaaagacacaaaacggtcgtctttcctgcccaagtaaagcttacagactaactggggagatgtagtgtgcatacaaaacagtaaaagagccatctcaaggacagagagcatagaccaagtcatctggaatggtctacatgccatgcggaagtccaccgaagggttagaacagggtgtcccagactctctcttctgagggaaggttggttgcaaaagtgggattcatgaccctcccaggctacaccatcttctttagaatgagaactgccaggtgacgccctcgctgctcctacctggctactaaacatcgacttcggttcacttcacggatgttcagtggatatcggtcacatgccaggtccccagctacgcattcaaggatggataatatacatagcagcacatccttgaggaactcataccttggtaaagggaaagaaatccatgaatggatacctctgtgtcctaagtgtttgtaataatgctgtgtgtcaggcctctgagcccaagctaagccatcatatcccctgtgacctgcatgtgcacatccagacggctggttcctaccttaactgatgatattccaccacaaaagaagtgaaaatggctggtccctgccttaactgatgacattaccttgtgaaattccttctcctggctcatcctggctcaaaagctcccccactgaacaccttgcaacccccacccctggccaccagagaacaaccccctttgactgtaattttccattacctacccacatcttataaaatggccccatccctatctcccttcgctgactcttttcggactcagcccgcctgcacccaggtgaaataaacagccttgttgctcacacaaa

SEQ ID NO: 16530 - DNA, 4682 bp, Homo sapiens
  ENST00000482556
ggccgttttcagaggtggagtccatcctcaaccagtccttctgctcccgccgccctctgcgcctcctggtggccacgaaggccaaagagatcatcaaaatccccgaccagccggacacactgtgcttccagattcgtggagctgccccaccgtacgtctatgctgtggggagaggctctgaggccatggctgcagggctctgtgctggtcagtgcattctgaaggtcaatggcagcaacgtgatgaacgatggtgcccctgaggtcctggagcacttccaggcattccggagtcggcgcgaagaggccctgggcctgtaccagtggatctaccacacccatgaggatgcccaggaagcacgagccagtcaggaggcctccactgaggaccccagtggcgagcaggcccaggaggaagaccaggctgattcagccttcccactgctgtccctgggtccccggctgagcctgtgtgaggacagccccatggtcaccctgactgtggacaacgtgcacctggaacacggcgtggtgtatgagtatgtgagcacggcaggcgtcaggtgccatgtgctggagaagatcgtggagccccgcggctgcttcggcctcaccgccaagatcctcgaggcctttgctgccaatgacagcgtcttcgtggagaactgcaggcggctcatggccctgagcagcgccatcgtgaccatgccccactttgagttccgcaacatctgtgacaccaagctggagagcattggccagaggattgcctgctaccaggagtttgcagcccaactgaagagcagggtcagcccacccttcaaacaagcccccctggagccccacccgctgtgtggcctggacttctgccccaccaattgccacatcaacctcatggaagtgtcctaccccaagaccaccccctcagtgggcaggtccttcagcatccgctttggacgcaaaccctccctcatcggccttgacccggagcaaggccacctgaaccccatgtcgtacacccagcactgcatcaccaccatggctgctccctcctggaagtgcttgcctgctgcagagggtgatccccaaggccagggtctccatgatggcagcttcgggccagccagtgggacccttggtcaggaagaccggggcctcagcttcctactcaagcaggaggaccgtgagatccaggatgcctacctgcagctcttcaccaagctggatgtggccctgaaggagatgaagcaatatgtcacccagatcaacaggctgctgtccaccatcacagagcccacctcgggtgggtcctgcgacgcatccttggctgaggaggcctcctccctgcccctggtcagtgaagagagcgagatggacaggagtgaccatgggggcatcaagaaggtgtgcttcaaggtggccgaggaggaccaggaggactcaggccacgacaccatgagttatcgcgactcctacagcgagtgtaacagcaatcgagactcggtcctgtcctacaccagcgtgagaagtaacagctcctacttgggcagcgacgagatggggtctggagatgagctgccctgtgacatgcggatcccatctgacaagcaggacaagcttcatggctgcctggagcacctctttaaccaggtggactccatcaatgctctcctcaaggggccagtcatgagccgggctttcgaagagaccaagcatttccctatgaaccacagcttacaagagtttaaacagaaagaagagtgtacaatccgtggccggagcctgatccagattagcatccaggaggacccctggaacctccccaactccatcaagaccctggtggacaacattcagagatatgtggaagatgggaagaaccagctgctcctggccttgctgaagtgcacagacacggagctgcagctgcgcagagacgcgatcttctgccaggccctggtggccgccgtgtgcaccttctccaagcagctgctggcggccctgggctaccgctacaacaacaatggcgagtacgaggagagcagccgcgacgccagccgcaagtggctggagcaggtggcggccacgggcgtcctgctgcactgccagtccctgctctcgccagccacagtgaaggaggaacggaccatgctggaggacatctgggtgacgctgtcagagctggacaatgtcaccttctcctttaagcagctggacgagaactatgtggccaacaccaacgtcttctaccacattgagggcagccggcaggcgctgaaggtcatcttctacctcgacagctaccacttctccaagctgccctcccgcctggagggtggggccagcctgaggctgcacacagcgctgttcacgaaaggtgagcttcaggcctggggcagggaggaccacgggggccgggccaaggccaccaagcacaccggctcccaaccgcctgcccgcccccgacatctcccctcccagtgctggagaacgtggaggggctgccttctccaggcagccaggccgcggaggatttgcagcaggacatcaacgcgcagtccctggagaaagttcagcagtattaccgcaaactcagggcattttacctggagcggtctaacctgcccacggatgccagcaccacggcggtaaagatagaccagctgatccgccccatcaatgccctggatgagctctgccgcctcatgaagtcctttgtccacccaaagcctggtgctgctgggagtgtgggcgccggcctcatccccatctcctcggagctctgctaccgcctgggggcctgccagatggtcatgtgtggcacaggcatgcagaggagcaccctgagcgtgtccctggagcaggcggccatcttggcacggagccacgggttgctgcccaagtgcatcatgcaggccacggacatcatgcggaagcagggcccaagggtggagattctggccaaaaacctgcgagtcaaggaccagatgccccagggtgctccgcgcctctaccgcctctgccagccgccggtggatggggacctctgaacacccaaatgccccacgctgggccgcggcctctggagctgggatttgggaggacacagcaggcagcgctggccttctccagggatggcccaaggcttccgcagccgcccgttccgggacctgcccagcgtcctccctgcctccttccgggacaagcctggccaccctcgctgtgatgacgagctggctgattggccctgggccggcccattcttcacacgcctgccagaagctggaggggtgctggagacccatagagctgatgggagcagctggtgcctggccttcggctcctgcgtccccagaacccaagggaacgtcatggaggccacatggggccacccggctccctcgggatggctccgcctgcacttttgaaaccccggtttccttcaacgtccacattccaggtgaccacacgtgtctcctcctcctcatcttagcttccaggttcaccctaaccctgtactaacctgcttggtggacttggaaaagacttggctctgtcgggaaaggagagacggggcctccatcacgcctgttaccagaggatccccgagagccacaccagctctggacatcaccgcccctggaactggggccaccagccctgggcacgagatttgctctgactttatttatatggcatgaaatctctggtttattttgggattttttgttgttggtgttgtcaaagtttgttttttctaaagttgtgtgattatatatttgacattttacatttcaaagaaaggtatgttgtctaacaggggaccaacagaaggtagtattgacaactgttcctgcttctactaaaaaaaaaagagcacaaaagaaaaactaaattattgaaaaattaaaaaatgtcattgtttcctgtttgttaatattagggttgtaaggtgtcgttttgaggtatcgactgtgattccttcccccaccctccattctccagcggttggccggtgttagaactcgctctctttgagtgactggctacaagggcctgagaggtggccagccagggttggagctggaggggatggagccccacctgaggtgccgtgtcacacgggttagagggtcactgggaaacaccgggcggtggcttctgtgatttattttcttgatggtaacttctcagagcagggcgattgggacatcaccagccagagcacaggaagccaccctgcctgctggggaggagggacccacacaagccccctcggcagtttgtccccccagcttcggtatgccttcagggaaaggtcacagctggggaggaagcggggggacgcctgtcacccctggcaggtggtgagttcaggtgggggctccctgctgcccccaggcctgggagcttgaagccctcccggcatctggcatccgagcctcccgccctccagggtgcgcttccctctcttgccgcagcatacacgagggcaggcagtggccttgtcactgtatcttgcatcagagacaaaggaggacccgctttagccctgctgcgggaaatgggggagggcccagggccagcgcattgtgcactggtttactttaaaatgtacagattcttctcgttaaattcttgatagattttttattattattaaaagtcagtttataatacaaa

SEQ ID NO: 16531 - DNA, 6636 bp, Homo sapiens
  ENST00000371941
cggcgccgcgcggccgcgctagaatggaggcgcccagcggcagcgagcccggcggcgacggggccggggactgcgcccacccggacccccgggcccctggcgccgcggcgcccagctccggccccggcccgtgcgcggccgcccgggagtccgagcgccagctgcgcctccgcctctgcgtcctcaacgagatcttgggcaccgagagggactacgtgggcaccttgcgcttcttgcagtcggcattcctgcatcgcatccggcagaacgtggccgactcagtggagaagggcctcacggaggagaatgtcaaggtcctgttctcgaacatcgaagacatcctggaagttcataaggatttcttggccgccttggagtattgtttacacccggagccgcagtctcagcatgaacttgggaatgttttcttaaaattcaaggacaagttctgcgtgtacgaggagtattgcagcaaccatgagaaagccctgaggctgctggtggagctgaacaagatccctaccgtgcgcgccttccttttgagctgcatgcttctgggaggccggaagaccacggacatccctttggaaggctacctgttgtctccgatccagaggatctgcaagtacccgctcctccttaaggagctggccaagaggactcccggcaagcacccagaccaccccgcggtccagagtgccctgcaggccatgaagaccgtttgctccaacatcaatgagaccaagcggcagatggagaagctggaagccctggagcagctgcagtcccacatcgaaggctgggagggttccaacctcacagacatctgcactcagctcctcctgcaagggactttgttaaagatctctgcgggcaacatccaggaaagggccttcttcctcttcgacaaccttctcgtctactgcaagcggaaatccagggtcaccgggagcaagaagtccaccaagaggaccaaatccatcaacggctccctctacatcttcaggggtcgaatcaacactgaagtcatggaggtggagaatgtggaagatgggacagcggattaccatagcaacggctataccgtcaccaacggctggaagatccacaacacggccaagaataagtggtttgtctgcatggccaagacggcagaggagaagcagaagtggctggatgccatcatccgcgagcgggagcagcgcgagagcctgaagctgggcatggagcgtgatgcctacgtcatgattgcggagaagggggagaagctgtaccacatgatgatgaacaagaaggtgaacctcatcaaggaccgccggagaaagctgagcactgtccccaagtgctttcttggcaatgagttcgttgcctggctcctagaaattggtgaaatcagcaagacggaagaaggagtcaacttgggccaagccctgttggagaatggcatcatccaccatgtttccgacaagcaccagttcaagaatgagcaggtgatgtatcgcttccgctacgacgatggcacctacaaggcccgaagtgagctggaggacatcatgtccaagggtgtgaggctttactgccgtcttcacagcctctacaccccggtgatcaaagaccgtgattaccacctgaagacctacaagtcagtgcttcccgggagcaagctggtggactggctgctggctcagggagactgccagactcgggaggaggcagtggcgctcggcgtgggtctgtgcaacaatggcttcatgcaccacgtgctggagaagagcgagttcagggatgagtcccagtacttccgctttcatgctgacgaggagatggaggggaccagcagcaagaacaaacagcttcgcaacgacttcaagctggtggagaacattctggccaagcgcctgctgatcctgccccaggaggaggactatggctttgacatcgaggagaagaacaaggctgtggtggtgaagtccgtccagaggggctcgctggctgaggtggctggcctgcaggtggggaggaagatctactccatcaatgaggacctggtgttcctgcggccgttttcagaggtggagtccatcctcaaccagtccttctgctcccgccgccctctgcgcctcctggtggccacgaaggccaaagagatcatcaaaatccccgaccagccggacacactgtgcttccagattcgtggagctgccccaccgtacgtctatgctgtggggagaggctctgaggccatggctgcagggctctgtgctggtcagtgcattctgaaggtcaatggcagcaacgtgatgaacgatggtgcccctgaggtcctggagcacttccaggcattccggagtcggcgcgaagaggccctgggcctgtaccagtggatctaccacacccatgaggatgcccaggaagcacgagccagtcaggaggcctccactgaggaccccagtggcgagcaggcccaggaggaagaccaggctgattcagccttcccactgctgtccctgggtccccggctgagcctgtgtgaggacagccccatggtcaccctgactgtggacaacgtgcacctggaacacggcgtggtgtatgagtatgtgagcacggcaggcgtcaggtgccatgtgctggagaagatcgtggagccccgcggctgcttcggcctcaccgccaagatcctcgaggcctttgctgccaatgacagcgtcttcgtggagaactgcaggcggctcatggccctgagcagcgccatcgtgaccatgccccactttgagttccgcaacatctgtgacaccaagctggagagcattggccagaggattgcctgctaccaggagtttgcagcccaactgaagagcagggtcagcccacccttcaaacaagcccccctggagccccacccgctgtgtggcctggacttctgccccaccaattgccacatcaacctcatggaagtgtcctaccccaagaccaccccctcagtgggcaggtccttcagcatccgctttggacgcaaaccctccctcatcggccttgacccggagcaaggccacctgaaccccatgtcgtacacccagcactgcatcaccaccatggctgctccctcctggaagtgcttgcctgctgcagagggtgatccccaaggccagggtctccatgatggcagcttcgggccagccagtgggacccttggtcaggaagaccggggcctcagcttcctactcaagcaggaggaccgtgagatccaggatgcctacctgcagctcttcaccaagctggatgtggccctgaaggagatgaagcaatatgtcacccagatcaacaggctgctgtccaccatcacagagcccacctcgggtgggtcctgcgacgcatccttggctgaggaggcctcctccctgcccctggtcagtgaagagagcgagatggacaggagtgaccatgggggcatcaagaaggtgtgcttcaaggtggccgaggaggaccaggaggactcaggccacgacaccatgagttatcgcgactcctacagcgagtgtaacagcaatcgagactcggtcctgtcctacaccagcgtgagaagtaacagctcctacttgggcagcgacgagatggggtctggagatgagctgccctgtgacatgcggatcccatctgacaagcaggacaagcttcatggctgcctggagcacctctttaaccaggtggactccatcaatgctctcctcaaggggccagtcatgagccgggctttcgaagagaccaagcatttccctatgaaccacagcttacaagagtttaaacagaaagaagagtgtacaatccgtggccggagcctgatccagattagcatccaggaggacccctggaacctccccaactccatcaagaccctggtggacaacattcagagatatgtggaagatgggaagaaccagctgctcctggccttgctgaagtgcacagacacggagctgcagctgcgcagagacgcgatcttctgccaggccctggtggccgccgtgtgcaccttctccaagcagctgctggcggccctgggctaccgctacaacaacaatggcgagtacgaggagagcagccgcgacgccagccgcaagtggctggagcaggtggcggccacgggcgtcctgctgcactgccagtccctgctctcgccagccacagtgaaggaggaacggaccatgctggaggacatctgggtgacgctgtcagagctggacaatgtcaccttctcctttaagcagctggacgagaactatgtggccaacaccaacgtcttctaccacattgagggcagccggcaggcgctgaaggtcatcttctacctcgacagctaccacttctccaagctgccctcccgcctggagggtggggccagcctgaggctgcacacagcgctgttcacgaaagtgctggagaacgtggaggggctgccttctccaggcagccaggccgcggaggatttgcagcaggacatcaacgcgcagtccctggagaaagttcagcagtattaccgcaaactcagggcattttacctggagcggtctaacctgcccacggatgccagcaccacggcggtaaagatagaccagctgatccgccccatcaatgccctggatgagctctgccgcctcatgaagtcctttgtccacccaaagcctggtgctgctgggagtgtgggcgccggcctcatccccatctcctcggagctctgctaccgcctgggggcctgccagatggtcatgtgtggcacaggcatgcagaggagcaccctgagcgtgtccctggagcaggcggccatcttggcacggagccacgggttgctgcccaagtgcatcatgcaggccacggacatcatgcggaagcagggcccaagggtggagattctggccaaaaacctgcgagtcaaggaccagatgccccagggtgctccgcgcctctaccgcctctgccagccgccggtggatggggacctctgaacacccaaatgccccacgctgggccgcggcctctggagctgggatttgggaggacacagcaggcagcgctggccttctccagggatggcccaaggcttccgcagccgcccgttccgggacctgcccagcgtcctccctgcctccttccgggacaagcctggccaccctcgctgtgatgacgagctggctgattggccctgggccggcccattcttcacacgcctgccagaagctggaggggtgctggagacccatagagctgatgggagcagctggtgcctggccttcggctcctgcgtccccagaacccaagggaacgtcatggaggccacatggggccacccggctccctcgggatggctccgcctgcacttttgaaaccccggtttccttcaacgtccacattccaggtgaccacacgtgtctcctcctcctcatcttagcttccaggttcaccctaaccctgtactaacctgcttggtggacttggaaaagacttggctctgtcgggaaaggagagacggggcctccatcacgcctgttaccagaggatccccgagagccacaccagctctggacatcaccgcccctggaactggggccaccagccctgggcacgagatttgctctgactttatttatatggcatgaaatctctggtttattttgggattttttgttgttggtgttgtcaaagtttgttttttctaaagttgtgtgattatatatttgacattttacatttcaaagaaaggtatgttgtctaacaggggaccaacagaaggtagtattgacaactgttcctgcttctactaaaaaaaaaagagcacaaaagaaaaactaaattattgaaaaattaaaaaatgtcattgtttcctgtttgttaatattagggttgtaaggtgtcgttttgaggtatcgactgtgattccttcccccaccctccattctccagcggttggccggtgttagaactcgctctctttgagtgactggctacaagggcctgagaggtggccagccagggttggagctggaggggatggagccccacctgaggtgccgtgtcacacgggttagagggtcactgggaaacaccgggcggtggcttctgtgatttattttcttgatggtaacttctcagagcagggcgattgggacatcaccagccagagcacaggaagccaccctgcctgctggggaggagggacccacacaagccccctcggcagtttgtccccccagcttcggtatgccttcagggaaaggtcacagctggggaggaagcggggggacgcctgtcacccctggcaggtggtgagttcaggtgggggctccctgctgcccccaggcctgggagcttgaagccctcccggcatctggcatccgagcctcccgccctccagggtgcgcttccctctcttgccgcagcatacacgagggcaggcagtggccttgtcactgtatcttgcatcagagacaaaggaggacccgctttagccctgctgcgggaaatgggggagggcccagggccagcgcattgtgcactggtttactttaaaatgtacagattcttctcgttaaattcttgatagattttttattattattaaaagtcagtttataatacaaa

SEQ ID NO: 16532 - DNA, 478 bp, Homo sapiens
  ENST00000496915
gaaacagtagcagtgctttacaatcttgtcatgcgttagtgcctgttgtccattttgcagatgaagaaactgaggctcagagaggtcaggtgatttgccctgtggctcacagccaggacctggtcttcagactccacatcccttgtgggtttggagttctgtagctgtatccccctcttaggaaagtgctggggatggtgtgaggtggggcaggaatgactgatggctgctgcttctacctcctgccaggagatgagctgccctgtgacatgcggatcccatctgacaagcaggacaagcttcatggctgcctggagcacctctttaaccaggtggactccatcaatgctctcctcaaggggccagtcatgagccgggctttcgaagagaccaagcatttccctatgaaccacagcttacaaggtgaggggatagccagtccaaggtgacagcctgcgatggggaagggtgttagaca

SEQ ID NO: 16533 - DNA, 362 bp, Homo sapiens
  ENST00000620554
gaagatgggacaggtagcccctcccccagccttgcctgagccctgcctgagccctgcctgctccctggcactctctctgtttcatttaaatatatttttttcttttatcatgagatgtaatctacctacagaaaagtgcccagagcatagatgcatgaagcgaacatctgggtggttagcattcaagttaagaaataaaacactgcaccccaaatccttcctccttgcaatgccttcttccccctagaagtaaccactgtctgaattttgtgatgatcattttcttgctttttaaagacatttttacctcctaagcatttatgactaaacattttaattaaaatttctatttttgagcctta

SEQ ID NO: 16534 - DNA, 10750 bp, Homo sapiens
  ENST00000288368
gccagagcagcggggccgggcgcgcagggcctggccggagcccccactcccaggagtttcctctgcagagccccgcgccccccgcgccgggatttcagcccgatcccctcctctccctgcgcccagcctctccccagcatgtaaagtcttctgtctctcctcggagttggcggaggcggcaactttccattctcgccgccgggggccgggcagcagcgggcgcgcgggtcagcgctcagcacggcgggcagcgccgcgctgcgcaccgccgccgaccatgagcgaggacagccgcggagacagccgcgccgagagcgccaaggacctggagaagcagcttcgcctgcgcgtgtgcgtgctcagcgagctccagaagaccgagcgggactatgtgggcacgctggagttcctggtgtcggcattcttacacagaatgaaccagtgtgcagcatcaaaagttgacaaaaatgtgacagaagaaacagtgaagatgttgttctcaaacattgaagacatccttgcagtacataaagaattcttaaaagtcgtggaagaatgcttacaccccgaacctaatgctcaacaagaagtgggaacctgctttcttcactttaaagacaagtttcgtatctatgatgaatattgtagtaaccatgagaaggcacaaaaattacttcttgaactcaacaaaataagaacaatccggacatttcttttgaactgcatgctgcttggaggacggaagaacacagatgttcccttggaaggatatttagtaacaccaatacaaagaatatgcaagtaccctcttattttgaaggagttgctgaagcggactccacggaaacacagtgactatgcagcagtgatggaagccctccaagccatgaaagctgtctgttccaacataaacgaggccaagagacagatggagaagttagaagttttagaggaatggcagtctcacattgaaggctgggaggggtccaacatcactgacacctgcactgaaatgctaatgtgtggagtcttactgaaaatttcttctggaaatattcaagaacgggtgttttttcttttcgataatcttttggtgtactgcaaaagaaaacacagacggttgaagaacagcaaggcatctacagatggacatcggtacctttttcgtggccggatcaacacggaggtgatggaagtggagaatgtggatgatggcaccgctgatttccatagcagtggacacattgttgttaatggatggaagatacataacacagcaaaaaataaatggtttgtttgtatggcaaaaacacctgaagagaagcatgaatggtttgaagctattttgaaagaaagagaacggcggaaaggtttaaaattaggaatggagcaagatacctgggtcatgatctctgaacagggtgagaaactttataaaatgatgtgcagacaaggaaatctgatcaaagaccgaaagagaaaactgactacgttccctaaatgctttcttggaagcgaatttgtgtcatggctgttggaaattggagagattcacaggcctgaggaaggcgtgcacttgggacaagcattattagaaaatggaatcattcaccatgttactgataaacatcaattcaaaccagaacagatgttatatagatttcgctatgatgatggaacattttatccaagaaatgagatgcaggacgtgatttcaaagggtgtaagattatattgtcgtcttcatagcctttttactccagtgataagagataaagattaccatttaaggacctacaaatctgtggtcatggccaacaaactgatagactggttaattgcacagggagattgccgcaccagagaagaggcaatgatatttggcgttggactctgtgacaatggatttatgcaccatgtccttgaaaaaagcgaattcaaagatgaacccctacttttccgttttttttcggatgaggaaatggagggatcaaatatgaaacatcgacttatgaaacatgacttaaaagttgtggaaaatgttatagctaagtcattattgattaaatccaatgaaggcagctatggctttggattagaagacaaaaataaagttccaataataaagttggtagaaaagggatctaatgctgagatggctggcatggaagtcgggaaaaagatttttgctattaatggtgacctagtttttatgagacctttcaatgaagtggattgcttcctgaaatcgtgtttaaacagcagaaaacctctaagagttcttgtgagcacaaagccaagagagacagtgaaaattccagattcagctgatggacttggcttccagatccggggatttggcccttctgttgtgcatgctgtaggaagaggaactgtggctgcagcagctggtcttcaccctggacagtgcattatcaaggtgaatggaatcaatgtcagcaaagagacacatgccagtgtcattgcacacgttacagcctgcaggaagtacaggcggccaacgaagcaagattccatacaatgggtttataatagcattgagagtgctcaagaagaccttcaaaaatctcactccaagccccctggagatgaagcaggggatgcttttgactgtaaagtagaagaggttattgacaaattcaacactatggccatcattgatgggaagaaggagcatgtgagtctgacagtggacaatgtccacctggaatatggtgtcgtgtatgagtacgacagcacagctggcatcaagtgcaatgtggtggaaaagatgattgagcccaaaggtttcttcagcttaactgccaagattcttgaagccctggctaaaagtgatgagcattttgtacaaaactgtaccagcctaaattctctaaatgaagtgattcctactgaccttcagagtaaattcagtgccctttgcagtgaaagaattgaacacctatgtcagagaatatccagttataaaaagttttctcgtgtactgaagaatagggcctggcctacttttaaacaggccaaatctaaaatctccccactgcacagcagtgatttctgccctaccaactgccatgtcaatgtgatggaagtttcttatcccaaaacatcaacctctttgggaagtgcatttggtgttcagttggatagcaggaagcataattctcatgataaagaaaacaaatcttcggagcaagggaaactgagccctatggtgtacattcagcacaccatcacaaccatggcggccccttcaggtctgtctctgggacagcaggatggccatggtctcaggtatctgctaaaagaagaagacttagaaacccaagacatctatcagaaactgctgggcaaacttcagactgcactgaaagaggtggagatgtgtgtttgtcaaatagatgaccttctgtcttcaataacatattctcctaaattagaacgtaagacatcagagggcataataccaacagacagtgacaatgagaagggagaaagaaacagcaaacgggtatgttttaatgtagcaggagatgaacaggaagattctggtcatgacaccatcagcaacagagactcttacagtgactgcaacagcaataggaattccatcgcctccttcaccagcatctgcagcagccagtgcagctcgtatttccacagtgatgaaatggactcaggtgatgaacttcccttaagtgttcgcatatctcatgataaacaggacaagatacatagttgccttgagcatcttttcagccaggtggattcaattaccaatctcctaaaagggcaggctgttgtgagggcctttgaccaaaccaagtatctcactccaggccgaggattgcaagaatttcaacaggaaatggaaccaaagctgagttgtccaaaaaggctacggcttcatatcaagcaagatccttggaatcttcccagcagcgtccggactcttgctcagaacatcaggaaatttgttgaagaggtaaagtgtaggctactcctggctcttcttgaatattcagatagtgagacacagctccgtagagacatggttttctgccagactcttgtggccactgtctgtgccttctctgagcagctcatggcggccttgaaccagatgtttgacaacagcaaggaaaatgagatggaaacttgggaagccagcaggaggtggctggaccagatagcgaatgcaggtgttctttttcactttcagtcacttctgtcaccaaacttgacagatgaacaagccatgttagaagatacactggttgcactatttgatttggaaaaggtttccttttactttaaaccatcagaagaggaacctctggttgcaaatgttcctcttacatatcaagcagaaggaagtcggcaagctctgaaagtttacttctacattgatagttatcattttgaacaacttcctcaacggctgaaaaatggaggagggtttaaaattcatcctgttctttttgcacaagcactagagagcatggaaggatattattacagagacaatgtttctgtggaagaatttcaagctcagataaatgcagcctcactggaaaaggtcaaacagtacaaccagaagctcagggcattctacttggacaagtcaaattcaccaccaaactccacatccaaagctgcctatgtagataagctaatgaggcctctcaacgctttggatgaactttaccgactggtagcctcgtttatcagatccaagcgcacagctgcctgtgcaaacacagcttgcagtgcttctggggttggactgctgtcagtttcctcggagctgtgcaacaggctgggcgcctgccacatcatcatgtgcagcagcggtgtgcatcggtgcaccctgagcgtgacgctggagcaagccatcattctggccagaagccacggactgccacctcgttacatcatgcaggctacagatgtgatgcggaagcagggagcaagagttcagaacacagcgaagaatttgggagtcagagaccggactccacagtctgcaccaaggctgtacaagctgtgcgagccacctcccccagctggagaagaatgaaaagaactcccaagaaaccaggcaggcagaagctcctgaatgctggactagacaaactacatgctggctaaacattctccactgaagatacatcaatgcttttttttttttttttttctgtaaatctttcttcccattgcaaacaagtagtgatcagtttatactttgatatttatgctggaaatggatagaagttcaatcagacagttcagcttcacgaactgatgtctctctgtattgacattaagtattcacttttagagtaaaatccatccctgggacataaagaaaaaaatattagagatttaaaaattaaccaccatgcctcctctcccattcattaaaatggttttattatgcttgttttcatctttcccaagtggacacatgtaataatggagagttcctcttgaagaaggccattattgaagaaacctggcgacatcttgcaaatcatcatgagaaatgttaaggacaatatagactgtgtgctatacattttcagtcccccatttgcaagagagaaagtcattaatgtgtaaaaggtggaaaagcatgctttactctttctcctaagggcttatttcttattagaggagaagaaagctgactaaggcctccagcaggactcactttcttctagctgcctttgggcatcctttattcttgtggacagctctagcaaatcaatgctatttttggtgtctgcaatgggcatggcttccttgggccatgaatactgggtgctgtgccataatggccctggggatcagggaagtgccctggggatcagggaggggaaccaggatgaagaaggggactgtaagcctattttaaaactaaacctttaagttagatacctaaaactcttaattttatgaaggctctcatatgagaggtcagactcttcaaagaatacaccatcatgagaatttttctgttaagatatatgtataagatatgaaaataaggctttatttgtactttaaaaggaccattaggggacttgtaatttatggatgcacaaggtgtattctatccttattctaaagtatatgtaatgtttatcatttctacattgatgcaataacattgtttttagcatagtaaatacagtaatatttattttaaatccataattttcaaacaaaacactcatgattgtgataattatatgggtttacactaatttagtatgtgaaatgcttttcatatctaaattatgtgcaaactattattaattttttttttattttttgaaactgagtctcactctgttacccagactggagtgcggtggtgcaatcttggctcactgcaacctccacctcctgggttcaagccattctcttgcctcagcctcccaggagctgggactacaggtgtgcaccaccatgctcagctaatttttgtatttttagtagagacgtgttttcaccatgttggccaggctggtcttgaactcctgacatcaagtgatccacccacctcagcctcccaaagtgctaggattacaggcgtgagccgctgctcccggcccattattaaattttaatttatgaaatttgatcatggttttcaaactattattaaaacctttatcattaaccattatgtattgaataacaaaaataccatgttacatgtgtaggcaatatgtgtatactactaggtaaggtaataataattgttatttggcacagaagctctagagacttttgtgagaagtccatatacaatgaaaaacaaggaacctaacatcagagttttcaagaaaaagttgaacattttgaatttaataaagatatctttacaaaaataaccttcaaggatttaacatttgtaggactaataaaggaacacagctgattagctagcaagtcctttcatattgtcatgactgttttctcatcaccatcctggaagcagtaatcctcattagaggcatgcaagggtcattaaaatgatttcagttgtactttgccatatttcatggggcaaattatcagctatattgtggtatttataagctaacatattttatatttttaaggatctactttcttcataatagaatgtgcttcatattatttttagggttaaacataagtgtgtcgtctatcatgcttggtacttactaaatgctcaaaaattagtaatggtttatattaacatcagtcactctaacttctgatcgtaataaaaattgtagctaacacttattaagggattactacatgcccagtaatacctccaaatgctttgcctgtattctgttgttattgcttcacttaatcctcataataatgacgtgacatggtactctttttatcgcgcccatttttagagttgaggaaccaaagcaaagaataacccagtgacttgcacaaagtcacatgattgacaaggggtagaaccaaaatttgaacccaggaagtctgccttcttaatgcattatgctacttttccttatcaatataagaactattgtaatattacgatgatttgtaagtaaatttggagttatgcggcatgtgttgtcattaaattatacatcttgtattaaaaaacggtgaatggaaatatgtaaatgctttaattatatgaaaattatagtgtttcctggacattttacaactctggatgcacattttgaggtaactcaacagtgttgcaatctgaaaaactattttgtatcatgttcctcctcatcaaaaataacagttttagatagtacatctcatacaactttattataattccaacacagtggtaagagtaaaaaacatacctaatggatgaatgaataatgacaattttttcaatgccatatgtacctccatgtgacattgggcattaaatggccttgaggttttaggatgtgtttaccttaatgctacatgctcctctataaccagtgcaccttcaaatactgctaaaacctgctaacttcttccaggttctgagcatggacaactcccaccgccccccaacctaaaagggaaggtcatgcatagaaagtttggattttaacttagagcctgactcaaaaataattgtgaactaaaaattcatagtcaatactttttaagcattctattatctcctataattttttctaatattaattccaaatattacaaaatttaatgtgatattaaagtatgaaaaatttgagaagattagaattttacatgtatttccattcctatttaaagagagaaaatggggagataatttctgtgctagttttacttatattggatatataatattgaatttatagtataagctttattttatcagttcgcaaatctgaagtctcatactgttttctgtctctttaaaacacattcttctggtggcttgggttcattgtgcattcattggccactcttcttgcagcaaattttaaatcaatttaaaattaggtaaactttttatgatactataatatatatgacgttgaaatgacattggttctgagtctattaatttaaattttgggatcattacattcagaatgaaatgaaattgaccttgatactaactttgagagccaaaaaaatgaatgggtaaacaaagcctaagggtcatgttaattaatttaacaaaacacactattttcagtcctttgggcttgtacattttatagacaaaattagcatttattgatttggaagtgttcaattgagagtaaatgactctgtgttttgaaactaatacctttgcatttaaaatactgaagtattattttgttagttgaagtagatcttttcctgtgtagcatgatttaatgcagagcagttattcacttatacttctgaaaagccataatattgaaatttaaaatgaatagtcttactttaaggtcacttttactttacattttactttaaaggtcgtttttagactttatgcactagtggtattgaaactaacctttaatatttgactaaattgcttgtgaatttttggaaactatgtttaatttttaaagacattgttatgtgaattatcttactaaattatcacttaagaactctctcatagcagtaatttcattaacacatatatatactaaccaatttgctaaatgaattgtcggttgtcctgcttaagtactagggccaagctttgaaatgacttaaagtgatctgaattttgattgagaaaaataatctgtcttctatcgaatgtttgaacttttagtgatgagcctcagcaaagtttcaccctgcatgaagcagaacaggtgggggaaaattacaagaggggtctgtaccaaaaatggccccaggatattccattgaacaaatattgaccattatcttcctaggtgctacaactccatactagtcattacagttagtctttggtttcacaaaaatgttactgcttcaaaggcttggcattaacagtgatgtcagcattcatactgccaacagtctgctggtcatacatggaagactgttaaagtgtggtctgtgcatcattgagcaattgttatgtagacacaaggcctgcttcactcaggatagcttgctcctctcgctgagaagagatacctgaagtctactaagtctactaaatgagatatatatgtgtatgtatatgcctatatatattattatatttactagtgtttgtgataatgttataaaaattaataagattgttttgttttgtatgaatgtacgacaaatcgagttgttcaatgtattgaatgaatgtcttactgtaagcatcagagctgtccaaccatgtgtaaatgtacctggtcttttgatcactgacactactttgctgttcaatctggaatcaactgacctggctctgccattgagaaataactaatttagaacaaaattgttaaattttaaaattgcatttctactagaaatagctttggagagttaattttaggtgcgaataacaggataaatgctatctgatcaagcattcatccgaaaaatgtttttgagaattcactttgtgcaaggcacagctgttggggctggtatatgtgtggacatgtttgatttgaaaaccttcgtggtgtctctgtgtgttattgatcatctgtgtcttttgcttaaaatggcattatttgtaacacaaacctaatatcatatatacaaatatactgtatgtagccaagaacactaaattggtaagacgctttagaaaatatgcatttgaatttgaatatctaatgcctcaagcaaatttattagagtttcagatgaatatatatttttgtaactggcaagtaaatgagtagaacagagctttttgcctaaaaatatttttataagtactcatttacatagtattcattattttaaatgacaaaatatcaaattggttctataaatagtaattgttttgaatatatccatacttaacatcatatgaaatccaaaatttaatgataaatttcatctggatgtgttattataaaagtcatctttttttcctttgtaaaatatccatgtaacatagcttccattactccatattttatgtatggttaaaattatcaaagtgcattatgtattttatattgtttatttttgtctgcatgaaagattggaatagtaaccgtgtatgataaatgttaataataataaagtgaaatgtagtatgacc

SEQ ID NO: 16535 - DNA, 3612 bp, Homo sapiens
  ENST00000529398
gcgccgcgctgcgcaccgccgccgaccatgagcgaggacagccgcggagacagccgcgccgagagcgccaaggacctggagaagcagcttcgcctgcgcgtgtgcgtgctcagcgagctccagaagaccgagcgggactatgtgggcacgctggagttcctggtgtcggcattcttacacagaatgaaccagtgtgcagcatcaaaagttgacaaaaatgtgacagaagaaacagtgaagatgttgttctcaaacattgaagacatccttgcagtacataaagaattcttaaaagtcgtggaagaatgcttacaccccgaacctaatgctcaacaagaagtgggaacctgctttcttcactttaaagacaagtttcgtatctatgatgaatattgtagtaaccatgagaaggcacaaaaattacttcttgaactcaacaaaataagaacaatccggacatttcttttgaactgcatgctgcttggaggacggaagaacacagatgttcccttggaaggatatttagtaacaccaatacaaagaatatgcaagtaccctcttattttgaaggagttgctgaagcggactccacggaaacacagtgactatgcagcagtgatggaagccctccaagccatgaaagctgtctgttccaacataaacgaggccaagagacagatggagaagttagaagttttagaggaatggcagtctcacattgaaggctgggaggggtccaacatcactgacacctgcactgaaatgctaatgtgtggagtcttactgaaaatttcttctggaaatattcaagaacgggtgttttttcttttcgataatcttttggtgtactgcaaaagaaaacacagacggttgaagaacagcaaggcatctacagatggacatcggtacctttttcgtggccggatcaacacggaggtgatggaagtggagaatgtggatgatggcaccgctgatttccatagcagtggacacattgttgttaatggatggaagatacataacacagcaaaaaataaatggtttgtttgtatggcaaaaacacctgaagagaagcatgaatggtttgaagctattttgaaagaaagagaacggcggaaaggtttaaaattaggaatggagcaagatacctgggtcatgatctctgaacagggtgagaaactttataaaatgatgtgcagacaaggaaatctgatcaaagaccgaaagagaaaactgactacgttccctaaatgctttcttggaagcgaatttgtgtcatggctgttggaaattggagagattcacaggcctgaggaaggcgtgcacttgggacaagcattattagaaaatggaatcattcaccatgttactgataaacatcaattcaaaccagaacagatgttatatagatttcgctatgatgatggaacattttatccaagaaatgagatgcaggacgtgatttcaaagggtgtaagattatattgtcgtcttcatagcctttttactccagtgataagagataaagattaccatttaaggacctacaaatctgtggtcatggccaacaaactgatagactggttaattgcacagggagattgccgcaccagagaagaggcaatgatatttggcgttggactctgtgacaatggatttatgcaccatgtccttgaaaaaagcgaattcaaagatgaacccctacttttccgttttttttcggatgaggaaatggagggatcaaatatgaaacatcgacttatgaaacatgacttaaaagttgtggaaaatgttatagctaagtcattattgattaaatccaatgaaggcagctatggctttggattagaagacaaaaataaagttccaataataaagttggtagaaaagggatctaatgctgagatggctggcatggaagtcgggaaaaagatttttgctattaatggtgacctagtttttatgagacctttcaatgaagtggattgcttcctgaaatcgtgtttaaacagcagaaaacctctaagagttcttgtgagcacaaagccaagagagacagtgaaaattccagattcagctgatggacttggcttccagatccggggatttggcccttctgttgtgcatgctgtaggaagaggaactgtggctgcagcagctggtcttcaccctggacagtgcattatcaaggtgaatggaatcaatgtcagcaaagagacacatgccagtgtcattgcacacgttacagcctgcaggaagtacaggcggccaacgaagcaagattccatacaatgggtttataatagcattgagagtgctcaagaagaccttcaaaaatctcactccaagccccctggagatgaagcaggggatgcttttgactgtaaagtagaagaggttattgacaaattcaacactatggccatcattgatgggaagaaggagcatgtgagtctgacagtggacaatgtccacctggaatatggtgtcgtgtatgagtacgacagcacagctggcatcaagtgcaatgtggtggaaaagatgattgagcccaaaggtttcttcagcttaactgccaagattcttgaagccctggctaaaagtgatgagcattttgtacaaaactgtaccagcctaaattctctaaatgaagtgattcctactgaccttcagagtaaattcagtgccctttgcagtgaaagaattgaacacctatgtcagagaatatccagttataaaaaggttcaagcttcagaaaggttttacaatttcacagcacggcatgctgtctgggagcacagttttgatcttcacagtgtaagcagcacatttccagtacctgtgactatggagttcctcctgctgcctcctcctctcttaggaatatcccaggatggaagacagcactgcattcctgaggaccttccttctcaagaaatgctcttagcagagagggcccctgtctgattcttaccctttggaacagttcaggcacccttagacacagtacacagcccttcctagcatgtgggcagggggacatcctgtattcacaggcatttgtattgagctacaagttggaaagccagtccccctagcaagagaatcttctgccagctctccccgattactccattaacacttcttgacatcaccctattcatttccttttcagcttgtaccaaaatttctaactatctggcttttacgtgcattatataattgtatatatacagtcatgcactgcataacatttcagtaaatgacagaccatatatatatggattatatatatatatatatatggatatatatacacatatatatacacacacatatatatatatatacatatatatgtatatatatataaaatggtggtcccataagattatactactacattttggctctactttttctatgttcagatagatgcacctattggtgtatttttcagaatacatccccgttgttaagcaatgcattactgtattatatatatggcacatgtattatatatatggcacattgccgttacttttaatggcaaaaaccgcaatcacttttgctccaacctagtaattgcaataaacaattgttgtatatagc

SEQ ID NO: 16536 - DNA, 3015 bp, Homo sapiens
  ENST00000517617
agaagaccgagcgggactatgtgggcacgctggagttcctggtgtcgaaagacaagtttcgtatctatgatgaatattgtagtaaccatgagaaggcacaaaaattacttcttgaactcaacaaaataagaacaatccggacatttcttttgaactgcatgctgcttggaggacggaagaacacagatgttcccttggaaggatatttagtaacaccaatacaaagaatatgcaagtaccctcttattttgaaggagttgctgaagcggactccacggaaacacagtgactatgcagcagtgatggaagccctccaagccatgaaagctgtctgttccaacataaacgaggccaagagacagatggagaagttagaagttttagaggaatggcagtctcacattgaaggctgggaggggtccaacatcactgacacctgcactgaaatgctaatgtgtggagtcttactgaaaatttcttctggaaatattcaagaacgggtgttttttcttttcgataatcttttggtgtactgcaaaagaaaacacagacggttgaagaacagcaaggcatctacagatggacatcggtacctttttcgtggccggatcaacacggaggtgatggaagtggagaatgtggatgatggcaccgctgatttccatagcagtggacacattgttgttaatggatggaagatacataacacagcaaaaaataaatggtttgtttgtatggcaaaaacacctgaagagaagcatgaatggtttgaagctattttgaaagaaagagaacggcggaaaggtttaaaattaggaatggagcaagatacctgggtcatgatctctgaacagggtgagaaactttataaaatgatgtgcagacaaggaaatctgatcaaagaccgaaagagaaaactgactacgttccctaaatgctttcttggaagcgaatttgtgtcatggctgttggaaattggagagattcacaggcctgaggaaggcgtgcacttgggacaagcattattagaaaatggaatcattcaccatgttactgataaacatcaattcaaaccagaacagatgttatatagatttcgctatgatgatggaacattttatccaagaaatgagatgcaggacgtgatttcaaagggtgtaagattatattgtcgtcttcatagcctttttactccagtgataagagataaagattaccatttaaggacctacaaatctgtggtcatggccaacaaactgatagactggttaattgcacagggagattgccgcaccagagaagaggcaatgatatttggcgttggactctgtgacaatggatttatgcaccatgtccttgaaaaaagcgaattcaaagatgaacccctacttttccgttttttttcggatgaggaaatggagggatcaaatatgaaacatcgacttatgaaacatgacttaaaagttgtggaaaatgttatagctaagtcattattgattaaatccaatgaaggcagctatggctttggattagaagacaaaaataaagttccaataataaagttggtagaaaagggatctaatgctgagatggctggcatggaagtcgggaaaaagatttttgctattaatggtgacctagtttttatgagacctttcaatgaagtggattgcttcctgaaatcgtgtttaaacagcagaaaacctctaagagttcttgtgagcacaaagccaagagagacagtgaaaattccagattcagctgatggacttggcttccagatccggggatttggcccttctgttgtgcatgctgtaggaagaggaactgtggctgcagcagctggtcttcaccctggacagtgcattatcaaggtgaatggaatcaatgtcagcaaagagacacatgccagtgtcattgcacacgttacagcctgcaggaagtacaggcggccaacgaagcaagattccatacaatgggtttataatagcattgagagtgctcaagaagaccttcaaaaatctcactccaagccccctggagatgaagcaggggatgcttttgactgtaaagtagaagaggttattgacaaattcaacactatggccatcattgatgggaagaaggagcatgtgagtctgacagtggacaatgtccacctggaatatggtgtcgtgtatgagtacgacagcacagctggcatcaagtgcaatgtggtggaaaagatgattgagcccaaaggtttcttcagcttaactgccaagattcttgaagccctggctaaaagtgatgagcattttgtacaaaactgtaccagcctaaattctctaaatgaagtgattcctactgaccttcagagtaaattcagtgccctttgcagtgaaagaattgaacacctatgtcagagaatatccagttataaaaagttttctcgtgtactgaagaatagggcctggcctacttttaaacaggccaaatctaaaatctccccactgcacagcagtgatttctgccctaccaactgccatgtcaatgtgatggaagtttcttatcccaaaacatcaacctctttgggaagtgcatttggtgttcagttggatagcaggaagcataattctcatgataaagaaaacaaatcttcggagcaagggaaactgagccctatggtgtacattcagcacaccatcacaaccatggcggccccttcaggtctgtctctgggacagcaggatggccatggtctcaggtatctgctaaaagaagaagacttagaaacccaagacatctatcagaaactgctgggcaaacttcagactgcactgaaagaggtggagatgtgtgtttgtcaaatagatgaatgaattaaaccgttcaagattgctaagagaaaaggagagtatttttttaagcaattgcatgacatctttgaattgtgttggaatccttgtgacagcagtttatattttaggatatgatattttacttcatttaataaatgagattttattgcatgat

SEQ ID NO: 16537 - DNA, 425 bp, Homo sapiens
  ENST00000522247
tttcaagctcagataaatgcagcctcactggaaaaggtcaaacagtacaaccagaagctcagggcattctacttggacaagtcaaattcaccaccaaactccacatccaaagctgcctatgtagataagctaatgaggcctctcaacgctttggatgaactttaccgactggtagcctcgtttatcagatccaagcgcacagctgcctgtgcaaacacagcttgcagtgcttctggggttggactgctgtcagtttcctcggagctgtgcaacaggctgggcgcctgccacatcatcatgtgcagcagcggtgtgcatcggtatgtgaccctcccgccttgcttgcctctttgttagatcacactttatttgatggtttttgtttacattttggcttcacaaaattaaaactggaaacattcaaa

SEQ ID NO: 16538 - DNA, 566 bp, Homo sapiens
  ENST00000520235
aaaggtcaaacagtacaaccagaagctcagggcattctacttggacaagtcaaattcaccaccaaactccacatccaaagctgcctatgtagataagctaatgaggcctctcaacgctttggatgaactttaccgactggtagcctcgtttatcagatccaagcgcacagctgcctgtgcaaacacagcttgcagtgcttctggggttggactgctgtcagtttcctcggagctgtgcaacaggctgggcgcctgccacatcatcatgtgcagcagcggtgtgcatcggtgcaccctgagcgtgacgctggagcaagccatcattctggccagaagccacggactgccacctcgttacatcatgcaggctacagatgtgatgcggaagcagattttgtgtatatacttttcatacagttgttattttaattcactgcttgagtttgaaggaaagataaaagacagaagagaagggtactatgttttcatgatgttttgctaatgattgtaacaaccttgggcagcactttatgtaaccagctgatttgattaataaaaggcttgca

SEQ ID NO: 16539 - DNA, 5902 bp, Homo sapiens
  ENST00000345127
agcgcgcggctccggagcccgagcgcactccgcctgcagcccagctgccagcgccgtctcccgcggccgccgccgcccgacagcgcgcccggaacatgccagcctcgcgcagcctgcgctgacttccccgagacgcgccgcggtcggcacggagactttctgggctctggatggttcgtgcgctgctcaccctcgcccacccctgacgccgcggaccgcagctcctcagccccgcagccccgcagcccagcagccccgcagcggcgccgaggacagtgcagccgagttgcgtctccctcgcgcgagcagccattgtttgatgtcctgtgactgagaaaccaggctttaaactttatgcctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggaaaaagttccttacgttaacagccccggagagaagcatcggattaaacagcttttgtaccagttaccaccacatgataatgaggtacggtattgccagtctttgagtgaagaggagaaaaaagagttgcaggtgttcagtgctcagcggaagaaagaagcactgggaagaggaacaattaagcttctgtccagagcagtcatgcatgctgtgtgtgagcagtgtggtttgaagataaatggaggtgaagttgcagtgttcgcctcccgtgcgggccctggtgtgtgctggcacccatcctgttttgtctgtttcacgtgtaatgagctgctggtcgacctcatctatttttatcaggatggaaaaattcactgtggcaggcaccatgcagaactgctcaaaccacggtgctcagcatgtgacgagataatttttgctgatgagtgcacagaagctgagggtcgccattggcacatgaaacacttctgctgccttgagtgtgaaacggtcctgggaggacagaggtatatcatgaaggacggccgccccttctgctgtggctgttttgagtctctctatgcggagtactgtgaaacctgtggggaacatattggtgtggaccatgcacagatgacctatgacgggcagcactggcacgccacggaagcctgcttttcttgtgcccagtgtaaagcctctttgttgggatgtcccttccttcccaaacagggtcagatttactgctcaaaaacgtgcagtcttggtgaagacgtccatgcctctgattcttccgactctgcatttcagtcagctcgatcaagagactcccgaagaagtgtccgaatgggcaagagcagccggtcagcagatcagtgtagacagtctctcctcttatcgcctgctctgaactacaagtttcctggcctctcaggcaatgctgatgacaccctttctcgaaaattggatgatctgagtctctccagacaaggaacaagttttgccagtgaagaattttggaaaggcagagtagagcaggaaactccagaagaccctgaagaatgggctgatcatgaagattatatgacgcagctcctcctcaagtttggtgataaaagcctctttcagccacagcccaatgagatggatattcgagccagtgagcactggatatctgataacatggttaaaagtaagaccgagttaaagcaaaataaccagagccttgcaagtaaaaaataccagtctgatatgtactgggcacagtcacaagatggactgggcgattctgcttatggcagccacccaggccctgcaagcagtagaaggcttcaggaattggaactggaccatggggcttcagggtataatcatgatgaaacacagtggtatgaagattccctggagtgtctgtcagacctgaaaccagagcaaagtgttcgggattcgatggattctttggcattgtccaatatcacaggggcttcggtggatggagaaaacaagccaaggccatcattgtattctctgcaaaattttgaggagatggaaacagaagattgtgagaagatgagcaatatgggaactttgaactcttccatgctgcacaggagtgcagagtccttaaagagtctaagttcagagttgtgtccagagaaaatcctgcctgaagagaagccagtacatctgccagtgctcagaaggtccaagtctcaatccagaccccagcaggtcaagttttctgatgatgtcattgacaatgggaactatgacattgaaatccggcagcctccgatgagtgaaaggactcggagacgcgtctacaattttgaagagaggggatccaggtctcatcaccaccgccgccggagaagtagaaagtcccgctccgacaatgccctgaatcttgttacagaaagaaaatactctcccaaggacagactgcggctgtacacccccgataactatgagaaatttatacagaataaaagtgcccgggagatccaagcatacatccagaatgctgatctctacggacagtacgcccatgccacttccgattatggcctgcagaacccaggaatgaatcggtttctgggactctacggcgaggatgatgattcctggtgttcttcctcctcctcctcttccgactcggaagaagaaggatattttcttggacaaccaatccctcaaccccggccacagagatttgcctactatacagatgacctttctagtccaccatctgcacttcccacccctcagtttggtcagaggacaacaaaatccaagaagaaaaagggacacaagggcaaaaattgtattatttcttaaccaagtagtgatgcagagcatttgtttaaaacttagccattaaccgtctgaatcgtttccttttcttccgtaggaaagttgtgaaaatagtttaaagtgctttctttgcccatgtaaatgagaactcaactgctgtttacagtgtcagattaacatttgaaaggtgtgatttctccaatttaccctctttggatggtgccaggtggacgtgacatctcgtgcctgtccggtgcgggtgcgttacagatggacgtagctgctttggttttccagtcctcaagggaatactgaagatgctgactgaaggggattggatgttgattttagaagatggagaactccagccacctttgtaaagcactagtgtttgtcatttatgtaagtcaggtcggctcaggtcttgatagtccgtcttggtgtgaggcatgcctgtcacgatgacctagctaacactgtgcatcttattgtgaggccagcttgtcccctcgaaccctctttggccaggtaaacattgtattgtatcagcgccagctacagattgaaaaaaaaaaacaaaaaacattgctatttataacttagtatttcatagacttaagtgtattcctaatttaacggtgcaaatattaatgtatatactgtacagttcagattttaaagctgatatttttatatccctgaattgtaagccgtttgttacgctgcagtgctagatttgccagggaaccagaatttatggatgaactgattgcttatattttagtcagggtttataaatgtagatggtcaaatttacattgcctagtgatggaaaattcaactttttttgatttttttttccaatattaaaaaaggctctgtatgcatggtggggctatgtaagtactctttaaaactatggccctattaatcttacaagtgttacttatgggtcaagcaatgtaaactgtataaatgtaaaaacaacccctccacacacataacccctggaatatatggtaaaaacaagtagaagctgtttcagcgagtgggttttttccccctgcctgcggggggtgcctttctcattttcagcaaggtgatgattatctcatgggaaatgacaaagatctgcttttgtggcagaggactttgtagatttgttattttaagagaggttattcctttttattccttccctcccactaatttgttggcctttaacagcaattttgaaaactgggtcttctggttatgtttttgttttaaaatctttaaattagaggatgctgtgccattgagtactgtaagttaatatgaggttctggttcaaggaaaacttacgttggatctgaaccaatgagcagatattttgatatgtgccactcttgcatatacatctcagtcctaactaaaggttctagtggcatccaggacctttagggaggcatttaataaacacttaataaataacaaaactacctttctgaatataaatctttgcaaatgtatccagataacttccattttgtgcctgtgttcaggcatgatttattttgcagttgccctaccattaacagacctccatttgtctcgtgtgtccacacgccccacttgtaggccagaaatagggcttcagacacagaggcttattttttccatatagactggagtggggaaaatttggccttagggaggacagacacaagtccaatgggtaaaccagcgagtagtaggtggacagccgtcccacacaagggtttgtatctgggctacacagattcccttcagaaaagcaccaatggtgagagagttcttcactcagtaacttacattccctggtctggtgcctttaaaaaaccatcagcaatgaaaaggaagtgcatacacatgacaaaaaaattcaaatagggcaaaagtcagagacagcatctcctttccattcttcatcccagtcccccaggtcctctccccagaagtaaccactcttacccagttttagtgtctccttcagacattcaaagcacattcgtataaatgtgtcttttaaaagtggtagtgacctatatgtgctgtgacatgcttttttccctttgtatgtggacatttcacgttagtgcatataggtctacccattctttcagtgactgcttaatagcctactcctaatgatggagttgactttcctcatacattatgctacactggcacatgtgcacataaatcgggagcagcgtagttactgggacaaaggttacgtatttaagactgatggatattgccaattttcctccaaaagaaattctcctgatttacattaatgtaatgtaaatgagagtgtttgttccatcacaacctctcaatgtattagcagatttcttgattttgaagaaattttcagaacctgtgctgccacaagtgggcatccttttagaaaagactgttgcaatatgttgcttataaaggatggataataaatagtaaacaggtgatacttagcctgaagaaatgcaggtataaggtgaaggtactgccctcacttttcaagtacattctcaaaagataggggtaacatagcctgccaaaggcttaaggaaatgcagatatttattcacaataataatgtgactttcttttccttttttttttttttttgagatggagtttcgctcctgttgcccaggctggagcgcaacggcacaatctcagttcactgcaacctctgcctcccgggttcaagcaattctcctgtctcagcctccggagtagctgagattacaggtgcctgccaccatgctcggctaattttttatatttttagtagagacagtgtttcaccaagttggccaggctggtctcgaactcctgaccttcaggtgatccacctgcctcagcctcccaaagtgcaggggattacaggcatgagccactgcgtctggcaataatgtaactttgaagcttaaaaattaatcccagtttgtagcaataacagaagactatctacaacggaagaaagaagcaactgccttacagttctgtaaagaattggcaagaaaataaagcctatagttgccga

SEQ ID NO: 16540 - DNA, 5761 bp, Homo sapiens
  ENST00000639589
atgggcagagtggagatgatttctttaagaggtggcctttcatattctcccagcgtttcgtggcccgcgcgtgcacctgcgggagggggaagtttacataagcgtcctagggtatttgcatcttagcggcttcactcactgggctcgggagaatggagcgggcgggcggcgcagccattgtttgatgtcctgtgactgagaaaccaggctttaaactttatgcctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggaaaaagttccttacgttaacagccccggagagaagcatcggattaaacagcttttgtaccagttaccaccacatgataatgaggtacggtattgccagtctttgagtgaagaggagaaaaaagagttgcaggtgttcagtgctcagcggaagaaagaagcactgggaagaggaacaattaagcttctgtccagagcagtcatgcatgctgtgtgtgagcagtgtggtttgaagataaatggaggtgaagttgcagtgttcgcctcccgtgcgggccctggtgtgtgctggcacccatcctgttttgtctgtttcacgtgtaatgagctgctggtcgacctcatctatttttatcaggatggaaaaattcactgtggcaggcaccatgcagaactgctcaaaccacggtgctcagcatgtgacgagataatttttgctgatgagtgcacagaagctgagggtcgccattggcacatgaaacacttctgctgccttgagtgtgaaacggtcctgggaggacagaggtatatcatgaaggacggccgccccttctgctgtggctgttttgagtctctctatgcggagtactgtgaaacctgtggggaacatattggtgtggaccatgcacagatgacctatgacgggcagcactggcacgccacggaagcctgcttttcttgtgcccagtgtaaagcctctttgttgggatgtcccttccttcccaaacagggtcagatttactgctcaaaaacgtgcagtcttggtgaagacgtccatgcctctgattcttccgactctgcatttcagtcagctcgatcaagagactcccgaagaagtgtccgaatgggcaagagcagccggtcagcagatcagtgtagacagtctctcctcttatcgcctgctctgaactacaagtttcctggcctctcaggcaatgctgatgacaccctttctcgaaaattggatgatctgagtctctccagacaaggaacaagttttgccagtgaagaattttggaaaggcagagtagagcaggaaactccagaagaccctgaagaatgggctgatcatgaagattatatgacgcagctcctcctcaagtttggtgataaaagcctctttcagccacagcccaatgagatggatattcgagccagtgagcactggatatctgataacatggttaaaagtaagaccgagttaaagcaaaataaccagagccttgcaagtaaaaaataccagtctgatatgtactgggcacagtcacaagatggactgggcgattctgcttatggcagccacccaggccctgcaagcagtagaaggcttcaggaattggaactggaccatggggcttcagggtataatcatgatgaaacacagtggtatgaagattccctggagtgtctgtcagacctgaaaccagagcaaagtgttcgggattcgatggattctttggcattgtccaatatcacaggggcttcggtggatggagaaaacaagccaaggccatcattgtattctctgcaaaattttgaggagatggaaacagaagattgtgagaagatgagcaatatgggaactttgaactcttccatgctgcacaggagtgcagagtccttaaagagtctaagttcagagttgtgtccagagaaaatcctgcctgaagagaagccagtacatctgccagtgctcagaaggtccaagtctcaatccagaccccagcaggtcaagttttctgatgatgtcattgacaatgggaactatgacattgaaatccggcagcctccgatgagtgaaaggactcggagacgcgtctacaattttgaagagaggggatccaggtctcatcaccaccgccgccggagaagtagaaagtcccgctccgacaatgccctgaatcttgttacagaaagaaaatactctcccaaggacagactgcggctgtacacccccgataactatgagaaatttatacagaataaaagtgcccgggagatccaagcatacatccagaatgctgatctctacggacagtacgcccatgccacttccgattatggcctgcagaacccaggaatgaatcggtttctgggactctacggcgaggatgatgattcctggtgttcttcctcctcctcctcttccgactcggaagaagaaggatattttcttggacaaccaatccctcaaccccggccacagagatttgcctactatacagatgacctttctagtccaccatctgcacttcccacccctcagtttggtcagaggacaacaaaatccaagaagaaaaagggacacaagggcaaaaattgtattatttcttaaccaagtagtgatgcagagcatttgtttaaaacttagccattaaccgtctgaatcgtttccttttcttccgtaggaaagttgtgaaaatagtttaaagtgctttctttgcccatgtaaatgagaactcaactgctgtttacagtgtcagattaacatttgaaaggtgtgatttctccaatttaccctctttggatggtgccaggtggacgtgacatctcgtgcctgtccggtgcgggtgcgttacagatggacgtagctgctttggttttccagtcctcaagggaatactgaagatgctgactgaaggggattggatgttgattttagaagatggagaactccagccacctttgtaaagcactagtgtttgtcatttatgtaagtcaggtcggctcaggtcttgatagtccgtcttggtgtgaggcatgcctgtcacgatgacctagctaacactgtgcatcttattgtgaggccagcttgtcccctcgaaccctctttggccaggtaaacattgtattgtatcagcgccagctacagattgaaaaaaaaaaacaaaaaacattgctatttataacttagtatttcatagacttaagtgtattcctaatttaacggtgcaaatattaatgtatatactgtacagttcagattttaaagctgatatttttatatccctgaattgtaagccgtttgttacgctgcagtgctagatttgccagggaaccagaatttatggatgaactgattgcttatattttagtcagggtttataaatgtagatggtcaaatttacattgcctagtgatggaaaattcaactttttttgatttttttttccaatattaaaaaaggctctgtatgcatggtggggctatgtaagtactctttaaaactatggccctattaatcttacaagtgttacttatgggtcaagcaatgtaaactgtataaatgtaaaaacaacccctccacacacataacccctggaatatatggtaaaaacaagtagaagctgtttcagcgagtgggttttttccccctgcctgcggggggtgcctttctcattttcagcaaggtgatgattatctcatgggaaatgacaaagatctgcttttgtggcagaggactttgtagatttgttattttaagagaggttattcctttttattccttccctcccactaatttgttggcctttaacagcaattttgaaaactgggtcttctggttatgtttttgttttaaaatctttaaattagaggatgctgtgccattgagtactgtaagttaatatgaggttctggttcaaggaaaacttacgttggatctgaaccaatgagcagatattttgatatgtgccactcttgcatatacatctcagtcctaactaaaggttctagtggcatccaggacctttagggaggcatttaataaacacttaataaataacaaaactacctttctgaatataaatctttgcaaatgtatccagataacttccattttgtgcctgtgttcaggcatgatttattttgcagttgccctaccattaacagacctccatttgtctcgtgtgtccacacgccccacttgtaggccagaaatagggcttcagacacagaggcttattttttccatatagactggagtggggaaaatttggccttagggaggacagacacaagtccaatgggtaaaccagcgagtagtaggtggacagccgtcccacacaagggtttgtatctgggctacacagattcccttcagaaaagcaccaatggtgagagagttcttcactcagtaacttacattccctggtctggtgcctttaaaaaaccatcagcaatgaaaaggaagtgcatacacatgacaaaaaaattcaaatagggcaaaagtcagagacagcatctcctttccattcttcatcccagtcccccaggtcctctccccagaagtaaccactcttacccagttttagtgtctccttcagacattcaaagcacattcgtataaatgtgtcttttaaaagtggtagtgacctatatgtgctgtgacatgcttttttccctttgtatgtggacatttcacgttagtgcatataggtctacccattctttcagtgactgcttaatagcctactcctaatgatggagttgactttcctcatacattatgctacactggcacatgtgcacataaatcgggagcagcgtagttactgggacaaaggttacgtatttaagactgatggatattgccaattttcctccaaaagaaattctcctgatttacattaatgtaatgtaaatgagagtgtttgttccatcacaacctctcaatgtattagcagatttcttgattttgaagaaattttcagaacctgtgctgccacaagtgggcatccttttagaaaagactgttgcaatatgttgcttataaaggatggataataaatagtaaacaggtgatacttagcctgaagaaatgcaggtataaggtgaaggtactgccctcacttttcaagtacattctcaaaagataggggtaacatagcctgccaaaggcttaaggaaatgcagatatttattcacaataataatgtgactttcttttccttttttttttttttttgagatggagtttcgctcctgttgcccaggctggagcgcaacggcacaatctcagttcactgcaacctctgcctcccgggttcaagcaattctcctgtctcagcctccggagtagctgagattacaggtgcctgccaccatgctcggctaattttttatatttttagtagagacagtgtttcaccaagttggccaggctggtctcgaactcctgaccttcaggtgatccacctgcctcagcctcccaaagtgcaggggattacaggcatgagccactgcgtctggcaataatgtaactttgaagcttaaaaattaatcccagtttgtagcaataacagaagactatctacaacggaagaaagaagcaactgccttacagttctgtaaagaattggcaagaaaataaagcctatagt

SEQ ID NO: 16541 - DNA, 4075 bp, Homo sapiens
  ENST00000445766
agaccagcctgtgggattacacgagacaggatcgagtccaaacgggtccccagctcggcaaggcgcgccggaaggaatctaacagccattgtttgatgtcctgtgactgagaaaccaggctttaaactttatgcctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggaaaaagttccttacgttaacagccccggagagaagcatcggattaaacagcttttgtaccagttaccaccacatgataatgaggtacggtattgccagtctttgagtgaagaggagaaaaaagagttgcaggtgttcagtgctcagcggaagaaagaagcactgggaagaggaacaattaagcttctgtccagagcagtcatgcatgctgtgtgtgagcagtgtggtttgaagataaatggaggtgaagttgcagtgttcgcctcccgtgcgggccctggtgtgtgctggcacccatcctgttttgtctgtttcacgtgtaatgagctgctggtcgacctcatctatttttatcaggatggaaaaattcactgtggcaggcaccatgcagaactgctcaaaccacggtgctcagcatgtgacgagataatttttgctgatgagtgcacagaagctgagggtcgccattggcacatgaaacacttctgctgccttgagtgtgaaacggtcctgggaggacagaggtatatcatgaaggacggccgccccttctgctgtggctgttttgagtctctctatgcggagtactgtgaaacctgtggggaacatattggtgtggaccatgcacagatgacctatgacgggcagcactggcacgccacggaagcctgcttttcttgtgcccagtgtaaagcctctttgttgggatgtcccttccttcccaaacagggtcagatttactgctcaaaaacgtgcagtcttggtgaagacgtccatgcctctgattcttccgactctgcatttcagtcagctcgatcaagagactcccgaagaagtgtccgaatgggcaagagcagccggtcagcagatcagtgtagacagtctctcctcttatcgcctgctctgaactacaagtttcctggcctctcaggcaatgctgatgacaccctttctcgaaaattggatgatctgagtctctccagacaaggaacaagttttgccagtgaagaattttggaaaggcagagtagagcaggaaactccagaagaccctgaagaatgggctgatcatgaagattatatgacgcagctcctcctcaagtttggtgataaaagcctctttcagccacagcccaatgagatggatattcgagccagtgagcactggatatctgataacatggttaaaagtaagaccgagttaaagcaaaataaccagagccttgcaagtaaaaaataccagtctgatatgtactgggcacagtcacaagatggactgggcgattctgcttatggcagccacccaggccctgcaagcagtagaaggcttcaggaattggaactggaccatggggcttcagggtataatcatgatgaaacacagtggtatgaagattccctggagtgtctgtcagacctgaaaccagagcaaagtgttcgggattcgatggattctttggcattgtccaatatcacaggggcttcggtggatggagaaaacaagccaaggccatcattgtattctctgcaaaattttgaggagatggaaacagaagattgtgagaagatgagcaatatgggaactttgaactcttccatgctgcacaggagtgcagagtccttaaagagtctaagttcagagttgtgtccagagaaaatcctgcctgaagagaagccagtacatctgccagtgctcagaaggtccaagtctcaatccagaccccagcaggtcaagttttctgatgatgtcattgacaatgggaactatgacattgaaatccggcagcctccgatgagtgaaaggactcggagacgcgtctacaattttgaagagaggggatccaggtctcatcaccaccgccgccggagaagtagaaagtcccgctccgacaatgccctgaatcttgttacagaaagaaaatactctcccaaggacagactgcggctgtacacccccgataactatgagaaatttatacagaataaaagtgcccgggagatccaagcatacatccagaatgctgatctctacggacagtacgcccatgccacttccgattatggcctgcagaacccaggaatgaatcggtttctgggactctacggcgaggatgatgattcctggtgttcttcctcctcctcctcttccgactcggaagaagaaggatattttcttggacaaccaatccctcaaccccggccacagagatttgcctactatacagatgacctttctagtccaccatctgcacttcccacccctcagtttggtcagaggacaacaaaatccaagaagaaaaagggacacaagggcaaaaattgtattatttcttaaccaagtagtgatgcagagcatttgtttaaaacttagccattaaccgtctgaatcgtttccttttcttccgtaggaaagttgtgaaaatagtttaaagtgctttctttgcccatgtaaatgagaactcaactgctgtttacagtgtcagattaacatttgaaaggtgtgatttctccaatttaccctctttggatggtgccaggtggacgtgacatctcgtgcctgtccggtgcgggtgcgttacagatggacgtagctgctttggttttccagtcctcaagggaatactgaagatgctgactgaaggggattggatgttgattttagaagatggagaactccagccacctttgtaaagcactagtgtttgtcatttatgtaagtcaggtcggctcaggtcttgatagtccgtcttggtgtgaggcatgcctgtcacgatgacctagctaacactgtgcatcttattgtgaggccagcttgtcccctcgaaccctctttggccaggtaaacattgtattgtatcagcgccagctacagattgaaaaaaaaaaacaaaaaacattgctatttataacttagtatttcatagacttaagtgtattcctaatttaacggtgcaaatattaatgtatatactgtacagttcagattttaaagctgatatttttatatccctgaattgtaagccgtttgttacgctgcagtgctagatttgccagggaaccagaatttatggatgaactgattgcttatattttagtcagggtttataaatgtagatggtcaaatttacattgcctagtgatggaaaattcaactttttttgatttttttttccaatattaaaaaaggctctgtatgcatggtggggctatgtaagtactctttaaaactatggccctattaatcttacaagtgttacttatgggtcaagcaatgtaaactgtataaatgtaaaaacaacccctccacacacataacccctggaatatatggtaaaaacaagtagaagctgtttcagcgagtgggttttttccccctgcctgcggggggtgcctttctcattttcagcaaggtgatgattatctcatgggaaatgacaaagatctgcttttgtggcagaggactttgtagatttgttattttaagagaggttattcctttttattccttccctcccactaatttgttggcctttaacagcaattttgaaaactgggtcttctggttatgtttttgttttaaaatctttaaattagaggatgctgtgccattgagtactgtaagttaatatgaggttctggttcaaggaaaacttacgttggatctgaaccaatgagcagatattttgatatgtgccactcttgcatatacatctcagtcctaactaaaggttctagtggcatccaggacctttagggaggcatttaataaacacttaataaataa

SEQ ID NO: 16542 - DNA, 4278 bp, Homo sapiens
  ENST00000640132
cctcgcccgccaggcggggccagcaccgggacgcgacccgggggcgcggtccgctgcaatgtagtggggacccggtgcttgctgccccaccctgctggggtctcctccggaaatgagtgggtgcgggtgactcgtagggcacccagccctctgttccttcgggagtcctccgctcccgctccgggccgccagcctccttcagacgcagagcgggcgggcggctagtgcgcgccgagggctcaggggccggcgccgcgaggggctgcaggccgcgctcggccgctgtccgggccgcagcagccattgtttgatgtcctgtgactgagaaaccaggctttaaactttatgcctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggaaaaagttccttacgttaacagccccggagagaagcatcggattaaacagcttttgtaccagttaccaccacatgataatgaggtacggtattgccagtctttgagtgaagaggagaaaaaagagttgcaggtgttcagtgctcagcggaagaaagaagcactgggaagaggaacaattaagcttctgtccagagcagtcatgcatgctgtgtgtgagcagtgtggtttgaagataaatggaggtgaagttgcagtgttcgcctcccgtgcgggccctggtgtgtgctggcacccatcctgttttgtctgtttcacgtgtaatgagctgctggtcgacctcatctatttttatcaggatggaaaaattcactgtggcaggcaccatgcagaactgctcaaaccacggtgctcagcatgtgacgagataatttttgctgatgagtgcacagaagctgagggtcgccattggcacatgaaacacttctgctgccttgagtgtgaaacggtcctgggaggacagaggtatatcatgaaggacggccgccccttctgctgtggctgttttgagtctctctatgcggagtactgtgaaacctgtggggaacatattggtgtggaccatgcacagatgacctatgacgggcagcactggcacgccacggaagcctgcttttcttgtgcccagtgtaaagcctctttgttgggatgtcccttccttcccaaacagggtcagatttactgctcaaaaacgtgcagtcttggtgaagacgtccatgcctctgattcttccgactctgcatttcagtcagctcgatcaagagactcccgaagaagtgtccgaatgggcaagagcagccggtcagcagatcagtgtagacagtctctcctcttatcgcctgctctgaactacaagtttcctggcctctcaggcaatgctgatgacaccctttctcgaaaattggatgatctgagtctctccagacaaggaacaagttttgccagtgaagaattttggaaaggcagagtagagcaggaaactccagaagaccctgaagaatgggctgatcatgaagattatatgacgcagctcctcctcaagtttggtgataaaagcctctttcagccacagcccaatgagatggatattcgagccagtgagcactggatatctgataacatggttaaaagtaagaccgagttaaagcaaaataaccagagccttgcaagtaaaaaataccagtctgatatgtactgggcacagtcacaagatggactgggcgattctgcttatggcagccacccaggccctgcaagcagtagaaggcttcaggaattggaactggaccatggggcttcagggtataatcatgatgaaacacagtggtatgaagattccctggagtgtctgtcagacctgaaaccagagcaaagtgttcgggattcgatggattctttggcattgtccaatatcacaggggcttcggtggatggagaaaacaagccaaggccatcattgtattctctgcaaaattttgaggagatggaaacagaagattgtgagaagatgagcaatatgggaactttgaactcttccatgctgcacaggagtgcagagtccttaaagagtctaagttcagagttgtgtccagagaaaatcctgcctgaagagaagccagtacatctgccagtgctcagaaggtccaagtctcaatccagaccccagcaggtcaagttttctgatgatgtcattgacaatgggaactatgacattgaaatccggcagcctccgatgagtgaaaggactcggagacgcgtctacaattttgaagagaggggatccaggtctcatcaccaccgccgccggagaagtagaaagtcccgctccgacaatgccctgaatcttgttacagaaagaaaatactctcccaaggacagactgcggctgtacacccccgataactatgagaaatttatacagaataaaagtgcccgggagatccaagcatacatccagaatgctgatctctacggacagtacgcccatgccacttccgattatggcctgcagaacccaggaatgaatcggtttctgggactctacggcgaggatgatgattcctggtgttcttcctcctcctcctcttccgactcggaagaagaaggatattttcttggacaaccaatccctcaaccccggccacagagatttgcctactatacagatgacctttctagtccaccatctgcacttcccacccctcagtttggtcagaggacaacaaaatccaagaagaaaaagggacacaagggcaaaaattgtattatttcttaaccaagtagtgatgcagagcatttgtttaaaacttagccattaaccgtctgaatcgtttccttttcttccgtaggaaagttgtgaaaatagtttaaagtgctttctttgcccatgtaaatgagaactcaactgctgtttacagtgtcagattaacatttgaaaggtgtgatttctccaatttaccctctttggatggtgccaggtggacgtgacatctcgtgcctgtccggtgcgggtgcgttacagatggacgtagctgctttggttttccagtcctcaagggaatactgaagatgctgactgaaggggattggatgttgattttagaagatggagaactccagccacctttgtaaagcactagtgtttgtcatttatgtaagtcaggtcggctcaggtcttgatagtccgtcttggtgtgaggcatgcctgtcacgatgacctagctaacactgtgcatcttattgtgaggccagcttgtcccctcgaaccctctttggccaggtaaacattgtattgtatcagcgccagctacagattgaaaaaaaaaaacaaaaaacattgctatttataacttagtatttcatagacttaagtgtattcctaatttaacggtgcaaatattaatgtatatactgtacagttcagattttaaagctgatatttttatatccctgaattgtaagccgtttgttacgctgcagtgctagatttgccagggaaccagaatttatggatgaactgattgcttatattttagtcagggtttataaatgtagatggtcaaatttacattgcctagtgatggaaaattcaactttttttgatttttttttccaatattaaaaaaggctctgtatgcatggtggggctatgtaagtactctttaaaactatggccctattaatcttacaagtgttacttatgggtcaagcaatgtaaactgtataaatgtaaaaacaacccctccacacacataacccctggaatatatggtaaaaacaagtagaagctgtttcagcgagtgggttttttccccctgcctgcggggggtgcctttctcattttcagcaaggtgatgattatctcatgggaaatgacaaagatctgcttttgtggcagaggactttgtagatttgttattttaagagaggttattcctttttattccttccctcccactaatttgttggcctttaacagcaattttgaaaactgggtcttctggttatgtttttgttttaaaatctttaaattagaggatgctgtgccattgagtactgtaagttaatatgaggttctggttcaaggaaaacttacgttggatctgaaccaatgagcagatattttgatatgtgccactcttgcatatacatctcagtcctaactaaaggttctagtggcatccaggacctttagggaggcatttaataaaca

SEQ ID NO: 16543 - DNA, 4277 bp, Homo sapiens
  ENST00000455697
gtcctagggtatttgcatcttagcggcttcactcactgggctcgggagaatggagcgggcgggcggcgatcgccggccccaggcgggctcccggcgctgagcggagacgagtttttctccccgcagaggaggatcctggaaggacgcggagctggggcttgggggatgcagtggcctggacgaggtgactccaacccgggggagcagagtccgtcacgccggcagggaccgagggtctctgcggagctggaggaccttttgtgggatgcctcacggctgctgaggggctgcagcggcagccattgtttgatgtcctgtgactgagaaaccaggctttaaactttatgcctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggaaaaagttccttacgttaacagccccggagagaagcatcggattaaacagcttttgtaccagttaccaccacatgataatgaggtacggtattgccagtctttgagtgaagaggagaaaaaagagttgcaggtgttcagtgctcagcggaagaaagaagcactgggaagaggaacaattaagcttctgtccagagcagtcatgcatgctgtgtgtgagcagtgtggtttgaagataaatggaggtgaagttgcagtgttcgcctcccgtgcgggccctggtgtgtgctggcacccatcctgttttgtctgtttcacgtgtaatgagctgctggtcgacctcatctatttttatcaggatggaaaaattcactgtggcaggcaccatgcagaactgctcaaaccacggtgctcagcatgtgacgagataatttttgctgatgagtgcacagaagctgagggtcgccattggcacatgaaacacttctgctgccttgagtgtgaaacggtcctgggaggacagaggtatatcatgaaggacggccgccccttctgctgtggctgttttgagtctctctatgcggagtactgtgaaacctgtggggaacatattggtgtggaccatgcacagatgacctatgacgggcagcactggcacgccacggaagcctgcttttcttgtgcccagtgtaaagcctctttgttgggatgtcccttccttcccaaacagggtcagatttactgctcaaaaacgtgcagtcttggtgaagacgtccatgcctctgattcttccgactctgcatttcagtcagctcgatcaagagactcccgaagaagtgtccgaatgggcaagagcagccggtcagcagatcagtgtagacagtctctcctcttatcgcctgctctgaactacaagtttcctggcctctcaggcaatgctgatgacaccctttctcgaaaattggatgatctgagtctctccagacaaggaacaagttttgccagtgaagaattttggaaaggcagagtagagcaggaaactccagaagaccctgaagaatgggctgatcatgaagattatatgacgcagctcctcctcaagtttggtgataaaagcctctttcagccacagcccaatgagatggatattcgagccagtgagcactggatatctgataacatggttaaaagtaagaccgagttaaagcaaaataaccagagccttgcaagtaaaaaataccagtctgatatgtactgggcacagtcacaagatggactgggcgattctgcttatggcagccacccaggccctgcaagcagtagaaggcttcaggaattggaactggaccatggggcttcagggtataatcatgatgaaacacagtggtatgaagattccctggagtgtctgtcagacctgaaaccagagcaaagtgttcgggattcgatggattctttggcattgtccaatatcacaggggcttcggtggatggagaaaacaagccaaggccatcattgtattctctgcaaaattttgaggagatggaaacagaagattgtgagaagatgagcaatatgggaactttgaactcttccatgctgcacaggagtgcagagtccttaaagagtctaagttcagagttgtgtccagagaaaatcctgcctgaagagaagccagtacatctgccagtgctcagaaggtccaagtctcaatccagaccccagcaggtcaagttttctgatgatgtcattgacaatgggaactatgacattgaaatccggcagcctccgatgagtgaaaggactcggagacgcgtctacaattttgaagagaggggatccaggtctcatcaccaccgccgccggagaagtagaaagtcccgctccgacaatgccctgaatcttgttacagaaagaaaatactctcccaaggacagactgcggctgtacacccccgataactatgagaaatttatacagaataaaagtgcccgggagatccaagcatacatccagaatgctgatctctacggacagtacgcccatgccacttccgattatggcctgcagaacccaggaatgaatcggtttctgggactctacggcgaggatgatgattcctggtgttcttcctcctcctcctcttccgactcggaagaagaaggatattttcttggacaaccaatccctcaaccccggccacagagatttgcctactatacagatgacctttctagtccaccatctgcacttcccacccctcagtttggtcagaggacaacaaaatccaagaagaaaaagggacacaagggcaaaaattgtattatttcttaaccaagtagtgatgcagagcatttgtttaaaacttagccattaaccgtctgaatcgtttccttttcttccgtaggaaagttgtgaaaatagtttaaagtgctttctttgcccatgtaaatgagaactcaactgctgtttacagtgtcagattaacatttgaaaggtgtgatttctccaatttaccctctttggatggtgccaggtggacgtgacatctcgtgcctgtccggtgcgggtgcgttacagatggacgtagctgctttggttttccagtcctcaagggaatactgaagatgctgactgaaggggattggatgttgattttagaagatggagaactccagccacctttgtaaagcactagtgtttgtcatttatgtaagtcaggtcggctcaggtcttgatagtccgtcttggtgtgaggcatgcctgtcacgatgacctagctaacactgtgcatcttattgtgaggccagcttgtcccctcgaaccctctttggccaggtaaacattgtattgtatcagcgccagctacagattgaaaaaaaaaaacaaaaaacattgctatttataacttagtatttcatagacttaagtgtattcctaatttaacggtgcaaatattaatgtatatactgtacagttcagattttaaagctgatatttttatatccctgaattgtaagccgtttgttacgctgcagtgctagatttgccagggaaccagaatttatggatgaactgattgcttatattttagtcagggtttataaatgtagatggtcaaatttacattgcctagtgatggaaaattcaactttttttgatttttttttccaatattaaaaaaggctctgtatgcatggtggggctatgtaagtactctttaaaactatggccctattaatcttacaagtgttacttatgggtcaagcaatgtaaactgtataaatgtaaaaacaacccctccacacacataacccctggaatatatggtaaaaacaagtagaagctgtttcagcgagtgggttttttccccctgcctgcggggggtgcctttctcattttcagcaaggtgatgattatctcatgggaaatgacaaagatctgcttttgtggcagaggactttgtagatttgttattttaagagaggttattcctttttattccttccctcccactaatttgttggcctttaacagcaattttgaaaactgggtcttctggttatgtttttgttttaaaatctttaaattagaggatgctgtgccattgagtactgtaagttaatatgaggttctggttcaaggaaaacttacgttggatctgaaccaatgagcagatattttgatatgtgccactcttgcatatacatctcagtcctaactaaaggttctagtggcatccaggacctttagggaggcatttaataaaca

SEQ ID NO: 16544 - DNA, 3735 bp, Homo sapiens
  ENST00000640840
aactctggaagtagagaactggtgagaaagactgtgcactcagtgtggtgtttctgttttgctttctgtgaaggtacggtattgccagtctttgagtgaagaggagaaaaaagagttgcaggtgttcagtgctcagcggaagaaagaagcactgggaagaggaacaattaagcttctgtccagagcagtcatgcatgctgtgtgtgagcagtgtggtttgaagataaatggaggtgaagttgcagtgttcgcctcccgtgcgggccctggtgtgtgctggcacccatcctgttttgtctgtttcacgtgtaatgagctgctggtcgacctcatctatttttatcaggatggaaaaattcactgtggcaggcaccatgcagaactgctcaaaccacggtgctcagcatgtgacgagataatttttgctgatgagtgcacagaagctgagggtcgccattggcacatgaaacacttctgctgccttgagtgtgaaacggtcctgggaggacagaggtatatcatgaaggacggccgccccttctgctgtggctgttttgagtctctctatgcggagtactgtgaaacctgtggggaacatattggtgtggaccatgcacagatgacctatgacgggcagcactggcacgccacggaagcctgcttttcttgtgcccagtgtaaagcctctttgttgggatgtcccttccttcccaaacagggtcagatttactgctcaaaaacgtgcagtcttggtgaagacgtccatgcctctgattcttccgactctgcatttcagtcagctcgatcaagagactcccgaagaagtgtccgaatgggcaagagcagccggtcagcagatcagtgtagacagtctctcctcttatcgcctgctctgaactacaagtttcctggcctctcaggcaatgctgatgacaccctttctcgaaaattggatgatctgagtctctccagacaaggaacaagttttgccagtgaagaattttggaaaggcagagtagagcaggaaactccagaagaccctgaagaatgggctgatcatgaagattatatgacgcagctcctcctcaagtttggtgataaaagcctctttcagccacagcccaatgagatggatattcgagccagtgagcactggatatctgataacatggttaaaagtaagaccgagttaaagcaaaataaccagagccttgcaagtaaaaaataccagtctgatatgtactgggcacagtcacaagatggactgggcgattctgcttatggcagccacccaggccctgcaagcagtagaaggcttcaggaattggaactggaccatggggcttcagggtataatcatgatgaaacacagtggtatgaagattccctggagtgtctgtcagacctgaaaccagagcaaagtgttcgggattcgatggattctttggcattgtccaatatcacaggggcttcggtggatggagaaaacaagccaaggccatcattgtattctctgcaaaattttgaggagatggaaacagaagattgtgagaagatgagcaatatgggaactttgaactcttccatgctgcacaggagtgcagagtccttaaagagtctaagttcagagttgtgtccagagaaaatcctgcctgaagagaagccagtacatctgccagtgctcagaaggtccaagtctcaatccagaccccagcaggtcaagttttctgatgatgtcattgacaatgggaactatgacattgaaatccggcagcctccgatgagtgaaaggactcggagacgcgtctacaattttgaagagaggggatccaggtctcatcaccaccgccgccggagaagtagaaagtcccgctccgacaatgccctgaatcttgttacagaaagaaaatactctcccaaggacagactgcggctgtacacccccgataactatgagaaatttatacagaataaaagtgcccgggagatccaagcatacatccagaatgctgatctctacggacagtacgcccatgccacttccgattatggcctgcagaacccaggaatgaatcggtttctgggactctacggcgaggatgatgattcctggtgttcttcctcctcctcctcttccgactcggaagaagaaggatattttcttggacaaccaatccctcaaccccggccacagagatttgcctactatacagatgacctttctagtccaccatctgcacttcccacccctcagtttggtcagaggacaacaaaatccaagaagaaaaagggacacaagggcaaaaattgtattatttcttaaccaagtagtgatgcagagcatttgtttaaaacttagccattaaccgtctgaatcgtttccttttcttccgtaggaaagttgtgaaaatagtttaaagtgctttctttgcccatgtaaatgagaactcaactgctgtttacagtgtcagattaacatttgaaaggtgtgatttctccaatttaccctctttggatggtgccaggtggacgtgacatctcgtgcctgtccggtgcgggtgcgttacagatggacgtagctgctttggttttccagtcctcaagggaatactgaagatgctgactgaaggggattggatgttgattttagaagatggagaactccagccacctttgtaaagcactagtgtttgtcatttatgtaagtcaggtcggctcaggtcttgatagtccgtcttggtgtgaggcatgcctgtcacgatgacctagctaacactgtgcatcttattgtgaggccagcttgtcccctcgaaccctctttggccaggtaaacattgtattgtatcagcgccagctacagattgaaaaaaaaaaacaaaaaacattgctatttataacttagtatttcatagacttaagtgtattcctaatttaacggtgcaaatattaatgtatatactgtacagttcagattttaaagctgatatttttatatccctgaattgtaagccgtttgttacgctgcagtgctagatttgccagggaaccagaatttatggatgaactgattgcttatattttagtcagggtttataaatgtagatggtcaaatttacattgcctagtgatggaaaattcaactttttttgatttttttttccaatattaaaaaaggctctgtatgcatggtggggctatgtaagtactctttaaaactatggccctattaatcttacaagtgttacttatgggtcaagcaatgtaaactgtataaatgtaaaaacaacccctccacacacataacccctggaatatatggtaaaaacaagtagaagctgtttcagcgagtgggttttttccccctgcctgcggggggtgcctttctcattttcagcaaggtgatgattatctcatgggaaatgacaaagatctgcttttgtggcagaggactttgtagatttgttattttaagagaggttattcctttttattccttccctcccactaatttgttggcctttaacagcaattttgaaaactgggtcttctggttatgtttttgttttaaaatctttaaattagaggatgctgtgccattgagtactgtaagttaatatgaggttctggttcaaggaaaacttacgttggatctgaaccaatgagcagatattttgatatgtgccactcttgcatatacatctcagtcctaactaaaggttctagtggcatccagga

SEQ ID NO: 16545 - DNA, 3778 bp, Homo sapiens
  ENST00000640055
gggagaatggagcgggcgggcggcgatcgccggccccaggcgggctcccggcgctgagcggagacgagtttttctccccgcagaggaggatcctggaaggacgcggagctggggcttgggggatgcagtggcctggacgaggtgactccaacccgggggagcagagtccgtcacgccggcagggaccgagggtctctgcggagctggaggaccttttgtgggatgcctcacggctgctgaggggctgcagcggccattgtttgatgtcctgtgactgagaaaccaggctttaaactttatgcctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggaaaaagttccttacgttaacagccccggagagaagcatcggattaaacagcttttgtaccagttaccaccacatgataatgaggtacggtattgccagtctttgagtgaagaggagaaaaaagagttgcaggtgttcagtgctcagcggaagaaagaagcactgggaagaggaacaattaagcttctgtccagagcagtcatgcatgctgtgtgtgagcagtgtggtttgaagataaatggaggtgaagttgcagtgttcgcctcccgtgcgggccctggtgtgtgctggcacccatcctgttttgtctgtttcacgtgtaatgagctgctggtcgacctcatctatttttatcaggatggaaaaattcactgtggcaggcaccatgcagaactgctcaaaccacggtgctcagcatgtgacgagataatttttgctgatgagtgcacagaagctgagggtcgccattggcacatgaaacacttctgctgccttgagtgtgaaacggtcctgggaggacagaggtatatcatgaaggacggccgccccttctgctgtggctgttttgagtctctctatgcggagtactgtgaaacctgtggggaacatattggtgtggaccatgcacagatgacctatgacgggcagcactggcacgccacggaagcctgcttttcttgtgcccagtgtaaagcctctttgttgggatgtcccttccttcccaaacagggtcagatttactgctcaaaaacgtgcagtcttggtgaagacgtccatgcctctgattcttccgactctgcatttcagtcagctcgatcaagagactcccgaagaagtgtccgaatgggcaagagcagccggtcagcagatcagtgtagacagtctctcctcttatcgcctgctctgaactacaagtttcctggcctctcaggcaatgctgatgacaccctttctcgaaaattggatgatctgagtctctccagacaaggaacaagttttgccagtgaagaattttggaaaggcagagtagagcaggaaactccagaagaccctgaagaatgggctgatcatgaagattatatgacgcagctcctcctcaagtttggtgataaaagcctctttcagccacagcccaatgagatggatattcgagccagtgagcactggatatctgataacatggttaaaagtaagaccgagttaaagcaaaataaccagagccttgcaagtaaaaaataccagtctgatatgtactgggcacagtcacaagatggactgggcgattctgcttatggcagccacccaggccctgcaagcagtagaaggcttcaggaattggaactggaccatggggcttcagggtataatcatgatgaaacacagtggtatgaagattccctggagtgtctgtcagacctgaaaccagagcaaagtgttcgggattcgatggattctttggcattgtccaatatcacaggggcttcggtggatggagaaaacaagccaaggccatcattgtattctctgcaaaattttgaggagatggaaacagaagattgtgagaagatgagcaatatgggaactttgaactcttccatgctgcacaggagtgcagagtccttaaagagtctaagttcagagttgtgtccagagaaaatcctgcctgaagagaagccagtacatctgccagtgctcagaaggtccaagtctcaatccagaccccagcaggtcaagttttctgatgatgtcattgacaatgggaactatgacattgaaatccggcagcctccgatgagtgaaaggactcggagacgcgtctacaattttgaagagaggggatccaggtctcatcaccaccgccgccggagaagtagaaagtcccgctccgacaatgccctgaatcttgttacagaaagaaaatactctcccaaggacagactgcggctgtacacccccgataactatgagaaatttatacagaataaaagtgcccgggagatccaagcatacatccagaatgctgatctctacggacagtacgcccatgccacttccgattatggcctgcagaacccaggaatgaatcggtttctgggactctacggcgaggatgatgattcctggtgttcttcctcctcctcctcttccgactcggaagaagaaggatattttcttggacaaccaatccctcaaccccggccacagagatttgcctactatacagatgacctttctagtccaccatctgcacttcccacccctcagtttggtcagaggacaacaaaatccaagaagaaaaagggacacaagggcaaaaattgtattatttcttaaccaagtagtgatgcagagcatttgtttaaaacttagccattaaccgtctgaatcgtttccttttcttccgtaggaaagttgtgaaaatagtttaaagtgctttctttgcccatgtaaatgagaactcaactgctgtttacagtgtcagattaacatttgaaaggtgtgatttctccaatttaccctctttggatggtgccaggtggacgtgacatctcgtgcctgtccggtgcgggtgcgttacagatggacgtagctgctttggttttccagtcctcaagggaatactgaagatgctgactgaaggggattggatgttgattttagaagatggagaactccagccacctttgtaaagcactagtgtttgtcatttatgtaagtcaggtcggctcaggtcttgatagtccgtcttggtgtgaggcatgcctgtcacgatgacctagctaacactgtgcatcttattgtgaggccagcttgtcccctcgaaccctctttggccaggtaaacattgtattgtatcagcgccagctacagattgaaaaaaaaaaacaaaaaacattgctatttataacttagtatttcatagacttaagtgtattcctaatttaacggtgcaaatattaatgtatatactgtacagttcagattttaaagctgatatttttatatccctgaattgtaagccgtttgttacgctgcagtgctagatttgccagggaaccagaatttatggatgaactgattgcttatattttagtcagggtttataaatgtagatggtcaaatttacattgcctagtgatggaaaattcaactttttttgatttttttttccaatattaaaaaaggctctgtatgcatggtggggctatgtaagtactctttaaaactatggccctattaatcttacaagtgttacttatgggtcaagcaatgtaaactgtataaatgtaaaaacaacccctccacacacataacccc

SEQ ID NO: 16546 - DNA, 3803 bp, Homo sapiens
  ENST00000639958
gcactccgcctgcagcccagctgccagcgccgtctcccgcggccgccgccgcccgacagcgcgcccggaacatgccagcctcgcgcagcctgcgctgacttccccgagacgcgccgcggtcggcacggagactttctgggctctggatggttcgtgcgctgctcaccctcgcccacccctgacgccgcggaccgcagctcctcagccccgcagccccgcagcccagcagccccgcagcggcgccgaggacagtgcagccgagttgcgtctccctcgcgcgagccattgtttgatgtcctgtgactgagaaaccaggctttaaactttatgcctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggaaaaagttccttacgttaacagccccggagagaagcatcggattaaacagcttttgtaccagttaccaccacatgataatgaggtacggtattgccagtctttgagtgaagaggagaaaaaagagttgcaggtgttcagtgctcagcggaagaaagaagcactgggaagaggaacaattaagcttctgtccagagcagtcatgcatgctgtgtgtgagcagtgtggtttgaagataaatggaggtgaagttgcagtgttcgcctcccgtgcgggccctggtgtgtgctggcacccatcctgttttgtctgtttcacgtgtaatgagctgctggtcgacctcatctatttttatcaggatggaaaaattcactgtggcaggcaccatgcagaactgctcaaaccacggtgctcagcatgtgacgagataatttttgctgatgagtgcacagaagctgagggtcgccattggcacatgaaacacttctgctgccttgagtgtgaaacggtcctgggaggacagaggtatatcatgaaggacggccgccccttctgctgtggctgttttgagtctctctatgcggagtactgtgaaacctgtggggaacatattggtgtggaccatgcacagatgacctatgacgggcagcactggcacgccacggaagcctgcttttcttgtgcccagtgtaaagcctctttgttgggatgtcccttccttcccaaacagggtcagatttactgctcaaaaacgtgcagtcttggtgaagacgtccatgcctctgattcttccgactctgcatttcagtcagctcgatcaagagactcccgaagaagtgtccgaatgggcaagagcagccggtcagcagatcagtgtagacagtctctcctcttatcgcctgctctgaactacaagtttcctggcctctcaggcaatgctgatgacaccctttctcgaaaattggatgatctgagtctctccagacaaggaacaagttttgccagtgaagaattttggaaaggcagagtagagcaggaaactccagaagaccctgaagaatgggctgatcatgaagattatatgacgcagctcctcctcaagtttggtgataaaagcctctttcagccacagcccaatgagatggatattcgagccagtgagcactggatatctgataacatggttaaaagtaagaccgagttaaagcaaaataaccagagccttgcaagtaaaaaataccagtctgatatgtactgggcacagtcacaagatggactgggcgattctgcttatggcagccacccaggccctgcaagcagtagaaggcttcaggaattggaactggaccatggggcttcagggtataatcatgatgaaacacagtggtatgaagattccctggagtgtctgtcagacctgaaaccagagcaaagtgttcgggattcgatggattctttggcattgtccaatatcacaggggcttcggtggatggagaaaacaagccaaggccatcattgtattctctgcaaaattttgaggagatggaaacagaagattgtgagaagatgagcaatatgggaactttgaactcttccatgctgcacaggagtgcagagtccttaaagagtctaagttcagagttgtgtccagagaaaatcctgcctgaagagaagccagtacatctgccagtgctcagaaggtccaagtctcaatccagaccccagcaggtcaagttttctgatgatgtcattgacaatgggaactatgacattgaaatccggcagcctccgatgagtgaaaggactcggagacgcgtctacaattttgaagagaggggatccaggtctcatcaccaccgccgccggagaagtagaaagtcccgctccgacaatgccctgaatcttgttacagaaagaaaatactctcccaaggacagactgcggctgtacacccccgataactatgagaaatttatacagaataaaagtgcccgggagatccaagcatacatccagaatgctgatctctacggacagtacgcccatgccacttccgattatggcctgcagaacccaggaatgaatcggtttctgggactctacggcgaggatgatgattcctggtgttcttcctcctcctcctcttccgactcggaagaagaaggatattttcttggacaaccaatccctcaaccccggccacagagatttgcctactatacagatgacctttctagtccaccatctgcacttcccacccctcagtttggtcagaggacaacaaaatccaagaagaaaaagggacacaagggcaaaaattgtattatttcttaaccaagtagtgatgcagagcatttgtttaaaacttagccattaaccgtctgaatcgtttccttttcttccgtaggaaagttgtgaaaatagtttaaagtgctttctttgcccatgtaaatgagaactcaactgctgtttacagtgtcagattaacatttgaaaggtgtgatttctccaatttaccctctttggatggtgccaggtggacgtgacatctcgtgcctgtccggtgcgggtgcgttacagatggacgtagctgctttggttttccagtcctcaagggaatactgaagatgctgactgaaggggattggatgttgattttagaagatggagaactccagccacctttgtaaagcactagtgtttgtcatttatgtaagtcaggtcggctcaggtcttgatagtccgtcttggtgtgaggcatgcctgtcacgatgacctagctaacactgtgcatcttattgtgaggccagcttgtcccctcgaaccctctttggccaggtaaacattgtattgtatcagcgccagctacagattgaaaaaaaaaaacaaaaaacattgctatttataacttagtatttcatagacttaagtgtattcctaatttaacggtgcaaatattaatgtatatactgtacagttcagattttaaagctgatatttttatatccctgaattgtaagccgtttgttacgctgcagtgctagatttgccagggaaccagaatttatggatgaactgattgcttatattttagtcagggtttataaatgtagatggtcaaatttacattgcctagtgatggaaaattcaactttttttgatttttttttccaatattaaaaaaggctctgtatgcatggtggggctatgtaagtactctttaaaactatggccctattaatcttacaagtgttacttatgggtcaagcaatgtaaactgtataaatgtaaaaacaacccctccacacacataa

SEQ ID NO: 16547 - DNA, 3635 bp, Homo sapiens
  ENST00000548696
ttttgaagatcgccggccccaggcgggctcccggcgctgagcggagacgagtttttctccccgcagaggaggatcctggaaggacgcggagctggggcttgggggatgcagtggcctggacgaggtgactccaacccgggggagcagagtccgtcacgccggcagggaccgagggtctctgcggagctggaggaccttttgtgggatgcctcacggctgctgaggggctgcagcggccattgtttgatgtcctgtgactgagaaaccaggctttaaactttatgcctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggaaaaagttccttacgttaacagccccggagagaagcatcggattaaacagcttttgtaccagttaccaccacatgataatgaggtacggtattgccagtctttgagtgaagaggagaaaaaagagttgcaggtgttcagtgctcagcggaagaaagaagcactgggaagaggaacaattaagcttctgtccagagcagtcatgcatgctgtgtgtgagcagtgtggtttgaagataaatggaggtgaagttgcagtgttcgcctcccgtgcgggccctggtgtgtgctggcacccatcctgttttgtctgtttcacgtgtaatgagctgctggtcgacctcatctatttttatcaggatggaaaaattcactgtggcaggcaccatgcagaactgctcaaaccacggtgctcagcatgtgacgagataatttttgctgatgagtgcacagaagctgagggtcgccattggcacatgaaacacttctgctgccttgagtgtgaaacggtcctgggaggacagaggtatatcatgaaggacggccgccccttctgctgtggctgttttgagtctctctatgcggagtactgtgaaacctgtggggaacatattggtgtggaccatgcacagatgacctatgacgggcagcactggcacgccacggaagcctgcttttcttgtgcccagtgtaaagcctctttgttgggatgtcccttccttcccaaacagggtcagatttactgctcaaaaacgtgcagtcttggtgaagacgtccatgcctctgattcttccgactctgcatttcagtcagctcgatcaagagactcccgaagaagtgtccgaatgggcaagagcagccggtcagcagatcagtgtagacagtctctcctcttatcgcctgctctgaactacaagtttcctggcctctcaggcaatgctgatgacaccctttctcgaaaattggatgatctgagtctctccagacaaggaacaagttttgccagtgaagaattttggaaaggcagagtagagcaggaaactccagaagaccctgaagaatgggctgatcatgaagattatatgacgcagctcctcctcaagtttggtgataaaagcctctttcagccacagcccaatgagatggatattcgagccagtgagcactggatatctgataacatggttaaaagtaagaccgagttaaagcaaaataaccagagccttgcaagtaaaaaataccagtctgatatgtactgggcacagtcacaagatggactgggcgattctgcttatggcagccacccaggccctgcaagcagtagaaggcttcaggaattggaactggaccatggggcttcagggtataatcatgatgaaacacagtggtatgaagattccctggagtgtctgtcagacctgaaaccagagcaaagtgttcgggattcgatggattctttggcattgtccaatatcacaggggcttcggtggatggagaaaacaagccaaggccatcattgtattctctgcaaaattttgaggagatggaaacagaagattgtgagaagatgagcaatatgggaactttgaactcttccatgctgcacaggagtgcagagtccttaaagagtctaagttcagagttgtgtccagagaaaatcctgcctgaagagaagccagtacatctgccagtgctcagaaggtccaagtctcaatccagaccccagcaggtcaagttttctgatgatgtcattgacaatgggaactatgacattgaaatccggcagcctccgatgagtgaaaggactcggagacgcgtctacaattttgaagagaggggatccaggtctcatcaccaccgccgccggagaagtagaaagtcccgctccgacaatgccctgaatcttgttacagaaagaaaatactctcccaaggacagactgcggctgtacacccccgataactatgagaaatttatacagaataaaagtgcccgggagatccaagcatacatccagaatgctgatctctacggacagtacgcccatgccacttccgattatggcctgcagaacccaggaatgaatcggtttctgggactctacggcgaggatgatgattcctggtgttcttcctcctcctcctcttccgactcggaagaagaaggatattttcttggacaaccaatccctcaaccccggccacagagatttgcctactatacagatgacctttctagtccaccatctgcacttcccacccctcagtttggtcagaggacaacaaaatccaagaagaaaaagggacacaagggcaaaaattgtattatttcttaaccaagtagtgatgcagagcatttgtttaaaacttagccattaaccgtctgaatcgtttccttttcttccgtaggaaagttgtgaaaatagtttaaagtgctttctttgcccatgtaaatgagaactcaactgctgtttacagtgtcagattaacatttgaaaggtgtgatttctccaatttaccctctttggatggtgccaggtggacgtgacatctcgtgcctgtccggtgcgggtgcgttacagatggacgtagctgctttggttttccagtcctcaagggaatactgaagatgctgactgaaggggattggatgttgattttagaagatggagaactccagccacctttgtaaagcactagtgtttgtcatttatgtaagtcaggtcggctcaggtcttgatagtccgtcttggtgtgaggcatgcctgtcacgatgacctagctaacactgtgcatcttattgtgaggccagcttgtcccctcgaaccctctttggccaggtaaacattgtattgtatcagcgccagctacagattgaaaaaaaaaaacaaaaaacattgctatttataacttagtatttcatagacttaagtgtattcctaatttaacggtgcaaatattaatgtatatactgtacagttcagattttaaagctgatatttttatatccctgaattgtaagccgtttgttacgctgcagtgctagatttgccagggaaccagaatttatggatgaactgattgcttatattttagtcagggtttataaatgtagatggtcaaatttacattgcctagtgatggaaaattcaactttttttgatttttttttccaatattaaaaaaggctctgt

SEQ ID NO: 16548 - DNA, 3341 bp, Homo sapiens
  ENST00000639566
ctgggctcgggagaatggagcgggcgggcggcggtaggtgctcgagccgctaggctggccaagggggtgggtaacttttcgaggaattgtgcgcgcgggacctcgtggagatcggccaggggcacggtcagcagtgacagttcctggaaagcgggcggcggcgggagcaggctgggcaggcgccgcccgcgggcgggagcggggagctgggtccggctgggatcgaagggcgggatcggcaggaaacgaaatgcagccattgtttgatgtcctgtgactgagaaaccaggctttaaactttatgcctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggaaaaagttccttacgttaacagccccggagagaagcatcggattaaacagcttttgtaccagttaccaccacatgataatgaggtacggtattgccagtctttgagtgaagaggagaaaaaagagttgcaggtgttcagtgctcagcggaagaaagaagcactgggaagaggaacaattaagcttctgtccagagcagtcatgcatgctgtgtgtgagcagtgtggtttgaagataaatggaggtgaagttgcagtgttcgcctcccgtgcgggccctggtgtgtgctggcacccatcctgttttgtctgtttcacgtgtaatgagctgctggtcgacctcatctatttttatcaggatggaaaaattcactgtggcaggcaccatgcagaactgctcaaaccacggtgctcagcatgtgacgagataatttttgctgatgagtgcacagaagctgagggtcgccattggcacatgaaacacttctgctgccttgagtgtgaaacggtcctgggaggacagaggtatatcatgaaggacggccgccccttctgctgtggctgttttgagtctctctatgcggagtactgtgaaacctgtggggaacatattggtgtggaccatgcacagatgacctatgacgggcagcactggcacgccacggaagcctgcttttcttgtgcccagtgtaaagcctctttgttgggatgtcccttccttcccaaacagggtcagatttactgctcaaaaacgtgcagtcttggtgaagacgtccatgcctctgattcttccgactctgcatttcagtcagctcgatcaagagactcccgaagaagtgtccgaatgggcaagagcagccggtcagcagatcagtgtagacagtctctcctcttatcgcctgctctgaactacaagtttcctggcctctcaggcaatgctgatgacaccctttctcgaaaattggatgatctgagtctctccagacaaggaacaagttttgccagtgaagaattttggaaaggcagagtagagcaggaaactccagaagaccctgaagaatgggctgatcatgaagattatatgacgcagctcctcctcaagtttggtgataaaagcctctttcagccacagcccaatgagatggatattcgagccagtgagcactggatatctgataacatggttaaaagtaagaccgagttaaagcaaaataaccagagccttgcaagtaaaaaataccagtctgatatgtactgggcacagtcacaagatggactgggcgattctgcttatggcagccacccaggccctgcaagcagtagaaggcttcaggaattggaactggaccatggggcttcagggtataatcatgatgaaacacagtggtatgaagattccctggagtgtctgtcagacctgaaaccagagcaaagtgttcgggattcgatggattctttggcattgtccaatatcacaggggcttcggtggatggagaaaacaagccaaggccatcattgtattctctgcaaaattttgaggagatggaaacagaagattgtgagaagatgagcaatatgggaactttgaactcttccatgctgcacaggagtgcagagtccttaaagagtctaagttcagagttgtgtccagagaaaatcctgcctgaagagaagccagtacatctgccagtgctcagaaggtccaagtctcaatccagaccccagcaggtcaagttttctgatgatgtcattgacaatgggaactatgacattgaaatccggcagcctccgatgagtgaaaggactcggagacgcgtctacaattttgaagagaggggatccaggtctcatcaccaccgccgccggagaagtagaaagtcccgctccgacaatgccctgaatcttgttacagaaagaaaatactctcccaaggacagactgcggctgtacacccccgataactatgagaaatttatacagaataaaagtgcccgggagatccaagcatacatccagaatgctgatctctacggacagtacgcccatgccacttccgattatggcctgcagaacccaggaatgaatcggtttctgggactctacggcgaggatgatgattcctggtgttcttcctcctcctcctcttccgactcggaagaagaaggatattttcttggacaaccaatccctcaaccccggccacagagatttgcctactatacagatgacctttctagtccaccatctgcacttcccacccctcagtttggtcagaggacaacaaaatccaagaagaaaaagggacacaagggcaaaaattgtattatttcttaaccaagtagtgatgcagagcatttgtttaaaacttagccattaaccgtctgaatcgtttccttttcttccgtaggaaagttgtgaaaatagtttaaagtgctttctttgcccatgtaaatgagaactcaactgctgtttacagtgtcagattaacatttgaaaggtgtgatttctccaatttaccctctttggatggtgccaggtggacgtgacatctcgtgcctgtccggtgcgggtgcgttacagatggacgtagctgctttggttttccagtcctcaagggaatactgaagatgctgactgaaggggattggatgttgattttagaagatggagaactccagccacctttgtaaagcactagtgtttgtcatttatgtaagtcaggtcggctcaggtcttgatagtccgtcttggtgtgaggcatgcctgtcacgatgacctagctaacactgtgcatcttattgtgaggccagcttgtcccctcgaaccctctttggccaggtaaacattgtattgtatcagcgccagctacagattgaaa

SEQ ID NO: 16549 - DNA, 3311 bp, Homo sapiens
  ENST00000552240
acttttgaagatcgccggccccaggcgggctcccggcgctgagcggagacgagtttttctccccgcagaggaggatcctggaaggacgcggagctggggcttgggggatgcagtggcctggacgaggtgactccaacccgggggagcagagtccgtcacgccggcagggaccgagggtctctgcggagctggaggaccttttgtgggatgcctcacggctgctgaggggctgcagcggcagccattgtttgatgtcctgtgactgagaaaccaggctttaaactttatgcctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggaaaaagttccttacgttaacagccccggagagaagcatcggattaaacagcttttgtaccagttaccaccacatgataatgaggtacggtattgccagtctttgagtgaagaggagaaaaaagagttgcaggtgttcagtgctcagcggaagaaagaagcactgggaagaggaacaattaagcttctgtccagagcagtcatgcatgctgtgtgtgagcagtgtggtttgaagataaatggaggtgaagttgcagtgttcgcctcccgtgcgggccctggtgtgtgctggcacccatcctgttttgtctgtttcacgtgtaatgagctgctggtcgacctcatctatttttatcaggatggaaaaattcactgtggcaggcaccatgcagaactgctcaaaccacggtgctcagcatgtgacgagataatttttgctgatgagtgcacagaagctgagggtcgccattggcacatgaaacacttctgctgccttgagtgtgaaacggtcctgggaggacagaggtatatcatgaaggacggccgccccttctgctgtggctgttttgagtctctctatgcggagtactgtgaaacctgtggggaacatattggtgtggaccatgcacagatgacctatgacgggcagcactggcacgccacggaagcctgcttttcttgtgcccagtgtaaagcctctttgttgggatgtcccttccttcccaaacagggtcagatttactgctcaaaaacgtgcagtcttggtgaagacgtccatgcctctgattcttccgactctgcatttcagtcagctcgatcaagagactcccgaagaagtgtccgaatgggcaagagcagccggtcagcagatcagtgtagacagtctctcctcttatcgcctgctctgaactacaagtttcctggcctctcaggcaatgctgatgacaccctttctcgaaaattggatgatctgagtctctccagacaaggaacaagttttgccagtgaagaattttggaaaggcagagtagagcaggaaactccagaagaccctgaagaatgggctgatcatgaagattatatgacgcagctcctcctcaagtttggtgataaaagcctctttcagccacagcccaatgagatggatattcgagccagtgagcactggatatctgataacatggttaaaagtaagaccgagttaaagcaaaataaccagagccttgcaagtaaaaaataccagtctgatatgtactgggcacagtcacaagatggactgggcgattctgcttatggcagccacccaggccctgcaagcagtagaaggcttcaggaattggaactggaccatggggcttcagggtataatcatgatgaaacacagtggtatgaagattccctggagtgtctgtcagacctgaaaccagagcaaagtgttcgggattcgatggattctttggcattgtccaatatcacaggggcttcggtggatggagaaaacaagccaaggccatcattgtattctctgcaaaattttgaggagatggaaacagaagattgtgagaagatgagcaatatgggaactttgaactcttccatgctgcacaggagtgcagagtccttaaagagtctaagttcagagttgtgtccagagaaaatcctgcctgaagagaagccagtacatctgccagtgctcagaaggtccaagtctcaatccagaccccagcaggtcaagttttctgatgatgtcattgacaatgggaactatgacattgaaatccggcagcctccgatgagtgaaaggactcggagacgcgtctacaattttgaagagaggggatccaggtctcatcaccaccgccgccggagaagtagaaagtcccgctccgacaatgccctgaatcttgttacagaaagaaaatactctcccaaggacagactgcggctgtacacccccgataactatgagaaatttatacagaataaaagtgcccgggagatccaagcatacatccagaatgctgatctctacggacagtacgcccatgccacttccgattatggcctgcagaacccaggaatgaatcggtttctgggactctacggcgaggatgatgattcctggtgttcttcctcctcctcctcttccgactcggaagaagaaggatattttcttggacaaccaatccctcaaccccggccacagagatttgcctactatacagatgacctttctagtccaccatctgcacttcccacccctcagtttggtcagaggacaacaaaatccaagaagaaaaagggacacaagggcaaaaattgtattatttcttaaccaagtagtgatgcagagcatttgtttaaaacttagccattaaccgtctgaatcgtttccttttcttccgtaggaaagttgtgaaaatagtttaaagtgctttctttgcccatgtaaatgagaactcaactgctgtttacagtgtcagattaacatttgaaaggtgtgatttctccaatttaccctctttggatggtgccaggtggacgtgacatctcgtgcctgtccggtgcgggtgcgttacagatggacgtagctgctttggttttccagtcctcaagggaatactgaagatgctgactgaaggggattggatgttgattttagaagatggagaactccagccacctttgtaaagcactagtgtttgtcatttatgtaagtcaggtcggctcaggtcttgatagtccgtcttggtgtgaggcatgcctgtcacgatgacctagctaacactgtgcatcttattgtgaggccagcttgtcccctcgaaccctctttggccaggtaaacattgtattgtatcagcgcc

SEQ ID NO: 16550 - DNA, 782 bp, Homo sapiens
  ENST00000640361
cgactctgcatttcagtcagctcgatcaagagactcccgaagaagtgtccgaatgggcaagagcagccggtcagcagatcagtgtagacagtctctcctcttatcgcctgctctgaactacaagtttcctggcctctcaggcaatgctgatgacaccctttctcgaaaattggatgatctgagtctctccagacaaggaacaagttttgccagtgaagaattttggaaaggcagagtagagcaggaaactccagaagaccctgaagaatgggctgatcatgaagattatatgacgcagctcctcctcaagtttggtgataaaagcctctttcagccacagcccaatgagatggatattcgagccagtgagcactggatatctgataacatggttaaaagtaagaccgagttaaagcaaaataaccagagccttgcaagtaaaaaataccagtctgatatgtactgggcacagtcacaagatggactgggcgattctgcttatggcagccacccaggccctgcaagcagtagaaggcttcaggaattggaactggaccatggggcttcagggtataatcatgatgaaacacagtggtatgaagattccctggagtgtctgtcagacctgaaaccagagcaaagtgttcgggattcgatggattctttggcattgtccaatatcacaggtggagtttcgcccttgtcgcccaggatggagtgcaatggcgcagtctcacctcactgcaacctccatctcccgggttcaagtgattcttctgcct

SEQ ID NO: 16551 - DNA, 320 bp, Homo sapiens
  ENST00000640946
tctttttgaagataatttttgctgatgagtgcacagaagctgagggtcgccattggcacatgaaacacttctgctgccttgagtgtgaaacggtcctgggaggacagaggtatatcatgaaggacggccgccccttctgctgtggctgttttgagtctctctatgcggagtactgtgaaacctgtggggaacatattggtgtggaccatgcacagatgacctatgacgggcagcactggcacgccacggaagcctgcttttcttgtgcccagtgtaaagcctctttgttgggatgtcccttccttcccaaacagggtcag

SEQ ID NO: 16552 - DNA, 789 bp, Homo sapiens
  ENST00000552108
tgcgctgctcaccctcgcccacccctgacgccgcggaccgcagctcctcagccccgcagccccgcagcccagcagccccgcagcggcgccgaggacagtgcagccgagttgcgtctccctcgcgcgaggatagccattttctttgagcaagcacaacaaactttttaataaaggaattttaaagaaacatttatagcagtttggattaccccaaagaagtaaaggggaaaaggttatcttagagcatattcagccattgtttgatgtcctgtgactgagaaaccaggctttaaactttatgcctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggaaaaagttccttacgttaacagccccggagagaagcatcggattaaacagcttttgtaccagttaccaccacatgataatgaggtacggtattgccagtctttgagtgaagaggagaaaaaagagttgcaggtgttcagtgctcagcggaagaaagaagcactgggaagaggaacaattaagcttctgtccagagcagtcatgcatgctgtgtgtgagcagtgtggtttgaagataaatggaggtgaagttgcagtgttcgcctcccgtgcgggccctggtgtgtgctggcacccatcctgttttgtctgtttcacgtgtaatgagct

SEQ ID NO: 16553 - DNA, 554 bp, Homo sapiens
  ENST00000640801
gtagacagggaaagcagatattggctgcagcatcgccagggctccgcagaggctctccgcatggctcctgtttgctgcatcacaaccaactcttcccttggttttctccggcgtggaaacagcagccattgtttgatgtcctgtgactgagaaaccaggctttaaactttatgcctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggaaaaagttccttacgttaacagccccggagagaagcatcggattaaacagcttttgtaccagttaccaccacatgataatgaggtacggtattgccagtctttgagtgaagaggagaaaaaagagttgcaggtgttcagtgctcagcggaagaaagaagcactgggaagaggaacaattaagcttctgtccagagcagtcatgcatgctgtgtgtgagcag

SEQ ID NO: 16554 - DNA, 712 bp, Homo sapiens
  ENST00000551050
ggggcttcgcgtcggcgccgaggaggggttcgctcgctgcctctgcgtcctgagctcggcctctggctcctggggccggggacgcagagaggggctggagccggtcgacccacggcccagggcgccccctcgcggcctaagcagcggccgccgcctggagcgcagagtttgcggggcccagggggcgccgacgcccgctctgaggcgtctctgctgctgcggcggcggggatggggacgacccaggggaccccctgcagccatcactggcagccccatcaagaattggccggctgagttttcccaaacagccattgtttgatgtcctgtgactgagaaaccaggctttaaactttatgcctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggaaaaagttccttacgttaacagccccggagagaagcatcggattaaacagcttttgtaccagttaccaccacatgataatgaggtacggtattgccagtctttgagtgaagaggagaaaaaagagttgcaggtgttcagtgctcagcggaagaaagaagcactgggaagaggaacaattaagcttctgtccaga

SEQ ID NO: 16555 - DNA, 456 bp, Homo sapiens
  ENST00000547113
catgccagcctcgcgcagcctgcgctgacttccccgagacgcgccgcggtcggcacggagactttctgggctctggatgcagccattgtttgatgtcctgtgactgagaaaccaggctttaaactttatgcctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggaaaaagttccttacgttaacagccccggagagaagcatcggattaaacagcttttgtaccagttaccaccacatgataatgaggtacggtattgccagtctttgagtgaagaggagaaaaaagagttgcaggtgttcagtgctcagcggaagaaagaagcactggg

SEQ ID NO: 16556 - DNA, 711 bp, Homo sapiens
  ENST00000640646
catgccagcctcgcgcagcctgcgctgacttccccgagacgcgccgcggtcggcacggagactttctgggctctggatggttcgtgcgctgctcaccctcgcccacccctgacgccgcggaccgcagctcctcagccccgcagccccgcagcccagcagccccgcagcggcgccgaggacagtgcagccgagttgcgtctccctcgcgcgagataaggtctcgctctgttgcccaggctggagtgcagtggcgcgatcatggctcactgcagcctcgacctcctggactcaagcgattctcccaccttggcctcctgagtagctgggaccacagcagccattgtttgatgtcctgtgactgagaaaccaggctttaaactttatgcctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggaaaaagttccttacgttaacagccccggagagaagcatcggattaaacagcttttgtaccagttaccaccacatgataatgaggtacggtattgccagtctttgagtgaagaggagaaaaaagagttgcaggtgttcagtgctcagcggaagaaagaagcactggg

SEQ ID NO: 16557 - DNA, 766 bp, Homo sapiens
  ENST00000639414
acggagactttctgggctctggatggttcgtgcgctgctcaccctcgcccacccctgacgccgcggaccgcagctcctcagccccgcagccccgcagcccagcagccccgcagcggcgccgaggacagtgcagccgagttgcgtctccctcgcgcgaggatagccattttctttgagcaagcacaacaaactttttaataaaggaattttaaagaaacatttatagcagtttggattaccccaaagaagtaaaggggaaaaggttatcttagagcatattcagccattgtttgatgtcctgtgactgagaaaccaggctttaaactttatgcctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggaaaaagttccttacgttaacagccccggagagaagcatcggattaaacagcttttgtaccagttaccaccacatgataatgagtgtttgcagccacccaccaatgatcaggaacctacaaattcctgagatttcccagcccctgcatccagagtgaatgctttatggtcattcaggcctgcagttgagttgagtgcatgtagaatggagagtaaaagtggcaattaacaagtttaaaccttttgtggaaaggttaatgtcctatatatatttttt

SEQ ID NO: 16558 - DNA, 453 bp, Homo sapiens
  ENST00000552200
actccgcctgcagcccagctgccagcgccgtctcccgcggccgccgccgcccgacagcgcgcccggaacatgccagcctcgcgcagcctgcgctgacttccccgagacgcgccgcggtcggcacggagactttctgggctctggatggttcgtgcgctgctcaccctcgcccacccctgacgccgcggaccgcagctcctcagccccgcagccccgcagcccagcagccccgcagcggcgccgaggacagtgcagccgagttgcgtctccctcgcgcgagatcgccggccccaggcgggctcccggcgctgagcggagacgagtttttctccccgcagaggaggatcctggaaggacgcggagctggggcttgggggatgcagtggcctggacgaggtgactccaacccgggggagcagagtccgtcacgccggcagggaccgagggtctctg

SEQ ID NO: 16559 - DNA, 574 bp, Homo sapiens
  ENST00000639588
gcactccgcctgcagcccagctgccagcgccgtctcccgcggccgccgccgcccgacagcgcgcccggaacatgccagcctcgcgcagcctgcgctgacttccccgagacgcgccgcggtcggcacggagactttctgggctctggatggttcgtgcgctgctcaccctcgcccacccctgacgccgcggaccgcagctcctcagccccgcagccccgcagcccagcagccccgcagcggcgccgaggacagtgcagccgagttgcgtctccctcgcgcgagtgaccagcctagaagctgaagctacccagcggctgccagctagcagtcatctcattagcatacaaaaaagactatcatgttggaatcatgtgaaatcacgttggacattccaaggattttaggagttgtgtgccaggaaacctggacaaagaccaactatacatttcacgatgtcagaacgagtaagtggcaaagctggcaccaaggctggatgactccagaattcgtgtccttaaccactatgcctcactatcttccaaaaaaacaaatattctaaagacaatcataactg

SEQ ID NO: 16560 - DNA, 3711 bp, Homo sapiens
  ENST00000393140
agagctgccgcggggggaacgcggacctcttttccccgagcccagggtcggctggggccgccgccaggcaagttcgccccaggagcgggcgccgctggccgagatgctcctccgggacttggtgctgcgccgtggctgctgctggtcctcgctgctgctgcactgcgcgctccacccgctctggggcttcgtgcaggtgacgcatggtgagccccagaagtcctgctccaaagtgactgacagctgccgacacgtctgccagtgccggccccctcccccgctgcccccgccgcccccacccccgccacctcccagactcctctccgccccagctcccaactctacctcttgccccactgaggaaagctggtggtcggggctggtgatcatcattgccgtatgctgtgcctccctggtgtttctgactgtgcttgtcatcatttgctacaaagccataaaaaggaaaccactgagaaaagacgaaaatggcaccagcgttgctgagtatcccatgagtgcttcgcagagcaacaaaggagtagacgtgaacaacgcagtggtgtgagtctgcaggccctggacccgctggccagagggacaccttggtggcactggtggacatgggaaagcaggtggacatgagctaaccctgagcttgtccaggacttcattgcctcacaggccctgagcctcccgaaggagaaaccattgtcttcccaggcttgcccctggtcagcctgcgggcccaggcagctcggacaccaggctgagcccggcgcagcacctgggcagtgtccccaccccaggccctccacatcctcctccctgtctggtgtctggtctgtcgactgcccccagctgctgtctaaagcatgcgcactggcgaagccagagggatctgtctttctactgtggcagggaggcttccccctttagccaaaagaaagatggtccggagcccactccctgccggaaaacctctcctcctcccaggaagcctgcctgctccactgttcacattctcaacagaagccatcggcacagccagcagacagacgtcccctttcaaaggtgcttcccacacatctgttcatcgccccatctgcagttgttgtcaatcttcagggcctgccttctccctcctatccccactgacaccctacaccctaggctcctgactgcctgccatggagggctgtgagtccagcctgcagaatcccctcctgagcagacacaggagtgcgtttacactcgggggcagtgtctggccttccgggggcaaaacgactcactgaacccgcagcccagggccactgggcaagggcagaggccactgcacctgtcctcagactcatccccacacttgaccccataggaactgatgcatctgtgtgagccaggccctgccttagtcagcagaggccactacttgtgccaaatccactgtgggcctgctgtaccaggctgatgctggccaggcgctggatgtcccccacagtcccctgaggcctgactgttgtactcaggccctctcccagagtcctccatcatctccccattttaccctaccccgagccccagtcgccaagaaggaggtgttgttcttccagggtcttcctttcaatgtctgtttccacagtctcatgctatagaagcgctgagccctccagcgtggttggaggatcaagggatgaaatgggacaggaggagaggggtcctccaggctggtgacccctgccctgttggcctgtctcccaagtggcagccttccctgtgggccacatcaggaaacccacggagacagggtgattttgcatctcctggaaaatgagtgggacactcctggccccctggctctccccaccacccctacatatgtgctcagaaggagcccaatgcattgaatggttccactgtcgagccctctaagacctggtttgcctcctaaacctccagtgtgctcctctgataggtgtttaagctacaggtgagactttgaagtccagagaagacagacacacctgaaaaccggtccccatttgggccgaaccttaaaaagcccattgtcccagagtcctagtgcccacggagctgtctgtgtgtcattgtcctgcccaggtcatcaggtgtgggctgaggacaggcccagggcataccctcccataaaggggttttcttctttcctcatttccttctatttgaggacttgtttggggtttagatttgaattttgcttcccctggacacctgggcatcagcatagtgccaccccctgctcctgacctggccagtacttcacagtgctcttgaggtgcggagccagctgacaaataggccagagggtgtgggccagcagcaggttaaagggggaaacccagcagaccccaccccagggcactctcccctactgccttcagccttctggtgcctgttgaacccccaagctgtgccctaagcagacccctgggcaggaccctagccctaagcacacaccaccctgtgctgcaaccatgagaaagtgcccatgccttgggctgtccagaagctcaggagtgatcagagggcaccttctctaagaggggaggttcctggctaagggaccatggagtggtgggcagcctgaaggggctgggcacagcccagctttgcgcacactcgcctggtcccatcattccctaccttggcttaaacctaggaggcctggattttgcagttagcctaatcttccagccccaggcgaggctccctggtgaggaatcagctgagccatcaccacgttttggggcctgtatcctcttccctgagccgctgacgcatccagggctctagtctgcacataaattccctctcagctgggcttgtaaaatcccttctcaccccagttagcaaaaatcaagggaagagcctagtttttttaaaagattcacttaatatccaccccccacctcaagcccaagaccgcccattcaaaaaacaagtatacggcacagcaagggagacccactagattttgagcttacagagacataagggtacttaaaaccctgccggcctagtatttgagcttagaacttttatttaaaatgagccggcagtctctagacacacaccgatcctcaggctagtccgagccctgaggtcaagaatgaaatgcacttcccttctcattttctcaaatagatcttttccagccgtctcacagttgaccccaactttggaactcagatcataggatctcccagaggtttcaggtgttcctaagaagcttctaaaggaagttttggaagaaagactaataggtgtaaacatataaacatatatattatatatagctatatatatttaaagagatctctacatatatatatatatataaatacaactactgtactctctgcatctgtacaaagtatgagttaaactgcccaggtagtgtgagatacgtaatgcatgaatgtgaatatcctgaaatctgccttcttagcaacgtgccgcgtgtactggagagaggacagttgctcctgggagttctctcaatgggcaaatgtacaagttgatgccgtcttatccaccaacaagccattaaggttggtttcctgctgagacttttgtaccggaagcgagaccggcagcactgggggtgtccatatgccacttatgaggaagaaagcaccatgacttttttattttcaataaaaatatagagatgtc

SEQ ID NO: 16561 - DNA, 1081 bp, Homo sapiens
  ENST00000477603
cgccaggcaagttcgccccaggagcgggcgccgctggccgagatgctcctccgggacttggtgctgcgccgtggctgctgctggtcctcgctgctgctgcactgcgcgctccacccgctctggggcttcgtgcaggtgacgcatggtgagccccagaagtcctgctccaaagtgactgacagctgccgacacgtctgccagtgccggccccctcccccgctgcccccgccgcccccacccccgccacctcccagactcctctccgccccagctcccaactctacctcttgccccactgaggaaagctggtggtcggggctggtgatcatcattgccgtatgctgtgcctccctggtgtttctgactgtgcttgtcatcatttgctacaaagccataaaaaggaaccatgccatctagggagccctctgtggccatctctgcctggaccagggtggaaatgcctcttcttggtttaatgagaccagcctcagctgactcacagagctgcagagccaggctgggtcctaacaactctctctagcatttccggagccccacggggcacgcgttaggaaaccactgagaaaagacgaaaatggcaccagcgttgctgagtatcccatgagtgcttcgcagagcaacaaaggagtagacgtgaacaacgcagtggtgtgagtctgcaggccctggacccgctggccagagggacaccttggtggcactggtggacatgggaaagcaggtggacatgagctaaccctgagcttgtccaggacttcattgcctcacaggccctgagcctcccgaaggagaaaccattgtcttcccaggcttgcccctggtcagcctgcgggcccaggcagctcggacaccaggctgagcccggcgcagcacctgggcagtgtccccaccccaggccctccacatcctcctccctgtctggtgtctggtctgtcgactgcccccagctgctgtctaaagcatgcgcactggcgaagccagagggatctgtctttctactgtggcagggaggcttccccctttagccaaaagaaagatggtccggagcccactccctgcc

SEQ ID NO: 16562 - DNA, 3649 bp, Homo sapiens
  ENST00000393143
ctcctgacagttcgccccaggagcgggcgccgctggccgagatgctcctccgggacttggtgctgcgccgtggctgctgctggtcctcgctgctgctgcactgcgcgctccacccgctctggggcttcgtgcaggtgacgcatggtgagccccagaagtcctgctccaaagtgactgacagctgccgacacgtctgccagtgccggccccctcccccgctgcccccgccgcccccacccccgccacctcccagactcctctccgccccagctcccaactctacctcttgccccactgaggaaagctggtggtcggggctggtgatcatcattgccgtatgctgtgcctccctggtgtttctgactgtgcttgtcatcatttgctacaaagccataaaaaggaaaccactgagaaaagacgaaaatggcaccagcgttgctgagtatcccatgagtgcttcgcagagcaacaaaggagtagacgtgaacaacgcagtggtgtgagtctgcaggccctggacccgctggccagagggacaccttggtggcactggtggacatgggaaagcaggtggacatgagctaaccctgagcttgtccaggacttcattgcctcacaggccctgagcctcccgaaggagaaaccattgtcttcccaggcttgcccctggtcagcctgcgggcccaggcagctcggacaccaggctgagcccggcgcagcacctgggcagtgtccccaccccaggccctccacatcctcctccctgtctggtgtctggtctgtcgactgcccccagctgctgtctaaagcatgcgcactggcgaagccagagggatctgtctttctactgtggcagggaggcttccccctttagccaaaagaaagatggtccggagcccactccctgccggaaaacctctcctcctcccaggaagcctgcctgctccactgttcacattctcaacagaagccatcggcacagccagcagacagacgtcccctttcaaaggtgcttcccacacatctgttcatcgccccatctgcagttgttgtcaatcttcagggcctgccttctccctcctatccccactgacaccctacaccctaggctcctgactgcctgccatggagggctgtgagtccagcctgcagaatcccctcctgagcagacacaggagtgcgtttacactcgggggcagtgtctggccttccgggggcaaaacgactcactgaacccgcagcccagggccactgggcaagggcagaggccactgcacctgtcctcagactcatccccacacttgaccccataggaactgatgcatctgtgtgagccaggccctgccttagtcagcagaggccactacttgtgccaaatccactgtgggcctgctgtaccaggctgatgctggccaggcgctggatgtcccccacagtcccctgaggcctgactgttgtactcaggccctctcccagagtcctccatcatctccccattttaccctaccccgagccccagtcgccaagaaggaggtgttgttcttccagggtcttcctttcaatgtctgtttccacagtctcatgctatagaagcgctgagccctccagcgtggttggaggatcaagggatgaaatgggacaggaggagaggggtcctccaggctggtgacccctgccctgttggcctgtctcccaagtggcagccttccctgtgggccacatcaggaaacccacggagacagggtgattttgcatctcctggaaaatgagtgggacactcctggccccctggctctccccaccacccctacatatgtgctcagaaggagcccaatgcattgaatggttccactgtcgagccctctaagacctggtttgcctcctaaacctccagtgtgctcctctgataggtgtttaagctacaggtgagactttgaagtccagagaagacagacacacctgaaaaccggtccccatttgggccgaaccttaaaaagcccattgtcccagagtcctagtgcccacggagctgtctgtgtgtcattgtcctgcccaggtcatcaggtgtgggctgaggacaggcccagggcataccctcccataaaggggttttcttctttcctcatttccttctatttgaggacttgtttggggtttagatttgaattttgcttcccctggacacctgggcatcagcatagtgccaccccctgctcctgacctggccagtacttcacagtgctcttgaggtgcggagccagctgacaaataggccagagggtgtgggccagcagcaggttaaagggggaaacccagcagaccccaccccagggcactctcccctactgccttcagccttctggtgcctgttgaacccccaagctgtgccctaagcagacccctgggcaggaccctagccctaagcacacaccaccctgtgctgcaaccatgagaaagtgcccatgccttgggctgtccagaagctcaggagtgatcagagggcaccttctctaagaggggaggttcctggctaagggaccatggagtggtgggcagcctgaaggggctgggcacagcccagctttgcgcacactcgcctggtcccatcattccctaccttggcttaaacctaggaggcctggattttgcagttagcctaatcttccagccccaggcgaggctccctggtgaggaatcagctgagccatcaccacgttttggggcctgtatcctcttccctgagccgctgacgcatccagggctctagtctgcacataaattccctctcagctgggcttgtaaaatcccttctcaccccagttagcaaaaatcaagggaagagcctagtttttttaaaagattcacttaatatccaccccccacctcaagcccaagaccgcccattcaaaaaacaagtatacggcacagcaagggagacccactagattttgagcttacagagacataagggtacttaaaaccctgccggcctagtatttgagcttagaacttttatttaaaatgagccggcagtctctagacacacaccgatcctcaggctagtccgagccctgaggtcaagaatgaaatgcacttcccttctcattttctcaaatagatcttttccagccgtctcacagttgaccccaactttggaactcagatcataggatctcccagaggtttcaggtgttcctaagaagcttctaaaggaagttttggaagaaagactaataggtgtaaacatataaacatatatattatatatagctatatatatttaaagagatctctacatatatatatatatataaatacaactactgtactctctgcatctgtacaaagtatgagttaaactgcccaggtagtgtgagatacgtaatgcatgaatgtgaatatcctgaaatctgccttcttagcaacgtgccgcgtgtactggagagaggacagttgctcctgggagttctctcaatgggcaaatgtacaagttgatgccgtcttatccaccaacaagccattaaggttggtttcctgctgagacttttgtaccggaagcgagaccggcagcactgggggtgtccatatgccacttatgaggaagaaagcaccatgacttttttattttcaataaaaatatagagatgtc

SEQ ID NO: 16563 - DNA, 1080 bp, Homo sapiens
  ENST00000316227
ctcctgacagttcgccccaggagcgggcgccgctggccgagatgctcctccgggacttggtgctgcgccgtggctgctgctggtcctcgctgctgctgcactgcgcgctccacccgctctggggcttcgtgcaggtgacgcatggtgagccccagaagtcctgctccaaagtgactgacagctgccgacacgtctgccagtgccggccccctcccccgctgcccccgccgcccccacccccgccacctcccagactcctctccgccccagctcccaactctacctcttgccccactgaggaaagctggtggtcggggctggtgatcatcattgccgtatgctgtgcctccctggtgtttctgactgtgcttgtcatcatttgctacaaagccataaaaaggaaccatgccatctagggagccctctgtggccatctctgcctggaccagggtggaaatgcctcttcttggtttaatgagaccagcctcagctgactcacagagctgcagagccaggctgggtcctaacaactctctctagcatttccggagccccacggggcacgcgttaggaaaccactgagaaaagacgaaaatggcaccagcgttgctgagtatcccatgagtgcttcgcagagcaacaaaggagtagacgtgaacaacgcagtggtgtgagtctgcaggccctggacccgctggccagagggacaccttggtggcactggtggacatgggaaagcaggtggacatgagctaaccctgagcttgtccaggacttcattgcctcacaggccctgagcctcccgaaggagaaaccattgtcttcccaggcttgcccctggtcagcctgcgggcccaggcagctcggacaccaggctgagcccggcgcagcacctgggcagtgtccccaccccaggccctccacatcctcctccctgtctggtgtctggtctgtcgactgcccccagctgctgtctaaagcatgcgcactggcgaagccagagggatctgtctttctactgtggcagggaggcttccccctttagccaaaagaaagatggtccggagcccactccctgcc

SEQ ID NO: 16564 - DNA, 3711 bp, Homo sapiens; identical to SEQ ID NO: 16560
  ENST00000629961

SEQ ID NO: 16565 - DNA, 1081 bp, Homo sapiens; identical to SEQ ID NO: 16561
  ENST00000627063

SEQ ID NO: 16566 - DNA, 1080 bp, Homo sapiens; identical to SEQ ID NO: 16563
  ENST00000617019

SEQ ID NO: 16567 - DNA, 3649 bp, Homo sapiens; identical to SEQ ID NO: 16562
  ENST00000611347

SEQ ID NO: 16568 - DNA, 3305 bp, Homo sapiens
  ENST00000287878
gagctggtttattctgcggccgaggattacatttatgcacgaacgggcttactggttccagattccccacttgggcacaggcataggaggcttgttttccaaattgctggttttaattgcacctgcctttcagattacctctgggaatctgtgggaggagccgagagggtggaaaatgtttcttagctttgcaaaaggaagaaaactttgtcacccagcgggagacctcagccacgagtaacccggggagacaccagaaccgggacgggctttgactgatttgcctacgagggttccgtaggaaaggacgcttgaattcggcgcttcggcggcggcggcggccgcgcgagttccctgctcaccctccctctccgcggaagtccccacgaggtggcttcagggtgtaacagagcgcgcggctccagtccgaaggcagcggccgggggagggaaggaggggaccgaacccccgaggagtttcgcagaatcaacttctggttagagttatgggaagcgcggttatggacaccaagaagaaaaaagatgtttccagccccggcgggagcggcggcaagaaaaatgccagccagaagaggcgttcgctgcgcgtgcacattccggacctgagctccttcgccatgccgctcctggacggagacctggagggttccggaaagcattcctctcgaaaggtggacagccccttcggcccgggcagcccctccaaagggttcttctccagaggcccccagccccggccctccagccccatgtctgcacctgtgaggcccaagaccagccccggctctcccaaaaccgtgttcccgttctcctaccaggagtccccgccacgctcccctcgacgcatgagcttcagtgggatcttccgctcctcctccaaagagtcttcccccaactccaaccctgctacctcgcccgggggcatcaggtttttctcccgctccagaaaaacctccggcctctcctcctctccgtcaacacccacccaagtgaccaagcagcacacgtttcccctggaatcctataagcacgagcctgaacggttagagaatcgcatctatgcctcgtcttcccccccggacacagggcagaggttctgcccgtcttccttccagagcccgaccaggcctccactggcatcaccgacacactatgctccctccaaagccgcggcgctggcggcggccctgggacccgcggaagccggcatgctggagaagctggagttcgaggacgaagcagtagaagactcagaaagtggtgtttacatgcgattcatgaggtcacacaagtgttatgacatcgttccaaccagttcaaagcttgttgtctttgatactacattacaagttaaaaaggccttctttgctttggtagccaacggtgtccgagcagcgccactgtgggagagtaaaaaacaaagttttgtaggaatgctaacaattacagatttcataaatatactacatagatactataaatcacctatggtacagatttatgaattagaggaacataaaattgaaacatggagggagctttatttacaagaaacatttaagcctttagtgaatatatctccagatgcaagcctcttcgatgctgtatactccttgatcaaaaataaaatccacagattgcccgttattgaccctatcagtgggaatgcactttatatacttacccacaaaagaatcctcaagttcctccagctttttatgtctgatatgccaaagcctgccttcatgaagcagaacctggatgagcttggaataggaacgtaccacaacattgccttcatacatccagacactcccatcatcaaagccttgaacatatttgtggaaagacgaatatcagctctgcctgttgtggatgagtcaggaaaagttgtagatatttattccaaatttgatgtaattaatcttgctgctgagaaaacatacaataacctagatatcacggtgacccaggcccttcagcaccgttcacagtattttgaaggtgttgtgaagtgcaataagctggaaatactggagaccatcgtggacagaatagtaagagctgaggtccatcggctggtggtggtaaatgaagcagatagtattgtgggtattatttccctgtcggacattctgcaagccctgatcctcacaccagcaggtgccaaacaaaaggagacagaaacggagtgaccgccgtgaatgtagacgccctaggaggagaacttgaacaaagtctctgggtcacgttttgcctcatgaacactggctgcaagtggttaagaatgtatatcagggtttaacaataggtatttcttccagtgatgttgaaattaagcttaaaaaagaaagattttatgtgcttgaagattcaggcttgcattaaaagactgttttcagacctttgtctgaaggattttaaatgctgtatgtcattaaagtgcactgtgtcctgaagttttcattatttttcatttcaaagaattcactggtatggaacaggtgatgtggcataaggtgagtgcacggtatgttcagatcacagtgccttatgtccgaatacagcaatatgtcaccgccgcagccggggcgcacgcgtgtgaaacaacaccgagcttgaatgtggaagtctttgaaccttttaccaaatcagtttgttttctttagatttgtcaaaaagttgtaatttgaatataaataattactttaaaattgtaatgacacttttacacgtaagtgttttgttctgggctaccgtgtcaacgaggctgctttacaacagctttatttatttttactttcatgcaatttttttacacatcttttggtggagtaaacttcaccacatccatgaataaactctcagttattttgaaatggcaaatttctcattatttaagtttggatctggaaaggacatgacttctgaaatagccgctgctgggttttaaaagctgaggtctctcaaagtgtggaggagacgttgccgtcaggcgggagccaagtgccgggaagatgtctattttttttcttgtgtattgaaatgtaaaatcatgatgtttgttatgactgctgatgcgattgtttttgtaaattttattgtggcatatacagtattgtcatacagttgaagagaaacaatgtttcctaatgtaagtgctctgaaaatgttgacactgtatatatatatatgaggatagtttgttttttttttgttttgggtttttttttttcagattgaaaaattaaaatagatcctactatctaccattttgttaaagaa

SEQ ID NO: 16569 - DNA, 2318 bp, Homo sapiens
  ENST00000418337
gcggccgcgccacctgcggcggcggcggcggcctcgggcgggtgggggcagcgctcccgctccgcccccggcccccgctgcccgcgtcccctgccaggcccctcctcccggcggcgcggcagagccaggccccagcgctcggccggccgcgagcccgccggccggggacgagcgtcgcagctcatgctgatcgctgtcctcctcctccccctcaggcggcgctggcggcggccctgggacccgcggaagccggcatgctggagaagctggagttcgaggacgaagcagtagaagactcagaaagtggtgtttacatgcgattcatgaggtcacacaagtgttatgacatcgttccaaccagttcaaagcttgttgtctttgatactacattacaagttaaaaaggccttctttgctttggtagccaacggtgtccgagcagcgccactgtgggagagtaaaaaacaaagttttgtaggaatgctaacaattacagatttcataaatatactacatagatactataaatcacctatggtacagatttatgaattagaggaacataaaattgaaacatggagggagctttatttacaagaaacatttaagcctttagtgaatatatctccagatgcaagcctcttcgatgctgtatactccttgatcaaaaataaaatccacagattgcccgttattgaccctatcagtgggaatgcactttatatacttacccacaaaagaatcctcaagttcctccagctttttatgtctgatatgccaaagcctgccttcatgaagcagaacctggatgagcttggaataggaacgtaccacaacattgccttcatacatccagacactcccatcatcaaagccttgaacatatttgtggaaagacgaatatcagctctgcctgttgtggatgagtcaggaaaagttgtagatatttattccaaatttgatgtaattaatcttgctgctgagaaaacatacaataacctagatatcacggtgacccaggcccttcagcaccgttcacagtattttgaaggtgttgtgaagtgcaataagctggaaatactggagaccatcgtggacagaatagtaagagctgaggtccatcggctggtggtggtaaatgaagcagatagtattgtgggtattatttccctgtcggacattctgcaagccctgatcctcacaccagcaggtgccaaacaaaaggagacagaaacggagtgaccgccgtgaatgtagacgccctaggaggagaacttgaacaaagtctctgggtcacgttttgcctcatgaacactggctgcaagtggttaagaatgtatatcagggtttaacaataggtatttcttccagtgatgttgaaattaagcttaaaaaagaaagattttatgtgcttgaagattcaggcttgcattaaaagactgttttcagacctttgtctgaaggattttaaatgctgtatgtcattaaagtgcactgtgtcctgaagttttcattatttttcatttcaaagaattcactggtatggaacaggtgatgtggcataaggtgagtgcacggtatgttcagatcacagtgccttatgtccgaatacagcaatatgtcaccgccgcagccggggcgcacgcgtgtgaaacaacaccgagcttgaatgtggaagtctttgaaccttttaccaaatcagtttgttttctttagatttgtcaaaaagttgtaatttgaatataaataattactttaaaattgtaatgacacttttacacgtaagtgttttgttctgggctaccgtgtcaacgaggctgctttacaacagctttatttatttttactttcatgcaatttttttacacatcttttggtggagtaaacttcaccacatccatgaataaactctcagttattttgaaatggcaaatttctcattatttaagtttggatctggaaaggacatgacttctgaaatagccgctgctgggttttaaaagctgaggtctctcaaagtgtggaggagacgttgccgtcaggcgggagccaagtgccgggaagatgtctattttttttcttgtgtattgaaatgtaaaatcatgatgtttgttatgactgctgatgcgattgtttttgtaaattttattgtggcatatacagtattgtcatacagttgaagagaaacaatgtttcctaatgtaagtgctctgaaaatgttgacactgtatatatatatatgaggatagtttgttttttttttgttttgggtttttttttttcagattgaaaaattaaaatagatcctactatctacca

SEQ ID NO: 16570 - DNA, 2699 bp, Homo sapiens
  ENST00000492843
gcttccggcagcttcttgctacttaaggacagccgggctgacgctccagctgctgtggccggaggtgcagccccgtcaggacggctccactccctggcgcctcacagactctggggctgcggtgaggtcgccctgaagaccccctggtgaggacgcttgaacccgggctgtcacctgagcacaggctgccactctgagcttttggggcgccctgtgcctgtcgggctgatgctcctctggctcccggccacctggggctgacaccggttctgtgggtcctgatatgttcacctgtcgccactcctgtggccacagctacccatgaagcgctttgggagcctcaggagcaacaagaaacacaaggaccaaaatcgaagcacggagaggcgccagtcggagcctcatggccttttcgcctccggcctctcctcctctccgtcaacacccacccaagtgaccaagcagcacacgtttcccctggaatcctataagcacgagcctgaacggttagagaatcgcatctatgcctcgtcttcccccccggacacagggcagaggttctgcccgtcttccttccagagcccgaccaggcctccactggcatcaccgacacactatgctccctccaaagccgcggcgctggcggcggccctgggacccgcggaagccggcatgctggagaagctggagttcgaggacgaagcagtagaagactcagaaagtggtgtttacatgcgattcatgaggtcacacaagtgttatgacatcgttccaaccagttcaaagcttgttgtctttgatactacattacaagttaaaaaggccttctttgctttggtagccaacggtgtccgagcagcgccactgtgggagagtaaaaaacaaagttttgtaggaatgctaacaattacagatttcataaatatactacatagatactataaatcacctatggtacagatttatgaattagaggaacataaaattgaaacatggagggagctttatttacaagaaacatttaagcctttagtgaatatatctccagatgcaagcctcttcgatgctgtatactccttgatcaaaaataaaatccacagattgcccgttattgaccctatcagtgggaatgcactttatatacttacccacaaaagaatcctcaagttcctccagctttttatgtctgatatgccaaagcctgccttcatgaagcagaacctggatgagcttggaataggaacgtaccacaacattgccttcatacatccagacactcccatcatcaaagccttgaacatatttgtggaaagacgaatatcagctctgcctgttgtggatgagtcaggaaaagttgtagatatttattccaaatttgatgtaattaatcttgctgctgagaaaacatacaataacctagatatcacggtgacccaggcccttcagcaccgttcacagtattttgaaggtgttgtgaagtgcaataagctggaaatactggagaccatcgtggacagaatagtaagagctgaggtccatcggctggtggtggtaaatgaagcagatagtattgtgggtattatttccctgtcggacattctgcaagccctgatcctcacaccagcaggtgccaaacaaaaggagacagaaacggagtgaccgccgtgaatgtagacgccctaggaggagaacttgaacaaagtctctgggtcacgttttgcctcatgaacactggctgcaagtggttaagaatgtatatcagggtttaacaataggtatttcttccagtgatgttgaaattaagcttaaaaaagaaagattttatgtgcttgaagattcaggcttgcattaaaagactgttttcagacctttgtctgaaggattttaaatgctgtatgtcattaaagtgcactgtgtcctgaagttttcattatttttcatttcaaagaattcactggtatggaacaggtgatgtggcataaggtgagtgcacggtatgttcagatcacagtgccttatgtccgaatacagcaatatgtcaccgccgcagccggggcgcacgcgtgtgaaacaacaccgagcttgaatgtggaagtctttgaaccttttaccaaatcagtttgttttctttagatttgtcaaaaagttgtaatttgaatataaataattactttaaaattgtaatgacacttttacacgtaagtgttttgttctgggctaccgtgtcaacgaggctgctttacaacagctttatttatttttactttcatgcaatttttttacacatcttttggtggagtaaacttcaccacatccatgaataaactctcagttattttgaaatggcaaatttctcattatttaagtttggatctggaaaggacatgacttctgaaatagccgctgctgggttttaaaagctgaggtctctcaaagtgtggaggagacgttgccgtcaggcgggagccaagtgccgggaagatgtctattttttttcttgtgtattgaaatgtaaaatcatgatgtttgttatgactgctgatgcgattgtttttgtaaattttattgtggcatatacagtattgtcatacagttgaagagaaacaatgtttcctaatgtaagtgctctgaaaatgttgacactgtatatatatatatgaggatagtttgttttttttttgttttgggttttttttttt

SEQ ID NO: 16571 - DNA, 2281 bp, Homo sapiens
  ENST00000392801
gggaatgacagtttgctgcagtcccgtcaatgggggaatctgcccgagctctgcctgcattttgagcagcaaagcagctccagccaccaagaccgttgcctgcgctgtcttaggccagcccatgctgtctgccagccgcttgttgcgctgccttggggactgggaacacacccagccccggtccccatctgttgcagacatgcagtggcagcagctcggagcacagccgaaccctagaaattgcctgtgctgaaggggctgggaaaccccttctctgatggacctttcgagtgaggcagcaggatttgtcagagctgggagtgccgcccgtccccgtcactcgcatcctgccatccagcagcttacaagcctgcactgcttattagcatctggaagagaagacctccaggaccccttggggctgagacctgagctccttcgccatgccgctcctggacggagacctggagggttccggaaagcattcctctcgaaaggtggacagccccttcggcccgggcagcccctccaaagggttcttctccagaggcccccagccccggccctccagccccatgtctgcacctgtgaggcccaagaccagccccggctctcccaaaaccgtgttcccgttctcctaccaggagtccccgccacgctcccctcgacgcatgagcttcagtgggatcttccgctcctcctccaaagagtcttcccccaactccaaccctgctacctcgcccgggggcatcaggtttttctcccgctccagaaaaacctccggcctctcctcctctccgtcaacacccacccaagtgaccaagcagcacacgtttcccctggaatcctataagcacgagcctgaacggttagagaatcgcatctatgcctcgtcttcccccccggacacagggcagaggttctgcccgtcttccttccagagcccgaccaggcctccactggcatcaccgacacactatgctccctccaaagccgcggcgctggcggcggccctgggacccgcggaagccggcatgctggagaagctggagttcgaggacgaagcagtagaagactcagaaagtggtgtttacatgcgattcatgaggtcacacaagtgttatgacatcgttccaaccagttcaaagcttgttgtctttgatactacattacaagttaaaaaggccttctttgctttggtagccaacggtgtccgagcagcgccactgtgggagagtaaaaaacaaagttttgtaggaatgctaacaattacagatttcataaatatactacatagatactataaatcacctatggtacagatttatgaattagaggaacataaaattgaaacatggagggagctttatttacaagaaacatttaagcctttagtgaatatatctccagatgcaagcctcttcgatgctgtatactccttgatcaaaaataaaatccacagattgcccgttattgaccctatcagtgggaatgcactttatatacttacccacaaaagaatcctcaagttcctccagctttttatgtctgatatgccaaagcctgccttcatgaagcagaacctggatgagcttggaataggaacgtaccacaacattgccttcatacatccagacactcccatcatcaaagccttgaacatatttgtggaaagacgaatatcagctctgcctgttgtggatgagtcaggaaaagttgtagatatttattccaaatttgatgtaattaatcttgctgctgagaaaacatacaataacctagatatcacggtgacccaggcccttcagcaccgttcacagtattttgaaggtgttgtgaagtgcaataagctggaaatactggagaccatcgtggacagaatagtaagagctgaggtccatcggctggtggtggtaaatgaagcagatagtattgtgggtattatttccctgtcggacattctgcaagccctgatcctcacaccagcaggtgccaaacaaaaggagacagaaacggagtgaccgccgtgaatgtagacgccctaggaggagaacttgaacaaagtctctgggtcacgttttgcctcatgaacactggctgcaagtggttaagaatgtatatcagggtttaacaataggtatttcttccagtgatgttgaaattaagcttaaaaaagaaagattttatgtgcttgaagattcaggcttgcattaaaagactgttttcagacctttgtctgaaggattttaaatgctgtatgtcattaaagtgcactgtgtcc

SEQ ID NO: 16572 - DNA, 570 bp, Homo sapiens
  ENST00000479461
agaaatcaggctctcttaagctcactaattttggtcattgaagtgaactgaaatgaaaggatataatttattctcttgcttcattacagaatcttgctgctgagaaaacatacaataacctagatatcacggtgacccaggcccttcagcaccgttcacagtattttgaaggtgttgtgaagtgcaataagctggaaatactggagaccatcgtggacagaatagtaagagctgaggtccatcggctggtggtggtaaatgaagcagatagtattgtgggtattatttccctgtcggacattctgcaagccctgatcctcacaccagcaggtgccaaacaaaaggagacagaaacggagtgaccgccgtgaatgtagacgccctaggaggagaacttgaacaaagtctctgggtcacgttttgcctcatgaacactggctgcaagtggttaagaatgtatatcagggtttaacaataggtatttcttccagtgatgttgaaattaagcttaaaaaagaaagattttatgtgcttgaagattcaggcttgcattaaaagactgttttcaga

SEQ ID NO: 16573 - DNA, 480 bp, Homo sapiens
  ENST00000485183
tagaaatcaggctctcttaagctcactaattttggtcattgaagtgaactgaaatgaaaggatataatttattctcttgcttcattacagaatcttgctgctgagaaaacatacaataacctagatatcacggtgacccaggcccttcagcaccgttcacagtattttgaaggtgttgtgaagtgcaataagctggaaatactggagaccatcgtggacagaatagtaagagctgaggtccatcggctggtggtggtaaatgaagcagatagtattgtgggtattatttccctgtcggacattctgcaagccctgatcctcacaccagcaggtaaaatgctggtttctgacctttgccatcggcgtctaggaagggtgggaggtagaacaggaagtgcagcatttaaaccatcatttctccacccacctacagatcaaggctttgagtatattactttgaaaccattttcgttttctctt

SEQ ID NO: 16574 - DNA, 564 bp, Homo sapiens
  ENST00000478989
aggaatgctaacaattacagatttcataaatatactacatagatactataaatcacctatggtacagatttatgaattagaggaacataaaattgaaacatggagggagctttatttacaagaaacatttaagcctttagtgaatatatctccagatgcaagcctcttcgatgctgtatactccttgatcaaaaataaaatccacagattgcccgttattgaccctatcagtgggaatgcactttatatacttacccacaaaagaatcctcaagttcctccagctttttgtacaccaggaggatggaatcaactataccctttataaaagatgtctgatatgccaaagcctgccttcatgaagcagaacctggatgagcttggaataggaacgtaccacaacattgccttcatacatccagacactcccatcatcaaagccttgaacatatttgtggaaagacgaatatcagctctgcctgttgtggatgagtcaggaaaagttgtagatatttattccaaatttgatgtaattaatcttgctgctgagaaaacatacaataac

SEQ ID NO: 16575 - DNA, 1413 bp, Homo sapiens
  ENST00000488258
gatttgcctacgagggttccgtaggaaaggacgcttgaattcggcgcttcggcggcggcggcggccgcgcgagttccctgctcaccctccctctccgcggaagtccccacgaggtggcttcagggtgtaacagagcgcgcggctccagtccgaaggcagcggccgggggagggaaggaggggaccgaacccccgaggagtttcgcagaatcaacttctggttagagttatgggaagcgcggttatggacaccaagaagaaaaaagatgtttccagccccggcgggagcggcggcaagaaaaatgccagccagaagaggcgttcgctgcgcgtgcacattccggacctgagctccttcgccatgccgctcctggacggagacctggagggttccggaaagcattcctctcgaaaggtggacagccccttcggcccgggcagcccctccaaagggttcttctccagaggcccccagccccggccctccagccccatgtctgcacctgtgaggcccaagaccagccccggctctcccaaaaccgtgttcccgttctcctaccaggagtccccgccacgctcccctcgacgcatgagcttcagtgggatcttccgctcctcctccaaagagtcttcccccaactccaaccctgctacctcgcccgggggcatcaggtttttctcccgctccagaaaaacctccggcctctcctcctctccgtcaacacccacccaagtgaccaagcagcacacgtttcccctggaatcctataagcacgagcctgaacggttagagaatcgcatctatgcctcgtcttcccccccggacacagggcagaggttctgcccgtcttccttccagagcccgaccaggcctccactggcatcaccgacacactatgctccctccaaagcccagtagaagactcagaaagtggtgtttacatgcgattcatgaggtcacacaagtgttatgacatcgttccaaccagttcaaagcttgttgtctttgatactacattacaagttaaaaaggccttctttgctttggtagccaacggtgtccgagcagcgccactgtgggagagtaaaaaacaaagttttgtaggaatgctaacaattacagatttcataaatatactacatagatactataaatcacctatggtacagatttatgaattagaggaacataaaattgaaacatggagggagctttatttacaagaaacatttaagcctttagtgaatatatctccagatgcaagcctcttcgatgctgtatactccttgatcaaaaataaaatccacagattgcccgttattgaccctatcagtgggaatgcactttatatacttacccacaaaagaatcctcaagttcctccagctttttgtaagtagtttttagcgtttct

SEQ ID NO: 16576 - DNA, 1123 bp, Homo sapiens
  ENST00000476632
aggacttcctctttcaggcccggcttgcaagagcgctagggccaagctcctttcagccctaatcggtactggagctaatcgcattcgcggcgcccgtgcactctgcagggatgggccgtggggccagggacctcagtcccctctcggcctgtcctgcccttccaggaggctagcggctgctggccgcgcagcctgccaacctgagttggccatagtagagtctcagatacccagctcctgagcggccagggccagattcagggtgtgtacgtttttggcagcggctccccaaccgagaagacactcggctgcgaagagaggacgcgaattaagagttccatgctggaaaaaaaaaaatggatagcgacaaagtgcatctacaatacgtgtagcccacggaacgatttttgttaagggggccgaggatgggcagttacatctaaaatttggaaagggaagaggaaagcgagaaaggatcccctagctggcgccccggggcgttctgcagcctccagcccctctccccctccccgcgccgcggagcccacacctgcgcaggtggagcctgccgagcgcggccgccggtgctgggaaggcggcgctggcggcggccctgggacccgcggaagccggcatgctggagaagctggagttcgaggacgaagcagtagaagactcagaaagtggtgtttacatgcgattcatgaggtcacacaagtgttatgacatcgttccaaccagttcaaagcttgttgtctttgatactacattacaagttaaaaaggccttctttgctttggtagccaacggtgtccgagcagcgccactgtgggagagtaaaaaacaaagttttgtaggaatgctaacaattacagatttcataaatatactacatagatactataaatcacctatggtacagatttatgaattagaggaacataaaattgaaacatggagggagctttatttacaagaaacatttaagcctttagtgaatatatctccagatgcaagcctcttcgatgctgtatactccttgatcaaaaataaaatccacagattgcccgttattgaccctatcagtgggaatgcactttatatacttacccacaaaagaatc

SEQ ID NO: 16577 - DNA, 573 bp, Homo sapiens
  ENST00000493872
gcagctcatgctgatcgctgtcctcctcctccccctcaggcggcgctggcggcggccctgggacccgcggaagccggcatgctggagaagctggagttcgaggacgaagcaaggtgtcagggagcgctaattgtttgtgcttgtcaccatgcactcggaggcaaccccgaatcatacccacagtccagaccctttaatcatagactggtgcccttatctgcgcctgtgaagatatgaccgcagtagaagactcagaaagtggtgtttacatgcgattcatgaggtcacacaagtgttatgacatcgttccaaccagttcaaagcttgttgtctttgatactacattacaagttaaaaaggccttctttgctttggtagccaacggtgtccgagcagcgccactgtgggagagtaaaaaacaaagttttgtaggaatgctaacaattacagatttcataaatatactacatagatactataaatcacctatggtacagatttatgaattagaggaacataaaattgaaacatggagggagctttatttacaagaaacatttaagcctttagtga

SEQ ID NO: 16578 - DNA, 653 bp, Homo sapiens
  ENST00000491938
gctgatcgctgtcctcctcctccccctcaggcggcgctggcggcggccctgggacccgcggaagccggcatgctggagaagctggagttcgaggacgaagcagtagaagactcagaaagtggtgtttacatgcgattcatgaggtcacacaagtgttatgacatcgttccaaccagttcaaagcttgttgtctttgatactacattacaagttaaaaaggccttctttgctttggtagccaacggtgtccgagcagcgccactgtgggagagtaaaaaacaaagttttgtaggaatgctaacaattacagatttcataaatatactacatagatactataaatcacctatggtacagatttatgaattagaggaacataaaattgaaacatggaggggtaagcactattggatgtttaaaatcttttagtatcgggaaagctatgtttagtatgaaaagtatgttttcattttgcagatccttttctctctgctccataaaatgttatataaaacattctctttatttctgttaattttgatagtatgctactgtactaaagctgaacaatataagtattgtcccttctgtttatagacatgtataggacaccttcagcaggcaaggccttatcctagggccaggaatgtgaa

SEQ ID NO: 16579 - DNA, 539 bp, Homo sapiens
  ENST00000483775
aggccccagcgctcggccggccgcgagcccgccggccggggacgagcgtcgcagctcatgctgatcgctgtcctcctcctccccctcaggcggcgctggcggcggccctgggacccgcggaagccggcatgctggagaagctggagttcgaggacgaagcagtagaagactcagaaagtggtgtttacatgcgattcatgaggtcacacaagtgttatgacatcgttccaaccagttcaaagcttgttgtctttgatactacattacaagttaaaaaggccttctttgctttggtagccaacggtgtccgagcagcgccactgtgggagagtaaaaaacaaagttttgtaggtaagcagtgtgggcctgaggaaaatcgaaaatggaaaccttgaaagcagaaagcctaaagtattttaatagatgccggtttggaattcaacctagtaaacatgtttccaagttaaagaacattcttgctggcagggtgcagtggcccatgcccgtaatctcagcactttgggaggccaaggcaggga

SEQ ID NO: 16580 - DNA, 1670 bp, Homo sapiens
  ENST00000481434
gagctggtttattctgcggccgaggattacatttatgcacgaacgggcttactggttccagattccccacttgggcacaggcataggaggcttgttttccaaattgctggttttaattgcacctgcctttcagattacctctgggaatctgtgggaggagccgagagggtggaaaatgtttcttagctttgcaaaaggaagaaaactttgtcacccagcgggagacctcagccacgagtaacccggggagacaccagaaccgggacgggctttgactgatttgcctacgagggttccgtaggaaaggacgcttgaattcggcgcttcggcggcggcggcggccgcgcgagttccctgctcaccctccctctccgcggaagtccccacgaggtggcttcagggtgtaacagagcgcgcggctccagtccgaaggcagcggccgggggagggaaggaggggaccgaacccccgaggagtttcgcagaatcaacttctggttagagttatgggaagcgcggttatggacaccaagaagaaaaaagatgtttccagccccggcgggagcggcggcaagaaaaatgccagccagaagaggcgttcgctgcgcgtgcacattccggacctgagctccttcgccatgccgctcctggacggagacctggagggttccggaaagcattcctctcgaaaggtggacagccccttcggcccgggcagcccctccaaagggttcttctccagaggcccccagccccggccctccagccccatgtctgcacctgtgaggcccaagaccagccccggctctcccaaaaccgtgttcccgttctcctaccaggagtccccgccacgctcccctcgacgcatgagcttcagtgggatcttccgctcctcctccaaagagtcttcccccaactccaaccctgctacctcgcccgggggcatcaggtttttctcccgctccagaaaaacctccggcctctcctcctctccgtcaacacccacccaagtgaccaagcagcacacgtttcccctggaatcctataagcacgagcctgaacggttagagaatcgcatctatgcctcgtcttcccccccggacacagggcagaggttctgcccgtcttccttccagagcccgaccaggcctccactggcatcaccgacacactatgctccctccaaagccgtaagtctgggcccttctgtgggtggggctgccgggtggcagagggagggcagagcagttattgccccaagctgagcagtctatctgcagccgaggctgaggtcgtgtgctcccgacatcttcaggatattgtaccataaatcacaggctgagggagaaatggtgagggcacaatagcaaatggaaatacacaaaaaatagctgggtgcggtggctcacacctgtagtcccagcactttgggaggccaagataggcagatcacttgaggccaggagttcgagaccagcctggccaacatggcaaaaccctgtctctaccaaaactgcaaaaattagctgggtgtggtggcgtgcacctgtatcccaactactcgggaggctgaggcataagaattgcttaaacctagatggcagacactgcagtgagctgagatcatgacaccgcactccagcccctatgtaacagagcagactctgtctg

SEQ ID NO: 16581 - DNA, 562 bp, Homo sapiens
  ENST00000487375
agaccccctggtgaggacgcttgaacccgggctgtcacctgagcacaggctgccactctgagcttttggggcgccctgtgcctgtcgggctgatgctcctctggctcccggccacctggggctgacaccggttctgtgggtcctgatatgttcacctgtcgccactcctgtggccacagctacccatgaagcgctttgggagcctcaggagcaacaagaaacacaaggaccaaaatcgaagcacggagaggcgccagtcggagcctcatggccttttcgggaggtgactttggcaaaatgtctgaactgtaaatgaaaactggaagagcagaaaaagaaaaagcctccggcctctcctcctctccgtcaacacccacccaagtgaccaagcagcacacgtttcccctggaatcctataagcacgagcctgaacggttagagaatcgcatctatgcctcgtcttcccccccggacacagggcagaggttctgcccgtcttccttccagagcccgaccaggcctccactggcatcaccgacacactatgctccctccaaagccg

SEQ ID NO: 16582 - DNA, 575 bp, Homo sapiens
  ENST00000461529
actggcccagcggcacagactctgcggccccatgcttgctgcaggcgcaagagggtgcttggtcggggagttaattcaaacacatctggaacctgctgcctgccgggtacagtatgaggccaagaatagagaggacctgagctccttcgccatgccgctcctggacggagacctggagggttccggaaagcattcctctcgaaaggtggacagccccttcggcccgggcagcccctccaaagggttcttctccagaggcccccagccccggccctccagccccatgtctgcacctgtgaggcccaagaccagccccggctctcccaaaaccgtgttcccgttctcctaccaggagtccccgccacgctcccctcgacgcatgagcttcagtgggatcttccgctcctcctccaaagagtcttcccccaactccaaccctgctacctcgcccgggggcatcaggtttttctcccgctccagaaaaacctccggcctctcctcctctccgtcaacacccacccaagtgaccaagcagcacacgtttcccctggaatcctataagcacgagcctgaac

SEQ ID NO: 16583 - DNA, 510 bp, Homo sapiens
  ENST00000474383
gcggccgcgcgagttccctgctcaccctccctctccgcggaagtccccacgaggtggcttcagggtgtaacagagcgcgcggctccagtccgaaggcagcggccgggggagggaaggaggggaccgaacccccgaggagtttcgcagaatcaacttctggttagagttatgggaagcgcggttatggacaccaagaagaaaaaagatgtttccagccccggcgggagcggcggcaagaaaaatgccagccagaagaggcgttcgctgcgcgtgcacattccgcactctcaacgccctgcgagcgccgacggttggatggagggagggtcgcccggattcacccccagctgccatccccgtgggccagcactgcctctttctctccctcttcttccaccttatcttcctgtccactttccccctttccctcccccataattgaccccaatgtggaattgagggtcatttcaaaatatttctgatactatttgaagaaaataaactttatct

SEQ ID NO: 16584 - DNA, 2326 bp, Homo sapiens
  ENST00000233944
gccacagtgtcgcacacttgctctcagttggtctggggctggccacatggagcccgggctggagcacgcactgcgcaggaccccttcctggagcagccttgggggttctgagcatcaagagatgagcttcctagagcaagaaaacagcagctcatggccatcaccagctgtgaccagcagctcagaaagaatccgtgggaaacggagggccaaagccttgagatggacaaggcagaagtcggtggaggaaggggagccaccaggtcagggggaaggtccccggtccaggccagctgctgagtccaccgggctggaggccacattccccaagaccacacccttggctcaagctgatcctgccggggtgggcactccaccaacagggtgggactgcctcccctctgactgtacagcctcagctgcaggctccagcacagatgatgtggagctggccacggagttcccagccacagaggcctgggagtgtgagctagaaggcctgctggaagagaggcctgccctgtgcctgtccccgcaggccccatttcccaagctgggctgggatgacgaactgcggaaacccggcgcccagatctacatgcgcttcatgcaggagcacacctgctacgatgccatggcaactagctccaagctagtcatcttcgacaccatgctggagatcaagaaggccttctttgctctggtggccaacggtgtgcgggcagcccctctatgggacagcaagaagcagagctttgtggggatgctgaccatcactgacttcatcctggtgctgcatcgctactacaggtcccccctggtccagatctatgagattgaacaacataagattgagacctggagggagatctacctgcaaggctgcttcaagcctctggtctccatctctcctaatgatagcctgtttgaagctgtctacaccctcatcaagaaccggatccatcgcctgcctgttcttgacccggtgtcaggcaacgtactccacatcctcacacacaaacgcctgctcaagttcctgcacatctttggttccctgctgccccggccctccttcctctaccgcactatccaagatttgggcatcggcacattccgagacttggctgtggtgctggagacagcacccatcctgactgcactggacatctttgtggaccggcgtgtgtctgcactgcctgtggtcaacgaatgtggtcaggtcgtgggcctctattcccgctttgatgtgattcacctggctgcccagcaaacctacaaccacctggacatgagtgtgggagaagccctgaggcagaggacactatgtctggagggagtcctttcctgccagccccacgagagcttgggggaagtgatcgacaggattgctcgggagcaggtacacaggctggtgctagtggacgagacccagcatctcttgggcgtggtctccctctccgacatccttcaggcactggtgctcagccctgctggcatcgatgccctcggggcctgagaagatctgagtcctcaatcccaagccacctgcacacctggaagccaatgaagggaactggagaactcagccttcatcttcccccacccccatttgctggttcagctatgattcaggcttcttcagccctcccaaattgcccttgccctacctgtgctcccagaagccctcgggcatgcccagtgcaccatgggatgatgaaattaaggagaacagctgagtcaagcttggaggtccctgaaccagaggcactaggattaccccagggccatctgtgctccatgcccgcccatccccttgccgcctgactgggtcggatggccccagtgggtttagtcagggcttctggattcctcggtttctgggctacctatggcttcagccttcagctcctgggagtcccagctgttgttcccagcaacgtcgccactgccctcctactctccaggctttgtcatttcaaggctgctgaaatgctgcatttcaggggccaccatggagcagccgttatttatagaactgcctgttggaggtggggagtcctccctccattcttgtccagaaaactccttagctctcgcagtgagccatgttcttagtctccagggatggatggccttgtatatggacccctgagaatgagcaattgagaaaacaaaacaaaaggaacaatccatgaacttagattttattggtttcactcaaaatgctgcagtcatttgacctgaacttgtggcaagagacttgtgctttctaaattcaaagactagaaggaaaatggataaaaatcacaagtgccgtttctcttgc

SEQ ID NO: 16585 - DNA, 2222 bp, Homo sapiens
  ENST00000529249
ctgctcaatgaccatgttcccacatgctccaagccacatcccctcaaaaagggtccctctagcttgtcctcagtgacccaggaggcagctgaggaccaagtacccagattatccggtgcgccccttccctcccagcaacccccagccttcagggctgtagcagctgagcaaatgggggcccctccctctcattgcctgacacccaatcagagagaaaccgatcctggcagggcagggtgcccggggccgggcccagaatagtgcagcccagccacagtgtcgcacacttgctctcagttggtctggggctggccacatggagcccgggctggagcacgcactgcgcaggaccccttcctggagcagccttgggggttctgagcatcaagagatgagcttcctagagcaagaaaacagcagctcatggccatcaccagctgtgaccagcagctcagaaagaatccgtgggaaacggagggccaaagccttgagatggacaaggcagaagtcggtggaggaaggggagccaccaggtcagggggaaggtccccggtccaggccagctgctgagtccaccgggctggaggccacattccccaagaccacacccttggctcaagctgatcctgccggggtgggcactccaccaacagggtgggactgcctcccctctgactgtacagcctcagctgcaggctccagcacagatgatgtggagctggccacggagttcccagccacagaggcctgggagtgtgagctagaaggcctgctggaagagaggcctgccctgtgcctgtccccgcaggccccatttcccaagctgggctgggatgacgaactgcggaaacccggcgcccagatctacatgcgcttcatgcaggagcacacctgctacgatgccatggcaactagctccaagctagtcatcttcgacaccatgctggagatcaagaaggccttctttgctctggtggccaacggtgtgcgggcagcccctctatgggacagcaagaagcagagctttgtggggatgctgaccatcactgacttcatcctggtgctgcatcgctactacaggtcccccctggtccagatctatgagattgaacaacataagattgagacctggagggagatctacctgcaaggctgcttcaagcctctggtctccatctctcctaatgatagcctgtttgaagctgtctacaccctcatcaagaaccggatccatcgcctgcctgttcttgacccggtgtcaggcaacgtactccacatcctcacacacaaacgcctgctcaagttcctgcacatctttggttccctgctgccccggccctccttcctctaccgcactatccaagatttgggcatcggcacattccgagacttggctgtggtgctggagacagcacccatcctgactgcactggacatctttgtggaccggcgtgtgtctgcactgcctgtggtcaacgaatgtggtcaggtcgtgggcctctattcccgctttgatgtgattcacctggctgcccagcaaacctacaaccacctggacatgagtgtgggagaagccctgaggcagaggacactatgtctggagggagtcctttcctgccagccccacgagagcttgggggaagtgatcgacaggattgctcgggagcaggtacacaggctggtgctagtggacgagacccagcatctcttgggcgtggtctccctctccgacatccttcaggcactggtgctcagccctgctggcatcgatgccctcggggcctgagaagatctgagtcctcaatcccaagccacctgcacacctggaagccaatgaagggaactggagaactcagccttcatcttcccccacccccatttgctggttcagctatgattcaggtaggctctgccctgggccatgacaccagcctcttagtcttcctgatttcctggatctcagattgggacaccctgaggatgggagtggccaagctcaaagctgagcagccctgtgaaaactgcaagtgtaaggactcacaggtccccactttgtcccattttcagctgaggtcatggagactgtcctagaagggagggacaaagccccggctaaaagctaaggctgcgatgtgacttcagacactctgggaagatttacttgttccctcacaattcaatttccacctgctggaaatccccttagaaggaagcaagctata

SEQ ID NO: 16586 - DNA, 1199 bp, Homo sapiens
  ENST00000470307
acacttgctctcagttggtctggggctggccacatggagcccgggctggagcacgcactgcgcaggaccccttcctggagcagccttgggggttctgagcatcaagagatgagcttcctagagcaagaaaacagcagctcatggccatcaccagctgtgaccagcagctcagaaagaatccgtgggaaacggagggccaaagccttgagatggacaaggcagaagtcggtggaggaaggggagccaccaggtcagggggaaggtccccggtccaggccagctgctgagtccaccgggctggaggccacattccccaagaccacacccttggctcaagctgatcctgccggggtgggcactccaccaacagggtgggactgcctcccctctgactgtacagcctcagctgcaggctccagcacagatgatgtggagctggccacggagttcccagccacagaggcctgggagtgtgagctagaaggcctgctggaagagaggcctgccctgtgcctgtccccgcaggccccatttcccaagctgggctgggatgacgaactgcggaaacccggcgcccagatctacatgcgcttcatgcaggagcacacctgctacgatgccatggcaactagctccaagctagtcatcttcgacaccatgctggagatcaagaaggccttctttgctctggtggccaacggtgtgcgggcagcccctctatgggacagcaagaagcagagctttgtggggatgctgaccatcactgacttcatcctggtgctgcatcgctactacaggtcccccctgagatctacctgcaaggctgcttcaagcctctggtctccatctctcctaatgatagcctgtttgaagctgtctacaccctcatcaagaaccggatccatcgcctgcctgttcttgacccggtgtcaggcaacgtactccacatcctcacacacaaacgcctgctcaagttcctgcacatctttggttccctgctgccccggccctccttcctctaccgcactatccaagatttgggcatcggcacattccgagacttggctgtggtgctggagacagcacccatcctgactgcactggacatctttgtggaccggcgtgtgtctgcactgcctgtggtcaacgaatgtggtcaggtcgtgggcctctattcccgctttgatgtgattcacctg

SEQ ID NO: 16587 - DNA, 1619 bp, Homo sapiens
  ENST00000490971
acacttgctctcagttggtctggggctggccacatggagcccgggctggagcacgcactgcgcaggaccccttcctggagcagccttgggggttctgagcatcaagagatgagcttcctagagcaagaaaacagcagctcatggccatcaccagctgtgaccagcagctcagaaagaatccgtgggaaacggagggccaaagccttgagatggacaaggcagaagtcggtggaggaaggggagccaccaggtcagggggaaggtccccggtccaggccagctgctgagtccaccgggctggaggccacattccccaagaccacacccttggctcaagctgatcctgccggggtgggcactccaccaacagggtgggactgcctcccctctgactgtacagcctcagctgcaggctccagcacagatgatgtggagctggccacggagttcccagccacagaggcctgggagtgtgagctagaaggcctgctggaagagaggcctgccctgtgcctgtccccgcaggccccatttcccaagctgggctgggatgacgaactgcggaaacccggcgcccagatctacatgcgcttcatgcaggagcacacctgctacgatgccatggcaactagctccaagctagtcatcttcgacaccatgctggagatcaagaaggccttctttgctctggtggccaacggtgtgcgggcagcccctctatgggacagcaagaagcagagctttgtggggatgctgaccatcactgacttcatcctggtgctgcatcgctactacaggtcccccctggtgaggagtgggctgggaatcttatgggcacccagaggggcgggggcggaggggagtcctcctggagcctggtgccctagaagcccacgtctttctgacttctggagtcctgtcgatgtctctaggtccagatctatgagattgaacaacataagattgagacctggagggagatctacctgcaaggctgcttcaagcctctggtctccatctctcctaatgatagcctgtttgaagctgtctacaccctcatcaagaaccggatccatcgcctgcctgttcttgacccggtgtcaggcaacgtactccacatcctcacacacaaacgcctgctcaagttcctgcacatctttggttccctgctgccccggccctccttcctctaccgcactatccaagatttgggcatcggcacattccgagacttggctgtggtgctggagacagcacccatcctgactgcactggacatctttgtggaccggcgtgtgtctgcactgcctgtggtcaacgaatgtggtacccacccccaggatgagaggctcgggctgggctggggcctgggagaacctggtggggagaatatgggaagggcagggtttctcatgccatccctgtggggggtacaggatggactggggattagaagtctccgtctactctgagacttgggcaagttgcttagcctctctgtgcctcagtttcctcctttgtgaaatgggattcttcacaacactcatctttctgacttcacaggaggatttaaaaggttatgtgcatgaaaatgggcatagcgagaggaagcagcagat

SEQ ID NO: 16588 - DNA, 331 bp, Homo sapiens
  ENST00000430489
acttgctctcagttggtctggggctggccacatggagcccgggctggagcacgcactgcgcaggaccccttcctggagcagccttgggggttctgagcatcaagagatgagcttcctagagcaagaaaacagcagctcatggccatcaccagctgtgaccagcagctcagaaagaatccgtgggaaacggagggccaaagccttgagatggacaaggcagaagtcggtggaggaaggggagccaccaggtccccggtccaggccagctgctgagtccaccgggctggaggccacattccccaagaccacacccttggctcaagctgatcct

SEQ ID NO: 16589 - DNA, 2301 bp, Homo sapiens
  ENST00000439262
agttggtctggggctggccacatggagcccgggctggagcacgcactgcgcaggaccccttcctggagcagccttgggggttctgagcatcaagagatgagcttcctagagcaagaaaacagcagctcatggccatcaccagctgtgaccagcagctcagaaagaatccgtgggaaacggagggccaaagccttgagatggacaaggcagaagtcggtggaggaaggggagccaccaggtcagggggaaggtccccggtccaggccagctgctgagtccaccgggctggaggccacattccccaagaccacacccttggctcaagctgatcctgccggggtgggcactccaccaacagggtgggactgcctcccctctgactgtacagcctcagctgcaggctccagcacagatgatgtggagctggccacggagttcccagccacagaggcctgggagtgtgagctagaaggcctgctggaagagaggcctgccctgtgcctgtccccgcaggccccatttcccaagctgggctgggatgacgaactgcggaaacccggcgcccagatctacatgcgcttcatgcaggagcacacctgctacgatgccatggcaactagctccaagctagtcatcttcgacaccatgctggagatcaagaaggccttctttgctctggtggccaacggtgtgcgggcagcccctctatgggacagcaagaagcagagctttgtggggatgctgaccatcactgacttcatcctggtgctgcatcgctactacaggtcccccctggtccagatctatgagattgaacaacataagattgagacctggagggagatctacctgcaaggctgcttcaagcctctggtctccatctctcctaatgatagcctgtttgaagctgtctacaccctcatcaagaaccggatccatcgcctgcctgttcttgacccggtgtcaggcaacgtactccacatcctcacacacaaacgcctgctcaagttcctgcacatctttggttccctgctgccccggccctccttcctctaccgcactatccaagatttgggcatcggcacattccgagacttggctgtggtgctggagacagcacccatcctgactgcactggacatctttgtggaccggcgtgtgtctgcactgcctgtggtcaacgaatgtggtcaggtcgtgggcctctattcccgctttgatgtgattcacctggctgcccagcaaacctacaaccacctggacatgagtgtgggagaagccctgaggcagaggacactatgtctggagggagtcctttcctgccagccccacgagagcttgggggaagtgatcgacaggattgctcgggagcaggtacacaggctggtgctagtggacgagacccagcatctcttgggcgtggtctccctctccgacatccttcaggcactggtgctcagccctgctggcatcgatgccctcggggcctgagaagatctgagtcctcaatcccaagccacctgcacacctggaagccaatgaagggaactggagaactcagccttcatcttcccccacccccatttgctggttcagctatgattcaggcttcttcagccctcccaaattgcccttgccctacctgtgctcccagaagccctcgggcatgcccagtgcaccatgggatgatgaaattaaggagaacagctgagtcaagcttggaggtccctgaaccagaggcactaggattaccccagggccatctgtgctccatgcccgcccatccccttgccgcctgactgggtcggatggccccagtgggtttagtcagggcttctggattcctcggtttctgggctacctatggcttcagccttcagctcctgggagtcccagctgttgttcccagcaacgtcgccactgccctcctactctccaggctttgtcatttcaaggctgctgaaatgctgcatttcaggggccaccatggagcagccgttatttatagaactgcctgttggaggtggggagtcctccctccattcttgtccagaaaactccttagctctcgcagtgagccatgttcttagtctccagggatggatggccttgtatatggacccctgagaatgagcaattgagaaaacaaaacaaaaggaacaatccatgaacttagattttattggtttcactcaaaatgctgcagtcatttgacctgaacttgtggcaagagacttgtgctttctaaattcaaagactagaaggaaaatggataaaaatcacaagtgccgtttctcttgc

SEQ ID NO: 16590 - DNA, 2689 bp, Homo sapiens
  ENST00000321728
gggcgagtgacagccccggctccgcgcgccgcggccgccagagccggcgcaggggaagcgcccgcggccccgggtgcagcagcggccgccgcctcccgcgcctccccggcccgcagcccgcggtcccgcggccccggggccggcacctctcgggctccggctccccgcgcgcaagatggctgacccggctgcggggccgccgccgagcgagggcgaggagagcaccgtgcgcttcgcccgcaaaggcgccctccggcagaagaacgtgcatgaggtcaagaaccacaaattcaccgcccgcttcttcaagcagcccaccttctgcagccactgcaccgacttcatctggggcttcgggaagcagggattccagtgccaagtttgctgctttgtggtgcacaagcggtgccatgaatttgtcacattctcctgccctggcgctgacaagggtccagcctccgatgacccccgcagcaaacacaagtttaagatccacacgtactccagccccacgttttgtgaccactgtgggtcactgctgtatggactcatccaccaggggatgaaatgtgacacctgcatgatgaatgtgcacaagcgctgcgtgatgaatgttcccagcctgtgtggcacggaccacacggagcgccgcggccgcatctacatccaggcccacatcgacagggacgtcctcattgtcctcgtaagagatgctaaaaaccttgtacctatggaccccaatggcctgtcagatccctacgtaaaactgaaactgattcccgatcccaaaagtgagagcaaacagaagaccaaaaccatcaaatgctccctcaaccctgagtggaatgagacatttagatttcagctgaaagaatcggacaaagacagaagactgtcagtagagatttgggattgggatttgaccagcaggaatgacttcatgggatctttgtcctttgggatttctgaacttcagaaagccagtgttgatggctggtttaagttactgagccaggaggaaggcgagtacttcaatgtgcctgtgccaccagaaggaagtgaggccaatgaagaactgcggcagaaatttgagagggccaagatcagtcagggaaccaaggtcccggaagaaaagacgaccaacactgtctccaaatttgacaacaatggcaacagagaccggatgaaactgaccgattttaacttcctaatggtgctggggaaaggcagctttggcaaggtcatgctttcagaacgaaaaggcacagatgagctctatgctgtgaagatcctgaagaaggacgttgtgatccaagatgatgacgtggagtgcactatggtggagaagcgggtgttggccctgcctgggaagccgcccttcctgacccagctccactcctgcttccagaccatggaccgcctgtactttgtgatggagtacgtgaatgggggcgacctcatgtatcacatccagcaagtcggccggttcaaggagccccatgctgtattttacgctgcagaaattgccatcggtctgttcttcttacagagtaagggcatcatttaccgtgacctaaaacttgacaacgtgatgctcgattctgagggacacatcaagattgccgattttggcatgtgtaaggaaaacatctgggatggggtgacaaccaagacattctgtggcactccagactacatcgcccccgagataattgcttatcagccctatgggaagtccgtggattggtgggcatttggagtcctgctgtatgaaatgttggctgggcaggcaccctttgaaggggaggatgaagatgaactcttccaatccatcatggaacacaacgtagcctatcccaagtctatgtccaaggaagctgtggccatctgcaaagggctgatgaccaaacacccaggcaaacgtctgggttgtggacctgaaggcgaacgtgatatcaaagagcatgcatttttccggtatattgattgggagaaacttgaacgcaaagagatccagcccccttataagccaaaagctagagacaagagagacacctccaacttcgacaaagagttcaccagacagcctgtggaactgacccccactgataaactcttcatcatgaacttggaccaaaatgaatttgctggcttctcttatactaacccagagtttgtcattaatgtgtaggtgaatgcaaactccatcgttgagcctggggtgtaagacttcaagccaagcgtatgtatcaattctagtcttccaggattcacggtgcacatgctggcattcaacatgtggaaagcttgtcttagagggcttttctttgtatgtgtagcttgctagtttgttttctacatttgaaaatgtttagtttagaataagcgcattatccaattatagaggtacaattttccaaacttccagaaactcatcaaatgaacagacaatgtcaaaactactgtgtctgataccaaaatgcttcagtatttgtaatttttcaagtcagaagctgatgttcctggtaaaagtttttacagttattctataatatcttctttgaatgctaagcatgagcgatatttttaaaaattgtgagtaagctttgcagttactgtgaactattgtctcttggaggaagttttttgtttaagaattgatatgattaaactgaattaatatatgcaa

SEQ ID NO: 16591 - DNA, 7969 bp, Homo sapiens
  ENST00000303531
gcgcgccgcggccgccagagccggcgcaggggaagcgcccgcggccccgggtgcagcagcggccgccgcctcccgcgcctccccggcccgcagcccgcggtcccgcggccccggggccggcacctctcgggctccggctccccgcgcgcaagatggctgacccggctgcggggccgccgccgagcgagggcgaggagagcaccgtgcgcttcgcccgcaaaggcgccctccggcagaagaacgtgcatgaggtcaagaaccacaaattcaccgcccgcttcttcaagcagcccaccttctgcagccactgcaccgacttcatctggggcttcgggaagcagggattccagtgccaagtttgctgctttgtggtgcacaagcggtgccatgaatttgtcacattctcctgccctggcgctgacaagggtccagcctccgatgacccccgcagcaaacacaagtttaagatccacacgtactccagccccacgttttgtgaccactgtgggtcactgctgtatggactcatccaccaggggatgaaatgtgacacctgcatgatgaatgtgcacaagcgctgcgtgatgaatgttcccagcctgtgtggcacggaccacacggagcgccgcggccgcatctacatccaggcccacatcgacagggacgtcctcattgtcctcgtaagagatgctaaaaaccttgtacctatggaccccaatggcctgtcagatccctacgtaaaactgaaactgattcccgatcccaaaagtgagagcaaacagaagaccaaaaccatcaaatgctccctcaaccctgagtggaatgagacatttagatttcagctgaaagaatcggacaaagacagaagactgtcagtagagatttgggattgggatttgaccagcaggaatgacttcatgggatctttgtcctttgggatttctgaacttcagaaagccagtgttgatggctggtttaagttactgagccaggaggaaggcgagtacttcaatgtgcctgtgccaccagaaggaagtgaggccaatgaagaactgcggcagaaatttgagagggccaagatcagtcagggaaccaaggtcccggaagaaaagacgaccaacactgtctccaaatttgacaacaatggcaacagagaccggatgaaactgaccgattttaacttcctaatggtgctggggaaaggcagctttggcaaggtcatgctttcagaacgaaaaggcacagatgagctctatgctgtgaagatcctgaagaaggacgttgtgatccaagatgatgacgtggagtgcactatggtggagaagcgggtgttggccctgcctgggaagccgcccttcctgacccagctccactcctgcttccagaccatggaccgcctgtactttgtgatggagtacgtgaatgggggcgacctcatgtatcacatccagcaagtcggccggttcaaggagccccatgctgtattttacgctgcagaaattgccatcggtctgttcttcttacagagtaagggcatcatttaccgtgacctaaaacttgacaacgtgatgctcgattctgagggacacatcaagattgccgattttggcatgtgtaaggaaaacatctgggatggggtgacaaccaagacattctgtggcactccagactacatcgcccccgagataattgcttatcagccctatgggaagtccgtggattggtgggcatttggagtcctgctgtatgaaatgttggctgggcaggcaccctttgaaggggaggatgaagatgaactcttccaatccatcatggaacacaacgtagcctatcccaagtctatgtccaaggaagctgtggccatctgcaaagggctgatgaccaaacacccaggcaaacgtctgggttgtggacctgaaggcgaacgtgatatcaaagagcatgcatttttccggtatattgattgggagaaacttgaacgcaaagagatccagcccccttataagccaaaagcttgtgggcgaaatgctgaaaacttcgaccgatttttcacccgccatccaccagtcctaacacctcccgaccaggaagtcatcaggaatattgaccaatcagaattcgaaggattttcctttgttaactctgaatttttaaaacccgaagtcaagagctaagtagatgtgtagatctccgtccttcatttctgtcattcaagctcaacggctattgtggtgacatttttatgtttttcattgccaagttgcatccatgtttgattttctgatgagactagagtgacagtgtttcagaacccaaatgtcctcaggtagtttggagcatctctatgagatgggattatgcagatggcctatggaaaatgcagctgcataattaacacattatcaaagtcctcttacaatttattttccgcagcatgtcagctaagtagacccaatggggagagaaaatgcctgctttctttccctctttttctgcactgccatattcacccccaaccatccaatctgtggataattggatgttagcggtactcttccacttccgggcctggagcttggcttgtatccaagtgtatggttgctttgcctaagaggaatccctctatttcacctgttctggaggcaccagaccttgaaaagaacatgctcaaaataaaatgttatctgttatttttgtaaactcaaagttaagatgatcaaagttctaaaattccaagaatgtgcttttagacggtctcaatctaaaagcacttcaaggggtcaaagggcaaccagcttgggtgctacctcagtgttgtagtttctgatactttatgtctttgctcaccctcatccccaaactacttgaaaagggcatttggcaccactctctgaaacaacacagtcactctagcaaggcccccaaagggccctggttttacattacatttcaaactttatttgctttggggttttgtttctgttgttgttcaaatgcaaaaaaaagaaaaaaaaagaaaaaaaaaggtgactcacattgttacacatgctttaaaatatgtattcaaatgttattaaccacaatgacgacctgctttgatttaaccaagaagacggctgcggagcctagcagactcaggcctgtgggaatgggatttgttacaaatctaggtttgttactggcttcagaaagctaattaagtgctctgaaaaagacaccgtttcttgaaacaaagatggttgtattcctcactttgatgttgttttgcaagatgtttgtggaaatgttcatttgtatctggatctctgttatgtgccatttttcttctagcatcgagatacaataaaaaaaaaaaaaaagaaaagaagaagaaatactatttcaaggaaaactgctctttttgagaaacgtggacctaaactacaaagtgggaactgaggagggaactcaggagaaaggaactaactgcggagctttaatcttggccccagtgttcagccactcggaggggcgggggctgtggcccattcaggggctgctggtgggctgtagtggggtgggatgacctggccagagccaacgaggatactggagcccaaagtcaagtttagagaccagctgggaacgtgaatggggctcttgattttcttatcaaaatcaccactcctcccagcttggactaaatattctttctagcaagcagctttgtgagctccctgaagcccaaggaaacccttcggtgggagaaatttcatttctgtctgagaggattaaggcagcaggtgactccccctcctcgcctgccgtgtcctgctattctcaggcagctctaaggagaattcttatcacagttcaagtgatttccagaagttccagggcttctgagagaccatcaagggaactttaacaacttgacaaatgtccttgaagtaagatgcctcatctttagggaaaaatggggtttggatttctgcttaggcaaagtctcctgcagttcatccttctctgtcctcttcttgcttcaggcttggggaccgtccctgctgtccccactgtggtggcaatcaggacctaaggtgaagcaaacttgaagttctatctgacaagtttaggcagtaagagaaggagggaaatcggagcaaagctccctcactttattgttgagaaactggcatctggaaagaggaaggaatttgcccaaagtcagtcagctgggataaaaacctgggtgtcctgtccagaaagtgcagggtgctttctgctctgtagcaaggcagcagacatctctgagccaggcccaccaacaggcccttatctggtggttggatcatgatcccattttgcttggacatgctctcaggaagataaaaaccatggagaaacactaggccattgacaaatgatctgagacaactttagaaaacaatgtaggatgaatggaaagagaaagaaaggaaagaaagaagaaaaagaaagaaggaaagaaagaaagagaaaggaaggaaggaaagaaggaaggaaaagaaggaaggaaggaaggaatatagtgttataaatactgcactcaacattttccaaattcttgccattatttttcaaaagtttaatagtttgcagaaatagatactcaagccaaagtctgttttagagaaactttccatggaaagtcagaatttctaccacttccttttctatccacatttccagtgcagaagaaactgagaaacagagctttttgaagagaggacagggccatagcaacaaggaccttcttgggggattaatgggaggtcagtagaattaataaccctccttggatgagtgctactgttttcacatggcttcagatgctatcaacctcaaagaaatgatctcaacagagaagcttattctctcccaacttctacggtaaaatccaggagtattttctctggggatctgcccacaggacaaagtccataaaagcaagtcctgtctggaccatgtggttatctgaagcattagccatcaccagcacaacaaacggggcagggctttccaaggtggggctggtcagaagggaatctttgataagaggcccacaggcagggaaagcgaaatagggttgatgagaccaggggagacctaaaaaaaaggcagctttgtgtcttctagctccaaatatacctgccttttagctcacacactgtcctggagttctcagacctttaggggccctaacacagttcagttcatacaggggttcaaaagggacagtggcccatttgggagacctttaggatcaatgggaatcaattccattgttttgcctcagagtaaagtttctggctcggggacaattataagttgcaaaaaggatagaggcatatcccaagtcttccttcattccacaaataattacaaacaacctactgtgtgccaggcactattcttagcactggaaatacactagtgaagaagcagatgaggaccctgtttattgtttctctccaagaaattctccaagaatattgtttcttggagagaaataataaataaacaagacaatttctgaaagcaataagtgcaatcaagataattaaaggatgctaaagtgtgacttgtggggattgggagagagatgcacagacaatattaaagaggaggcattcgagctttgttgtgaacaccggaagtaacatgccgagcgcctgggggatggaaactcctatagcaccccacaggctaacagcaagcaggacaagacaaaaagggcaggtgggacatggtagagatggaccctacccaggaaacagctccatcagcatcttagcctgccccactctagccacacatacccacgtgtgctcctgagttcagtgtgcccacctcactcccacaccctcacatagacttggcaagagtaaggagggaactccatagagacattttacctatctcaggggagcagccacaaagaagcaagtcttgtaaaaggtcttttgcaaaggagagtgaacccagcaatgagagatccttaacagctagtgcccattagggggctaaacctaaagcctgggtggtgatggctcaaacgctaatgagtcagtgaatccttaccgaccccctggcctttataatctgaggcaactttggctgcagcccgggaatgtgcagggcactagggaatacaaggccttcttccctggttgtcttgtaataaaacagccatggggttgtccctccagtccgagagactgtgatgaggcctacatagcagcgatgtggtcaggtaaaaatcaggaacccactgaaatcttgggcaagccaccctgcctgcttgtgcctcggttctctcatatgtcatatataggaggtgaggactccagctccacctgccccaggtgggtgtggtgatgatgaggaaagacaagaggcttgcaaggaccctgaagaggtcggagcatcatacagattcctttattagcccacattctgatgttccctggtgagacttgccccaagcaattgctagtaaatgggggttaatttcttctccacctccctactgaacaaaaaaagaaatgccagacttactaggagaatcgagttgctttgagtttcttttgttttgttttgttttgttttgttttaaggctccccttacacaccctcctttaagctttgggttttctctcttatagtttgttgacacatgctaaaaatgtctttggagagaacttctgcctgataaacacccaattctagactgtgggtggattttcgagctgacggtggtcaattcctttcattaagcagtgatctgatttctccacatggccattctgccttcttgggggcagagtagatgggcagcagttcaccttttcagagaaagaggtcttctagccacctgggctgctactgaatggttttctccaggacgctctacctaatgattatttctataacattaagcatggtaataagtagcttccaattcaattcatcctaaagccaaagaaaatacagcaacacacacacacacacacacacacacacacacacacacacacacacaccactttatggcaattcttaactgacattcaatgacttacttcttttcttagaaaatttccaccacatttctatccccaagccaacatacaatgtgaaatgaaagccagtgcgtggagtgcagctgctaaaaattttcagcacagggctctttctgactctgctcatgagatggtatcagccacccaatgactggcgtatcttggtcctgtgtctttcttcttacgctgtgttaatgtgtttactttccatttggcagagagacaagagagacacctccaacttcgacaaagagttcaccagacagcctgtggaactgacccccactgataaactcttcatcatgaacttggaccaaaatgaatttgctggcttctcttatactaacccagagtttgtcattaatgtgtaggtgaatgcaaactccatcgttgagcctggggtgtaagacttcaagccaagcgtatgtatcaattctagtcttccaggattcacggtgcacatgctggcattcaacatgtggaaagcttgtcttagagggcttttctttgtatgtgtagcttgctagtttgttttctacatttgaaaatgtttagtttagaataagcgcattatccaattatagaggtacaattttccaaacttccagaaactcatcaaatgaacagacaatgtcaaaactactgtgtctgataccaaaatgcttcagtatttgtaatttttcaagtcagaagctgatgttcctggtaaaagtttttacagttattctataatatcttctttgaatgctaagcatgagcgatatttttaaaaattgtgagtaagctttgcagttactgtgaactattgtctcttggaggaagttttttgtttaagaattgatatgattaaactgaattaatatatgcaa

SEQ ID NO: 16592 - DNA, 480 bp, Homo sapiens
  ENST00000498058
gcggccgccgcctcccgcgcctccccggcccgcagcccgcggtcccgcggccccggggccggcacctctcgggctccggctccccgcgcgcaagatggctgacccggctgcggggccgccgccgagcgagggcgaggagagcaccgtgcgcttcgcccgcaaaggcgccctccggcagaagaacgtgcatgaggtcaagaaccacaaattcaccgcccgcttcttcaagcagcccaccttctgcagccactgcaccgacttcatctgaagggacacactttccttcccactgatgtggagcattggccaatggaacgtgagcagacacaatctactctacatttaaacagaggctttgagaagctattgtgtggtttagccattgttcttcccacctctgccacaagaccaagaaagggctgttgcctcagctgcgtcctgggatggaaaagacacaggaagtagaatcacagagccaca

SEQ ID NO: 16593 - DNA, 569 bp, Homo sapiens
  ENST00000498739
acaaaggcggaagactcttgggcacccgcctgtggctgggagtttgcacctggggtacagaggcagggaggaaggcgggtgactctgtgggtaactagctggaggctgggccccccgggctgcctgacatacacctccttctgcttttgcaggggcttcgggaagcagggattccagtgccaagtaagagatgctaaaaaccttgtacctatggaccccaatggcctgtcagatccctacgtaaaactgaaactgattcccgatcccaaaagtgagagcaaacagaagaccaaaaccatcaaatgctccctcaaccctgagtggaatgagacatttagatttcagctgaaagaatcggacaaagacagaagactgtcagtagagatttgggattgggatttgaccagcaggaatgacttcatgggatctttgtcctttgggatttctgaacttcagaaagccagtgttgatggctggtttaagttactgagccaggaggaaggcgagtacttcaatgtgcctgtgccaccagaaggaagtgaggccaatgaagaactgcggcagaaatt

SEQ ID NO: 16594 - DNA, 467 bp, Homo sapiens
  ENST00000486868
ctgggcacagggctccagcgatggtcccaacaggtacaatgacctctggggaccaagttcagttcttggtgagttctccagtgcctctcgatgtaggatgaaccgttggcatgctccactgacgctggctccttctgttgtttctcttggctccaggacccccgcagcaaacacaagtttaagatccacacgtactccagccccacgttttgtgaccactgtgggtcactgctgtatggactcatccaccaggggatgaaatgtgacacctgcatgatgaatgtgcacaagcgctgcgtgatgaatgttcccagcctgtgtggcacggaccacacggagcgccgcggccgcatctacatccaggcccacatcgacagggacgtcctcattgtcctcgtaagagatgctaaaaaccttgtacctatggaccccaatggcctgtcagatccctacgtaaaactgaaact

SEQ ID NO: 16595 - DNA, 541 bp, Homo sapiens
  ENST00000482000
gtaagagatgctaaaaaccttgtacctatggaccccaatggcctgtcagatccctacgtaaaactgaaactgattcccgatcccaaaagtgagagcaaacagaagaccaaaaccatcaaatgctccctcaaccctgagtggaatgagacatttagatttcagctgaaagaatcggacaaagacagaagactgtcagtagagatttgggattgggatttgaccagcaggaatgacttcatgggatctttgtcctttgggatttctgaacttcagaaagccagtgttgatggctggaatccctggaagtccctgctgtgtggatagcacccttctcgatttccagcaaagatacagatgctctcttgtttttatatttcttttggtaatttccgtggaattttggaagaaaatttggaatattaaatgtggaggcgtagaggctcaaattgtcttctctgctttgaatcacctagcccatttttggaagctgcgtaagaagattcgtgaatggagagaaaacattgtgatgaaaattttaaac

SEQ ID NO: 16596 - DNA, 556 bp, Homo sapiens
  ENST00000472066
ttcaaaggaaaagaaagaacaggatgtggtcatggaattgtttggctttcaagagccactgaagggctttcagcattcaagtggcacagtcagagctgcattttcagaacagtcattagctgaagcaagttaatctccctgagcctcagtgtgtttatctacgaaatgggggtcatgctttcagaacgaaaaggcacagatgagctctatgctgtgaagatcctgaagaaggacgttgtgatccaagatgatgacgtggagtgcactatggtggagaagcgggtgttggccctgcctgggaagccgcccttcctgacccagctccactcctgcttccagaccatggaccgcctgtactttgtgatggagtacgtgaatgggggcgacctcatgtatcacatccagcaagtcggccggttcaaggagccccatgctgtattttacgctgcagaaattgccatcggtctgttcttcttacagagtaagggcatcatttaccgtgacctaaaacttgacaacgtgatgctcgattctgagggacacatcaagattgccg

SEQ ID NO: 16597 - DNA, 599 bp, Homo sapiens
  ENST00000463752
gttttcatcataaattccagctcttcccccactgtccatttggagccccagaagctacgggatgctaatgttgctgtttgctgtcctcttccaggaccgcctgtactttgtgatggagtacgtgaatgggggcgacctcatgtatcacatccagcaagtcggccggttcaaggagccccatgctgtattttacgctgcagaaattgccatcggtctgttcttcttacagagtaagggcatcatttaccggtaagtgaacactgctgtactttccatctcttcatctccctcagctcctccctgccctgcctctttcttcagctgcttttaaaattagaatccgcggtgggggaggaatcctccagaactaacttgggcatgtgttctgccaggcagcatcgcccactgccctggcaaagtttgggcagctctatatggtggtagaaaatctcggtggactgtgtcaccaatgatggttcagagcctcaaacaggagactgtttgctctaagaggagactcacagagaggacctcagtacttctttctcttgcttgtggaccctacatttgaggagcaggcaaagaattttggctggcag

SEQ ID NO: 16598 - DNA, 693 bp, Homo sapiens
  ENST00000487674
tgttgcccagctagtgaaactataatccttcatccagttcatcatatcccatgtccccttctccactatacaattgctgaacttctgcctacccccagtttgtccttaaggcaaccccatcaccctctaaaccaccctttgaatccatctgtactttcagcactttatgagctatatagctgaccatccatgggttctttaatgtcctacacctagttcaatattgtattgaattctgagcattgccaagcatatggtgtccttgagtttctccatcgctttttttttttttttaatttcagattttacgctgcagaaattgccatcggtctgttcttcttacagagtaagggcatcatttaccgtgacctaaaacttgacaacgtgatgctcgattctgagggacacatcaagattgccgattttggcatgtgtaaggaaaacatctgggatggggtgacaaccaagacattctgtggcactccagactacatcgcccccgagataattgcttatcagccctatgggaagtccgtggattggtgggcatttggagtcctgctgtatgaaatgttggctgggcaggcaccctttgaaggggaggatgaagatgaactcttccaatccatcatggaacacaacgtagcctatcccaagtctatgtccaaggaagctgtggccatctgcaaaggg

SEQ ID NO: 16599 - DNA, 536 bp, Homo sapiens
  ENST00000466124
gtctatgtccaaggaagctgtggccatctgcaaagggctgatgaccaaacacccaggcaaacgtctgggttgtggacctgaaggcgaacgtgatatcaaagagcatgcatttttccggtatattgattgggagaaacttgaacgcaaagagatccagcccccttataagccaaaagctgtaagtagcccattctctctgactgccgggtattcacacacaaggtattcttgcctgtgcctcatgttttccaaatgctccctgaggggtagacgtcaatgtgtctactggaacatgggtgtatgtattcacacatatgcacaaaatcactggttactaagatggacattttccattggcccagcttagtctctataaagatggaaacgacgatgcctattgaatttttgtttcttcgattcaattattgtaactgtcttagctgacaactttctgagaatggttcttgggtgagcagagttcagatccatttttggactgtgataaaggatctaattttgccctcattctttctctt

SEQ ID NO: 16600 - DNA, 589 bp, Homo sapiens
  ENST00000478843
aaggattagggagtcctgagccccaggctgctctgctcagtcttggaaggcctcacgcaacccccttcacaaagcctgcccgattgtgtcctcaagggacaatttatagcatgcaatgacagtgcggagggcaggtctgtctggggagatgaaacgacctgtgcgattacaggagattcctactttcctcgcccccagtcctcaaggtcttctcagaggttcccactaggaggccggctgcagtgccctggacgaccctcacacccaggacctcagttgctccatccaaggaatgggcgagctcaggtcttcctgactttcctggagaacaaagaggccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcaga

SEQ ID NO: 16601 - DNA, 2810 bp, Homo sapiens
  ENST00000394729
ggcctggcagggcgaggcctggcgggggcggggcctggcgggggcggggccggcggcacctgggtgaggtcgctcggccccgccccctcgcacttccgtgtgccgcggcgccggagcccgaggcggctgtagcccacatctcccgagcgacccccggcgcccgcccgccgcgcggaggcccgggccacacctcactggccgcttggcccatcccagtcagcgccgcgccgaaccccgtccgcgcgcgccggggagcggcgcccccgccgctgccgccgcgacccttggcgcctgcccctgcaacgggagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtggattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggggcctcaacaagcaaggctacaaatgcaggcaatgtaacgctgccatccacaagaaatgcatcgacaagatcatcggcagatgcactggcaccgcggccaacagccgggacactatattccagaaagaacgcttcaacatcgacatgccgcaccgcttcaaggttcacaactacatgagccccaccttctgtgaccactgcggcagcctgctctggggactggtgaagcagggattaaagtgtgaagactgcggcatgaatgtgcaccataaatgccgggagaaggtggccaacctctgcggcatcaaccagaagcttttggctgaggccttgaaccaagtcacccagagagcctcccggagatcagactcagcctcctcagagcctgttgggatatatcagggtttcgagaagaagaccggagttgctggggaggacatgcaagacaacagtgggacctacggcaagatctgggagggcagcagcaagtgcaacatcaacaacttcatcttccacaaggtcctgggcaaaggcagcttcgggaaggtgctgcttggagagctgaagggcagaggagagtactttgccatcaaggccctcaagaaggatgtggtcctgatcgacgacgacgtggagtgcaccatggttgagaagcgggtgctgacacttgccgcagagaatccctttctcacccacctcatctgcaccttccagaccaaggaccacctgttctttgtgatggagttcctcaacgggggggacctgatgtaccacatccaggacaaaggccgctttgaactctaccgtgccacgttttatgccgctgagataatgtgtggactgcagtttctacacagcaagggcatcatttacagggacctcaaactggacaatgtgctgctggaccgggatggccacatcaagattgccgactttgggatgtgcaaagagaacatattcggggagagccgggccagcaccttctgcggcacccctgactatatcgcccctgagatcctacagggcctgaagtacacattctctgtggactggtggtctttcggggtccttctgtacgagatgctcattggccagtcccccttccatggtgatgatgaggatgaactcttcgagtccatccgtgtggacacgccacattatccccgctggatcaccaaggagtccaaggacatcctggagaagctctttgaaagggaaccaaccaagaggctgggagtgaccggaaacatcaaaatccaccccttcttcaagaccataaactggactctgctggaaaagcggaggttggagccacctttcaggcccaaagtgaagtcacccagagactacagtaactttgaccaggagttcctgaacgagaaggcgcgcctctcctacagcgacaagaacctcatcgactccatggaccagtctgcattcgctggcttctcctttgtgaaccccaaattcgagcacctcctggaagattgaggttcctggacagatcaggctagccctgccctccacccacacctgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataataggctgtatatattgctcagtagagaaaaaccatgggggactggtgatatgttgatctttttcaaaaaaatatatatatgacaaaaaaaaaaaaaaaggagcacaagctgtttgaaccaccaggtttatttgtgtgtctaaataaacaccaaatagtaccaa

SEQ ID NO: 16602 - DNA, 2680 bp, Homo sapiens
  ENST00000330452
ccgccccctcgcacttccgtgtgccgcggcgccggagcccgaggcggctgtagcccacatctcccgagcgacccccggcgcccgcccgccgcgcggaggcccgggccacacctcactggccgcttggcccatcccagtcagcgccgcgccgaaccccgtccgcgcgcgccggggagcggcgcccccgccgctgccgccgcgacccttggcgcctgcccctgcaacgggaggtctgcagggaactggccaggcaagggggcaggcccgtttctcctggtggttggtgcgttgtagcagcagcgggagccaggactaaggacaagcaggagctgggagccccagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtggattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggggcctcaacaagcaaggctacaaatgcaggcaatgtaacgctgccatccacaagaaatgcatcgacaagatcatcggcagatgcactggcaccgcggccaacagccgggacactatattccagaaagaacgcttcaacatcgacatgccgcaccgcttcaaggttcacaactacatgagccccaccttctgtgaccactgcggcagcctgctctggggactggtgaagcagggattaaagtgtgaagactgcggcatgaatgtgcaccataaatgccgggagaaggtggccaacctctgcggcatcaaccagaagcttttggctgaggccttgaaccaagtcacccagagagcctcccggagatcagactcagcctcctcagagcctgttgggatatatcagggtttcgagaagaagaccggagttgctggggaggacatgcaagacaacagtgggacctacggcaagatctgggagggcagcagcaagtgcaacatcaacaacttcatcttccacaaggtcctgggcaaaggcagcttcgggaaggtgctgcttggagagctgaagggcagaggagagtactttgccatcaaggccctcaagaaggatgtggtcctgatcgacgacgacgtggagtgcaccatggttgagaagcgggtgctgacacttgccgcagagaatccctttctcacccacctcatctgcaccttccagaccaaggaccacctgttctttgtgatggagttcctcaacgggggggacctgatgtaccacatccaggacaaaggccgctttgaactctaccgtgccacgttttatgccgctgagataatgtgtggactgcagtttctacacagcaagggcatcatttacagggacctcaaactggacaatgtgctgctggaccgggatggccacatcaagattgccgactttgggatgtgcaaagagaacatattcggggagagccgggccagcaccttctgcggcacccctgactatatcgcccctgagatcctacagggcctgaagtacacattctctgtggactggtggtctttcggggtccttctgtacgagatgctcattggccagtcccccttccatggtgatgatgaggatgaactcttcgagtccatccgtgtggacacgccacattatccccgctggatcaccaaggagtccaaggacatcctggagaagctctttgaaagggaaccaaccaagaggctgggagtgaccggaaacatcaaaatccaccccttcttcaagaccataaactggactctgctggaaaagcggaggttggagccacctttcaggcccaaagtgaagtcacccagagactacagtaactttgaccaggagttcctgaacgagaaggcgcgcctctcctacagcgacaagaacctcatcgactccatggaccagtctgcattcgctggcttctcctttgtgaaccccaaattcgagcacctcctggaagattgaggttcctggacagatcaggctagccctgccctccacccacacctgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataa

SEQ ID NO: 16603 - DNA, 404 bp, Homo sapiens
  ENST00000477794
ggcggctgtagcccacatctcccgagcgacccccggcgcccgcccgccgcgcggaggcccgggccacacctcactggccgcttggcccatcccagtcagcgccgcgccgaaccccgtccgcgcgcgccggggagcggcgcccccgccgctgccgccgcgacccttggcgcctgcccctgcaacgggaggctggagtgcagtggcaagatctcggctcactgcaacctctacctcccgggttcaagtgattcttctgcctcagcctcccagccccactgcaggccccaccatggcgccgttcctgcgcatcgccttcaactcctatgagctgggctccctgcaggccgaggacgaggcgaaccagcccttctgtgccgtgaagatgaaggaggcgctcagcacag

SEQ ID NO: 16604 - DNA, 562 bp, Homo sapiens
  ENST00000487897
aaactgagaaactgagccgcggtcagcgaaagtcccgccgcgccgagacctgccggtctgcagggaactggccaggcaagggggcaggcccgtttctcctggtggttggtgcgttgtagcagcagcgggagccaggactaaggacaagcaggagctgggagccccagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtgg

SEQ ID NO: 16605 - DNA, 777 bp, Homo sapiens
  ENST00000464818
ggggcaggcccgtttctcctggtggttggtgcgttgtagcagcagcgggagccaggactaaggacaagcaggagctgggagccccagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtggattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggggcctcaacaagcaaggctacaaatgcaggcactgcggcatgaatgtgcaccataaatgccgggagaaggtggccaacctctgcggcatcaaccagaagcttttggctgaggccttgaaccaagtcaccca

SEQ ID NO: 16606 - DNA, 571 bp, Homo sapiens
  ENST00000479081
attcctaggtcggtttcggggccatccccgccgcctatccttcgccctaggtcacctggaggtggctggaaggccagtggactccacatttagggagagtggttacaagaggactcggattcccccaccttcccttcggctttgggaatcccaggaaacccgccccgaacccctgaaaagtcccagagaagaaagggggccctgaggcagaaggtggtccacgaagtcaagagccacaagttcaccgctcgcttcttcaagcagcccaccttctgcagccactgcaccgacttcatctggggtatcggaaagcagggcctgcaatgtcaagtctgcagctttgtggttcatcgacgatgccacgaatttgtgaccttcgagtgtccaggcgctgggaagggcccccagacggacgacccccggaacaaacacaagttccgcctgcatagctacagcagccccaccttctgcgaccactgtggctccctcctctacgggcttgtgcaccagggcatgaaatgctcctgctgcgagatgaacgtgcaccggcgctgtgtgcgtagcgtgccct

SEQ ID NO: 16607 - DNA, 678 bp, Homo sapiens
  ENST00000474397
acacaaataatggagaggccaggggaggaaataaagactcagccggcatcggagaaaaaagggggccctgaggcagaaggtggtccacgaagtcaagagccacaagttcaccgctcgcttcttcaagcagcccaccttctgcagccactgcaccgacttcatctggggtatcggaaagcagggcctgcaatgtcaagtctgcagctttgtggttcatcgacgatgccacgaatttgtgaccttcgagtgtccaggcgctgggaagggcccccagacggacgacccccggaacaaacacaagttccgcctgcatagctacagcagccccaccttctgcgaccactgtggctccctcctctacgggcttgtgcaccagggcatgaaatgctcctgctgcgagatgaacgtgcaccggcgctgtgtgcgtagcgtgccctccctgtgcggtgtggaccacaccgagcgccgcgggcgcctgcagctggagatccgggctcccacagcagatgagatccacgtaactgttggcgaggcccgtaacctaattcctatggaccccaatggtctctctgatccctatgtgaaactgaagctcatcccagaccctcggaacctgacgaaacagaagacccgaacggtgaaagccacgctaaaccctgtgtggaatgagacctttgt

SEQ ID NO: 16608 - DNA, 3133 bp, Homo sapiens
  ENST00000263431
cggagctggagctcccaccgccgccgcccgtgcctccggctgccggcgcccctgcctttggctcttcctccccactcgcccgctccccctggcggagccggcgcgcccggggtgccgctccctgcctggcgcgctccgcacctggaggtgccttgcccctctcctgcccacctcggaatttccctgtggctcctttgatccttcgagtctccagctcctctcccttccacctgtttcccccaagaaaggcaggatcctggtccctgctacgtttctggggccatggctggtctgggccccggcgtaggcgattcagaggggggaccccggcccctgttttgcagaaagggggccctgaggcagaaggtggtccacgaagtcaagagccacaagttcaccgctcgcttcttcaagcagcccaccttctgcagccactgcaccgacttcatctggggtatcggaaagcagggcctgcaatgtcaagtctgcagctttgtggttcatcgacgatgccacgaatttgtgaccttcgagtgtccaggcgctgggaagggcccccagacggacgacccccggaacaaacacaagttccgcctgcatagctacagcagccccaccttctgcgaccactgtggctccctcctctacgggcttgtgcaccagggcatgaaatgctcctgctgcgagatgaacgtgcaccggcgctgtgtgcgtagcgtgccctccctgtgcggtgtggaccacaccgagcgccgcgggcgcctgcagctggagatccgggctcccacagcagatgagatccacgtaactgttggcgaggcccgtaacctaattcctatggaccccaatggtctctctgatccctatgtgaaactgaagctcatcccagaccctcggaacctgacgaaacagaagacccgaacggtgaaagccacgctaaaccctgtgtggaatgagacctttgtgttcaacctgaagccaggggatgtggagcgccggctcagcgtggaggtgtgggactgggaccggacctcccgcaacgacttcatgggggccatgtcctttggcgtctcggagctgctcaaggcgcccgtggatggctggtacaagttactgaaccaggaggagggcgagtattacaatgtgccggtggccgatgctgacaactgcagcctcctccagaagtttgaggcttgtaactaccccctggaattgtatgagcgggtgcggatgggcccctcttcctctcccatcccctccccttcccctagtcccaccgaccccaagcgctgcttcttcggggcgagtccaggacgcctgcacatctccgacttcagcttcctcatggttctaggaaaaggcagttttgggaaggtgatgctggccgagcgcaggggctctgatgagctctacgccatcaagatcttgaaaaaggacgtgatcgtccaggacgacgatgtggactgcacgctggtggagaaacgtgtgctggcgctggggggccggggtcctggcggccggccccacttcctcacccagctccactccaccttccagaccccggaccgcctgtatttcgtgatggagtacgtcaccgggggagacttgatgtaccacattcaacagctgggcaagtttaaggagccccatgcagcgttctacgcggcagaaatcgctatcggcctcttcttccttcacaatcagggcatcatctacagggacctgaagctggacaatgtgatgctggatgctgagggacacatcaagatcactgactttggcatgtgtaaggagaacgtcttccccgggacgacaacccgcaccttctgcgggaccccggactacatagccccggagatcattgcctaccagccctatgggaagtctgtcgattggtggtcctttggagttctgctgtatgagatgttggcaggacagcctcccttcgatggggaggacgaggaggagctgtttcaggccatcatggaacaaactgtcacctaccccaagtcgctttcccgggaagccgtggccatctgcaaggggttcctgaccaagcacccagggaagcgcctgggctcagggcctgatggggaacctaccatccgtgcacatggctttttccgctggattgactgggagcggctggaacgattggagatcccgcctcctttcagaccccgcccgtgtggccgcagcggcgagaactttgacaagttcttcacgcgggcggcgccagcgctgacccctccagaccgcctagtcctggccagcatcgaccaggccgatttccagggcttcacctacgtgaaccccgacttcgtgcacccggatgcccgcagccccaccagcccagtgcctgtgcccgtcatgtaatctcacccgccgccactaggtgtccccaacgtcccctccgccgtgccggcggcagccccacttcacccccaacttcaccaccccctgtcccattctagatcctgcaccccagcattccagctctgcccccgcgggttctagacgcccctcccaagcgttcctggccttctgaactccatacagcctctacagccgtcccgcgttcaagacttgagcggagcccgatattctccctgaccttagcgttctggactctgccccaatcgggtccagagaccacaccactaaccatccccaactccatggggttcgagactccatcttggtagttctgtgcctccccccagaccccgcccctggggaaatagcctcacggggttggctgttccagactcaggttccagaacagccctcggcctccgaggctccccgcctccactctagttctagatgagtgggaggcgtgcccccctcctccagtacgtcccgctgctgtgctctggggatttctgggatatatggaggattctttccccagaggctcccaatcagcttttgttctagacttccccatcccgaagccatcacttctccccgcagcccgcctgccgtgcatggctcctgtctggctcggacccaccccaactctccccagtgcctgccactctctgggactctcctcctcccctcctcttcccttagcctctcccacccggccacagctgctggagaataaatttgggatgctgatgctgaa

SEQ ID NO: 16609 - DNA, 560 bp, Homo sapiens
  ENST00000419486
accgccgccgcccgtgcctccggctgccggcgcccctgcctttggctcttcctccccactcgcccgctccccctggcggagccggcgcgcccggggtgccgctccctgcctggcgcgctccgcacctggagaaagggggccctgaggcagaaggtggtccacgaagtcaagagccacaagttcaccgctcgcttcttcaagcagcccaccttctgcagccactgcaccgacttcatctggggtatcggaaagcagggcctgcaatgtcaagtctgcagctttgtggttcatcgacgatgccacgaatttgtgaccttcgagtgtccaggcgctgggaagggcccccagacggacgacccccggaacaaacacaagttccgcctgcatagctacagcagccccaccttctgcgaccactgtggctccctcctctacgggcttgtgcaccagggcatgaaatgctcctgctgcgagatgaacgtgcaccggcgctgtgtgcgtagcgtgccctccctgtgcggtgtggaccacaccgagcgccgcgggcgcctgcagctgga

SEQ ID NO: 16610 - DNA, 3224 bp, Homo sapiens
  ENST00000539722
ccgccagccccgccagtccccgcgcagtccccgcgcagtccccgcgcagtcccagcgccaccgggcagcagcggcgccgtgctcgctccagggcgcaaccatgtcgccatttcttcggattggcttgtccaactttgactgcgggtcctgccagtcttgtcagggcgaggctgttaacccttactgtgctgtgctcgtcaaagagtatgtcgaatcagagaacgggcagatgtatatccagaaaaagcctaccatgtacccaccctgggacagcacttttgatgcccatatcaacaagggaagagtcatgcagatcattgtgaaaggcaaaaacgtggacctcatctctgaaaccaccgtggagctctactcgctggctgagaggtgcaggaagaacaacgggaagacagaaatatggacacaaaggacatgaatgaatttgagacggaaggcttctttgctttgcatcagcgccggggtgccatcaagcaggcaaaggtccaccacgtcaagtgccacgagttcactgccaccttcttcccacagcccacattttgctctgtctgccacgagtttgtctggggcctgaacaaacagggctaccagtgccgacaatgcaatgcagcaattcacaagaagtgtattgataaagttatagcaaagtgcacaggatcagctatcaatagccgagaaaccatgttccacaaggagagattcaaaattgacatgccacacagatttaaagtctacaattacaagagcccgaccttctgtgaacactgtgggaccctgctgtggggactggcacggcaaggactcaagtgtgatgcatgtggcatgaatgtgcatcatagatgccagacaaaggtggccaacctttgtggcataaaccagaagctaatggctgaagcgctggccatgattgagagcactcaacaggctcgctgcttaagagatactgaacagatcttcagagaaggtccggttgaaattggtctcccatgctccatcaaaaatgaagcaaggccgccatgtttaccgacaccgggaaaaagagagcctcagggcatttcctgggagtctccgttggatgaggtggataaaatgtgccatcttccagaacctgaactgaacaaagaaagaccatctctgcagattaaactaaaaattgaggattttatcttgcacaaaatgttggggaaaggaagttttggcaaggtcttcctggcagaattcaagaaaaccaatcaatttttcgcaataaaggccttaaagaaagatgtggtcttgatggacgatgatgttgagtgcacgatggtagagaagagagttctttccttggcctgggagcatccgtttctgacgcacatgttttgtacattccagaccaaggaaaacctcttttttgtgatggagtacctcaacggaggggacttaatgtaccacatccaaagctgccacaagttcgacctttccagagcgacgttttatgctgctgaaatcattcttggtctgcagttccttcattccaaaggaatagtctacagggacctgaagctagataacatcctgttagacaaagatggacatatcaagatcgcggattttggaatgtgcaaggagaacatgttaggagatgccaagacgaataccttctgtgggacacctgactacatcgccccagagatcttgctgggtcagaaatacaaccactctgtggactggtggtccttcggggttctcctttatgaaatgctgattggtcagtcgcctttccacgggcaggatgaggaggagctcttccactccatccgcatggacaatcccttttacccacggtggctggagaaggaagcaaaggaccttctggtgaagctcttcgtgcgagaacctgagaagaggctgggcgtgaggggagacatccgccagcaccctttgtttcgggagatcaactgggaggaacttgaacggaaggagattgacccaccgttccggccgaaagtgaaatcaccatttgactgcagcaatttcgacaaagaattcttaaacgagaagccccggctgtcatttgccgacagagcactgatcaacagcatggaccagaatatgttcaggaacttttccttcatgaaccccgggatggagcggctgatatcctgaatcttgcccctccagagacaggaaagaatttgccttctccctgggaactggttcaagagacactgcttgggttcctttttcaacttggaaaaagaaagaaacactcaacaataaagactgagacccgttcgcccccatgtgacttttatctgtagcagaaaccaagtctacttcactaatgacgatgccgtgtgtctcgtctcctgacatgtctcacagacgctcctgaagttaggtcattactaaccatagttatttacttgaaagatgggtctccgcacttggaaaggtttcaagacttgatactgcaataaattatggctcttcacctgggcgccaactgctgatcaatgaaatgcttgttgaatcaggggcaaacggagtacagacgtctcaagactgaaacggccccattgcctggtctagtagcggatctcactcagccgcagacaagtaatcactaacccgttttattctattcctatctgtggatgtgtaaatggctggggggccagccctggataggtttttatgggaattctttacaataaacatagcttgtaacttgagatctacaaatccattcatcctgattgggcatgaaatccatggtcaagaggacaagtggaaagtgagagggaaggtttgctagacaccttcgcttgttatcttgtcaagatagaaaagatagtatcatttcacccttgccagtaaaaacctttccatccacccattctcagcagactccagtattggcacagtcactcactgccattctcacactataacaagaaaagaaatgaagtgcataagtctcctgggaaaagaaccttaaccccttctcgtgccatgactggtgatttcatgactcataagcccctccgtaggcatcattcaagatcaatggcccatgcatgctgtttgcagcagtcaattgagttgaattagaattccaaccatacattttaaaggtatttgtgctgtgtgtatattttgataaaatgttgtgacttcatggcaaacaggtggatgtgtaaaaatggaataaaaaaaaaaaaagagtc

SEQ ID NO: 16611 - DNA, 3285 bp, Homo sapiens
  ENST00000263125
ccgccagccccgccagtccccgcgcagtccccgcgcagtccccgcgcagtcccagcgccaccgggcagcagcggcgccgtgctcgctccagggcgcaaccatgtcgccatttcttcggattggcttgtccaactttgactgcgggtcctgccagtcttgtcagggcgaggctgttaacccttactgtgctgtgctcgtcaaagagtatgtcgaatcagagaacgggcagatgtatatccagaaaaagcctaccatgtacccaccctgggacagcacttttgatgcccatatcaacaagggaagagtcatgcagatcattgtgaaaggcaaaaacgtggacctcatctctgaaaccaccgtggagctctactcgctggctgagaggtgcaggaagaacaacgggaagacagaaatatggttagagctgaaacctcaaggccgaatgctaatgaatgcaagatactttctggaaatgagtgacacaaaggacatgaatgaatttgagacggaaggcttctttgctttgcatcagcgccggggtgccatcaagcaggcaaaggtccaccacgtcaagtgccacgagttcactgccaccttcttcccacagcccacattttgctctgtctgccacgagtttgtctggggcctgaacaaacagggctaccagtgccgacaatgcaatgcagcaattcacaagaagtgtattgataaagttatagcaaagtgcacaggatcagctatcaatagccgagaaaccatgttccacaaggagagattcaaaattgacatgccacacagatttaaagtctacaattacaagagcccgaccttctgtgaacactgtgggaccctgctgtggggactggcacggcaaggactcaagtgtgatgcatgtggcatgaatgtgcatcatagatgccagacaaaggtggccaacctttgtggcataaaccagaagctaatggctgaagcgctggccatgattgagagcactcaacaggctcgctgcttaagagatactgaacagatcttcagagaaggtccggttgaaattggtctcccatgctccatcaaaaatgaagcaaggccgccatgtttaccgacaccgggaaaaagagagcctcagggcatttcctgggagtctccgttggatgaggtggataaaatgtgccatcttccagaacctgaactgaacaaagaaagaccatctctgcagattaaactaaaaattgaggattttatcttgcacaaaatgttggggaaaggaagttttggcaaggtcttcctggcagaattcaagaaaaccaatcaatttttcgcaataaaggccttaaagaaagatgtggtcttgatggacgatgatgttgagtgcacgatggtagagaagagagttctttccttggcctgggagcatccgtttctgacgcacatgttttgtacattccagaccaaggaaaacctcttttttgtgatggagtacctcaacggaggggacttaatgtaccacatccaaagctgccacaagttcgacctttccagagcgacgttttatgctgctgaaatcattcttggtctgcagttccttcattccaaaggaatagtctacagggacctgaagctagataacatcctgttagacaaagatggacatatcaagatcgcggattttggaatgtgcaaggagaacatgttaggagatgccaagacgaataccttctgtgggacacctgactacatcgccccagagatcttgctgggtcagaaatacaaccactctgtggactggtggtccttcggggttctcctttatgaaatgctgattggtcagtcgcctttccacgggcaggatgaggaggagctcttccactccatccgcatggacaatcccttttacccacggtggctggagaaggaagcaaaggaccttctggtgaagctcttcgtgcgagaacctgagaagaggctgggcgtgaggggagacatccgccagcaccctttgtttcgggagatcaactgggaggaacttgaacggaaggagattgacccaccgttccggccgaaagtgaaatcaccatttgactgcagcaatttcgacaaagaattcttaaacgagaagccccggctgtcatttgccgacagagcactgatcaacagcatggaccagaatatgttcaggaacttttccttcatgaaccccgggatggagcggctgatatcctgaatcttgcccctccagagacaggaaagaatttgccttctccctgggaactggttcaagagacactgcttgggttcctttttcaacttggaaaaagaaagaaacactcaacaataaagactgagacccgttcgcccccatgtgacttttatctgtagcagaaaccaagtctacttcactaatgacgatgccgtgtgtctcgtctcctgacatgtctcacagacgctcctgaagttaggtcattactaaccatagttatttacttgaaagatgggtctccgcacttggaaaggtttcaagacttgatactgcaataaattatggctcttcacctgggcgccaactgctgatcaatgaaatgcttgttgaatcaggggcaaacggagtacagacgtctcaagactgaaacggccccattgcctggtctagtagcggatctcactcagccgcagacaagtaatcactaacccgttttattctattcctatctgtggatgtgtaaatggctggggggccagccctggataggtttttatgggaattctttacaataaacatagcttgtaacttgagatctacaaatccattcatcctgattgggcatgaaatccatggtcaagaggacaagtggaaagtgagagggaaggtttgctagacaccttcgcttgttatcttgtcaagatagaaaagatagtatcatttcacccttgccagtaaaaacctttccatccacccattctcagcagactccagtattggcacagtcactcactgccattctcacactataacaagaaaagaaatgaagtgcataagtctcctgggaaaagaaccttaaccccttctcgtgccatgactggtgatttcatgactcataagcccctccgtaggcatcattcaagatcaatggcccatgcatgctgtttgcagcagtcaattgagttgaattagaattccaaccatacattttaaaggtatttgtgctgtgtgtatattttgataaaatgttgtgacttcatggcaaacaggtggatgtgtaaaaatggaataaaaaaaaaaaaagagtc

SEQ ID NO: 16612 - DNA, 3077 bp, Homo sapiens
  ENST00000610727
atgtcaaatgagaacgggcagatgtatatccagaaaaagcctaccatgtacccaccctgggacagcacttttgatgcccatatcaacaagggaagagtcatgcagatcattgtgaaaggcaaaaacgtggacctcatctctgaaaccaccgtggagctctactcgctggctgagaggtgcaggaagaacaacgggaagacagaaatatggttagagctgaaacctcaaggccgaatgctaatgaatgcaagatactttctggaaatgagtgacacaaaggacatgaatgaatttgagacggaaggcttctttgctttgcatcagcgccggggtgccatcaagcaggcaaaggtccaccacgtcaagtgccacgagttcactgccaccttcttcccacagcccacattttgctctgtctgccacgagtttgtctggggcctgaacaaacagggctaccagtgccgacaatgcaatgcagcaattcacaagaagtgtattgataaagttatagcaaagtgcacaggatcagctatcaatagccgagaaaccatgttccacaaggagagattcaaaattgacatgccacacagatttaaagtctacaattacaagagcccgaccttctgtgaacactgtgggaccctgctgtggggactggcacggcaaggactcaagtgtgatgcatgtggcatgaatgtgcatcatagatgccagacaaaggtggccaacctttgtggcataaaccagaagctaatggctgaagcgctggccatgattgagagcactcaacaggctcgctgcttaagagatactgaacagatcttcagagaaggtccggttgaaattggtctcccatgctccatcaaaaatgaagcaaggccgccatgtttaccgacaccgggaaaaagagagcctcagggcatttcctgggagtctccgttggatgaggtggataaaatgtgccatcttccagaacctgaactgaacaaagaaagaccatctctgcagattaaactaaaaattgaggattttatcttgcacaaaatgttggggaaaggaagttttggcaaggtcttcctggcagaattcaagaaaaccaatcaatttttcgcaataaaggccttaaagaaagatgtggtcttgatggacgatgatgttgagtgcacgatggtagagaagagagttctttccttggcctgggagcatccgtttctgacgcacatgttttgtacattccagaccaaggaaaacctcttttttgtgatggagtacctcaacggaggggacttaatgtaccacatccaaagctgccacaagttcgacctttccagagcgacgttttatgctgctgaaatcattcttggtctgcagttccttcattccaaaggaatagtctacagggacctgaagctagataacatcctgttagacaaagatggacatatcaagatcgcggattttggaatgtgcaaggagaacatgttaggagatgccaagacgaataccttctgtgggacacctgactacatcgccccagagatcttgctgggtcagaaatacaaccactctgtggactggtggtccttcggggttctcctttatgaaatgctgattggtcagtcgcctttccacgggcaggatgaggaggagctcttccactccatccgcatggacaatcccttttacccacggtggctggagaaggaagcaaaggaccttctggtgaagctcttcgtgcgagaacctgagaagaggctgggcgtgaggggagacatccgccagcaccctttgtttcgggagatcaactgggaggaacttgaacggaaggagattgacccaccgttccggccgaaagtgaaatcaccatttgactgcagcaatttcgacaaagaattcttaaacgagaagccccggctgtcatttgccgacagagcactgatcaacagcatggaccagaatatgttcaggaacttttccttcatgaaccccgggatggagcggctgatatcctgaatcttgcccctccagagacaggaaagaatttgccttctccctgggaactggttcaagagacactgcttgggttcctttttcaacttggaaaaagaaagaaacactcaacaataaagactgagacccgttcgcccccatgtgacttttatctgtagcagaaaccaagtctacttcactaatgacgatgccgtgtgtctcgtctcctgacatgtctcacagacgctcctgaagttaggtcattactaaccatagttatttacttgaaagatgggtctccgcacttggaaaggtttcaagacttgatactgcaataaattatggctcttcacctgggcgccaactgctgatcaatgaaatgcttgttgaatcaggggcaaacggagtacagacgtctcaagactgaaacggccccattgcctggtctagtagcggatctcactcagccgcagacaagtaatcactaacccgttttattctattcctatctgtggatgtgtaaatggctggggggccagccctggataggtttttatgggaattctttacaataaacatagcttgtaacttgagatctacaaatccattcatcctgattgggcatgaaatccatggtcaagaggacaagtggaaagtgagagggaaggtttgctagacaccttcgcttgttatcttgtcaagatagaaaagatagtatcatttcacccttgccagtaaaaacctttccatccacccattctcagcagactccagtattggcacagtcactcactgccattctcacactataacaagaaaagaaatgaagtgcataagtctcctgggaaaagaaccttaaccccttctcgtgccatgactggtgatttcatgactcataagcccctccgtaggcatcattcaagatcaatggcccatgcatgctgtttgcagcagtcaattgagttgaattagaattccaaccatacattttaaaggtatttgtgctgtgtgtatattttgataaaatgttgtgacttcatggcaaacaggtggatgtgtaaaaatggaataaaaaaaaaaaaagagtc

SEQ ID NO: 16613 - DNA, 3096 bp, Homo sapiens
  ENST00000397176
ccgccagccccgccagtccccgcgcagtccccgcgcagtccccgcgcagtcccagcgccaccgggcagcagcggcgccgtgctcgctccagggcgcaaccatgtcgccatttcttcggattggcttgtccaactttgactgcgggtcctgccagtcttgtcagggcgaggctgttaacccttactgtgctgtgctcgtcaaagagtatgtcgaatcagagaacgggcagatgtatatccagaaaaagcctaccatgtacccaccctgggacagcacttttgatgcccatatcaacaagggaagagtcatgcagatcattgtgaaaggcaaaaacgtggacctcatctctgaaaccaccgtggagctctactcgctggctgagaggtgcaggaagaacaacgggaagacagaaatatggttagagctgaaacctcaaggccgaatgctaatgaatgcaagatactttctggaaatgagtgacacaaaggacatgaatgaatttgagacggaaggcttctttgctttgcatcagcgccggggtgccatcaagcaggcaaaggtccaccacgtcaagtgccacgagttcactgccaccttcttcccacagcccacattttgctctgtctgccacgagtttgtctggggcctgaacaaacagggctaccagtgccgacaatgcaatgcagcaattcacaagaagtgtattgataaagttatagcaaagtgcacaggatcagctatcaatagccgagaaaccatgttccacaaggagagattcaaaattgacatgccacacagatttaaagtctacaattacaagagcccgaccttctgtgaacactgtgggaccctgctgtggggactggcacggcaaggactcaagtgtgatgcatgtggcatgaatgtgcatcatagatgccagacaaaggtggccaacctttgtggcataaaccagaagctaatggctgaagcgctggccatgattgagagcactcaacaggctcgctgcttaagagatactgaacagatcttcagagaaggtccggttgaaattggtctcccatgctccatcaaaaatgaagcaaggccgccatgtttaccgacaccgggaaaaagagagcctcagggcatttcctgggagtctccgttggatgaggtggataaaatgtgccatcttccagaacctgaactgaacaaagaaagaccatctctgcagattaaactaaaaattgaggattttatcttgcacaaaatgttggggaaaggaagttttggcaaggtcttcctggcagaattcaagaaaaccaatcaatttttcgcaataaaggccttaaagaaagatgtggtcttgatggacgatgatgttgagtgcacgatggtagagaagagagttctttccttggcctgggagcatccgtttctgacgcacatgttttgtacattccagaccaaggaaaacctcttttttgtgatggagtacctcaacggaggggacttaatgtaccacatccaaagctgccacaagttcgacctttccagagcgacgttttatgctgctgaaatcattcttggtctgcagttccttcattccaaaggaatagtctacagggacctgaagctagataacatcctgttagacaaagatggacatatcaagatcgcggattttggaatgtgcaaggagaacatgttaggagatgccaagacgaataccttctgtgggacacctgactacatcgccccagagctcttcgtgcgagaacctgagaagaggctgggcgtgaggggagacatccgccagcaccctttgtttcgggagatcaactgggaggaacttgaacggaaggagattgacccaccgttccggccgaaagtgaaatcaccatttgactgcagcaatttcgacaaagaattcttaaacgagaagccccggctgtcatttgccgacagagcactgatcaacagcatggaccagaatatgttcaggaacttttccttcatgaaccccgggatggagcggctgatatcctgaatcttgcccctccagagacaggaaagaatttgccttctccctgggaactggttcaagagacactgcttgggttcctttttcaacttggaaaaagaaagaaacactcaacaataaagactgagacccgttcgcccccatgtgacttttatctgtagcagaaaccaagtctacttcactaatgacgatgccgtgtgtctcgtctcctgacatgtctcacagacgctcctgaagttaggtcattactaaccatagttatttacttgaaagatgggtctccgcacttggaaaggtttcaagacttgatactgcaataaattatggctcttcacctgggcgccaactgctgatcaatgaaatgcttgttgaatcaggggcaaacggagtacagacgtctcaagactgaaacggccccattgcctggtctagtagcggatctcactcagccgcagacaagtaatcactaacccgttttattctattcctatctgtggatgtgtaaatggctggggggccagccctggataggtttttatgggaattctttacaataaacatagcttgtaacttgagatctacaaatccattcatcctgattgggcatgaaatccatggtcaagaggacaagtggaaagtgagagggaaggtttgctagacaccttcgcttgttatcttgtcaagatagaaaagatagtatcatttcacccttgccagtaaaaacctttccatccacccattctcagcagactccagtattggcacagtcactcactgccattctcacactataacaagaaaagaaatgaagtgcataagtctcctgggaaaagaaccttaaccccttctcgtgccatgactggtgatttcatgactcataagcccctccgtaggcatcattcaagatcaatggcccatgcatgctgtttgcagcagtcaattgagttgaattagaattccaaccatacattttaaaggtatttgtgctgtgtgtatattttgataaaatgttgtgacttcatggcaaacaggtggatgtgtaaaaatggaataaaaaaaaaaaaagagtc

SEQ ID NO: 16614 - DNA, 6111 bp, Homo sapiens
  ENST00000379066
ctttgtggtctacagccacaccaccccaaatgtgcctgatcttgtctgatcttggaagctaagcattgttgggcctagttaggacctggataggagaaatcccttatggctaactatatgtcagaaagcatcagcttttctcgatggacccattcatctaatgaaatatgcctgtactattttaaaaagctttgtatttcgtcatagaaaagttcatccccccagaatgaaaatgaggacatttgagaaggtgatttaaggtgtggacatttgagaaggtgtcctatcaaattagtaaaccaaaggaaaagtactgaatagattaatccaaaacacttactgttttttaaacgaagaggatttcaccttgacagaaaaacaacttttattcaatatgtatttcctgaaattaaagagacaagtacagactgaaaggaaaatagattcgtaaataagctacgtcaactctatcctgctgaggatagctcagtgatgttaaatcctttacaaatccctggttgtcttcctacagacaagactgctttttgatgggactgatattaagagaaataggacctttggggcattcaactccttgataaaacttaaaagtatcggcatgagtggcttaacagaggaaataaagaagttttcaactaaatccaaaagtgcggtcattttctttactgctgttattttaaaaacctcttcataaccattgaaaaagaatcgacaactattttaaaagattaaagaaaggcagatgtctgcaaataattcccctccatcagcccagaagtctgtattacccacagctattcctgctgtgcttccagctgcttctccgtgttcaagtcctaagacgggactctctgcccgactctctaatggaagcttcagtgcaccatcactcaccaactccagaggctcagtgcatacagtttcatttctactgcaaattggcctcacacgggagagtgttaccattgaagcccaggaactgtctttatctgctgtcaaggatcttgtgtgctccatagtttatcaaaagtttccagagtgtggattctttggcatgtatgacaaaattcttctctttcgccatgacatgaactcagaaaacattttgcagctgattacctcagcagatgaaatacatgaaggagacctagtggaagtggttctttcagctttagccacagtagaagacttccagattcgtccacatactctctatgtacattcttacaaagctcctactttctgtgattactgtggtgagatgctctggggattggtacgtcaaggactgaaatgtgaaggctgtggattaaattaccataaacgatgtgccttcaagattccaaataactgtagtggagtaagaaagagacgtctgtcaaatgtatctttaccaggacccggcctctcagttccaagacccctacagcctgaatatgtagcccttcccagtgaagagtcacatgtccaccaggaaccaagtaagagaattccttcttggagtggtcgcccaatctggatggaaaagatggtaatgtgcagagtgaaagttccacacacatttgctgttcactcttacacccgtcccacgatatgtcagtactgcaagcggttactgaaaggcctctttcgccaaggaatgcagtgtaaagattgcaaattcaactgccataaacgctgtgcatcaaaagtaccaagagactgccttggagaggttactttcaatggagaaccttccagtctgggaacagatacagatataccaatggatattgacaataatgacataaatagtgatagtagtcggggtttggatgacacagaagagccatcacccccagaagataagatgttcttcttggatccatctgatctcgatgtggaaagagatgaagaagccgttaaaacaatcagtccatcaacaagcaataatattccgctaatgagggttgtacaatccatcaagcacacaaagaggaagagcagcacaatggtgaaggaagggtggatggtccattacaccagcagggataacctgagaaagaggcattattggagacttgacagcaaatgtctaacattatttcagaatgaatctggatcaaagtattataaggaaattccactttcagaaattctccgcatatcttcaccacgagatttcacaaacatttcacaaggcagcaatccacactgttttgaaatcattactgatactatggtatacttcgttggtgagaacaatggggacagctctcataatcctgttcttgctgccactggagttggacttgatgtagcacagagctgggaaaaagcaattcgccaagccctcatgcctgttactcctcaagcaagtgtttgcacttctccagggcaagggaaagatcacaaagatttgtctacaagtatctctgtatctaattgtcagattcaggagaatgtggatatcagtactgtttaccagatctttgcagatgaggtgcttggttcaggccagtttggcatcgtttatggaggaaaacatagaaagactgggagggatgtggctattaaagtaattgataagatgagattccccacaaaacaagaaagtcaactccgtaatgaagtggctattttacagaatttgcaccatcctgggattgtaaacctggaatgtatgtttgaaaccccagaacgagtctttgtagtaatggaaaagctgcatggagatatgttggaaatgattctatccagtgagaaaagtcggcttccagaacgaattactaaattcatggtcacacagatacttgttgctttgaggaatctgcattttaagaatattgtgcactgtgatttaaagccagaaaatgtgctgcttgcatcagcagagccatttcctcaggtgaagctgtgtgactttggatttgcacgcatcattggtgaaaagtcattcaggagatctgtggtaggaactccagcatacttagcccctgaagttctccggagcaaaggttacaaccgttccctagatatgtggtcagtgggagttatcatctatgtgagcctcagtggcacatttccttttaatgaggatgaagatataaatgaccaaatccaaaatgctgcatttatgtacccaccaaatccatggagagaaatttctggtgaagcaattgatctgataaacaatctgcttcaagtgaagatgagaaaacgttacagtgttgacaaatctcttagtcatccctggctacaggactatcagacttggcttgaccttagagaatttgaaactcgcattggagaacgttacattacacatgaaagtgatgatgctcgctgggaaatacatgcatacacacataaccttgtatacccaaagcacttcattatggctcctaatccagatgatatggaagaagatccttaatcactgagctaacctaaataaggaaggatttcattttatggactgatattttgctgtgtaacttgttctttgtagattgtcatctgcagtgctgcaaagatatgaagaaatatgataacgaataagtgacaccagtactgtagttcataatgagtaggtacaggcgggaaactgaataataagaagtcataatggaatcaaggtgaagctttttataaacttttttagcctaagcaataactggttttgtattttttcttaatccttcactttaatacaataggctcacttaatttgtcttcccatttctctttatatatatatatataaatataaatatatgtttgtttgtttttttaatgaaaaacaagtcaagctagcatccagttactatatagcttggctaaattatacaagacttacaagattgattactcgacaggcttgtatttaagaggtaactgtgaggttaccattatgtgatgttactataaggacttttaacattggtttaacaaaccatagaggcattgaagggtttttcttagatgcctagaaaaagcgcactgggctgttttacctttcttttttaggtcaatcaagactccaaaatagtgattcctaacctttttggagttgctctgctactctgaatatgttctatacagcataaggattgtcaccttctgtgtgttgcaacagcttctaagataattagggacaaatgatgttacaaaaggaagagtactgctggtctaagtgctgagttgtatgtctttgcatagctccactctgctgctaaatatgcatgttctgactgacaccatcttgatgccagtactggattccagcattcagcaggtgcagatctcggctttacacaatttatctttacctagggttcagtcagtaatttctgctttttagcagggccagtgcagggtcagttaatgctacagttactgtatagcaaacagtatccttttttctccttcccctagcctattgggctttgcagatatctggagtgttttaaagtcaattattttaagcagtttgaggggatgtgtaggagtggagcatgaaacagtttataaggctggggctgtattatcagcacagcaaattaaagaatgaaagaagtacttctttttacatttcagctccagcagccagctatttaaaaaatatttttaaatatcttccccaaagtttaagatgtgggaccatctacttgtaagaaacagtggcttatttcttcatttctcagtaatcattgtaaacctttttttttttcttctccactctaacaaaagtaaaagaacaaaacttttgctgaggtcttggactccactacttgttagttatgttggcctggacagatggcaggtctgtcggcagttcctcagtctgtaaaatgaagattatcattcttgcctctccctttgtcacagtgttgtcgtgaagatcagatatgtatgaatgcagtcaaataaactaaaaactaggaaagtgttaactatcgttgcccaccgaatttgaggtagcaaaaaaaaaaaagaatgttctggtacatgaacagactgagaaggcctttcgacatccctgaagctagtctcctgtctagactaaaaatatccttgaaagaatagtagcaaacagtatgcagtactcctgtgttctaagttcttttatgttttagtttaccctcacagcagccatagtgttaagtcattatgagcttcatcttaaagataagaaaactgaggcaaggggagattaacttactgccaaatttcaaacagttagtagtatttgagaccagtagtatggctctaatcttacccttagccctcccaaccattatgctgtactatctacccataaatacctccaggaaacattcccctcttggtaatttgtccttctatagaagcttcaaagattaaatcaaattaattttcaaaaaaaatttttttttagaaatgttattttccctgtgatagaggatgacttcccagtttcaccaaagtctgtttatatcaacacacacaaaatggaataattctgagtcactaggcaatcaatctactgtggttttactatgtaaggtgaaaattaactggaacgatgtttgtttgctatacttacatagtcaaactttacaagccatgaaattaattgcactctttgtatttgttgttaaatgcctaagaagttttctaaaaattttgtaaaggcactgtcagagaatctggagttgaatgattattccagatactgtataacctgcataactttttgtctttaagtcgtgtttgtaaaagaagtaattgctagaaacatttgataatgtacaaagtagtctataatgactgttcagtacatttttaatatttttttggttatatccaactttttgtaaatatactggaagcttgataataaaatgtatttcctatcaccatacttttccatgtgaaaacctgagcctatttctagtataagtatccaaagaaaagtttgacctggttgtgttattttaccagaccttggtaaaagaactattttggaaacagtatttgtaaatggaactaatgctatatttaaaaacactgatttttttttaacctgccaaaaataaaaaaaagctcattttataattttctactaaa

SEQ ID NO: 16615 - DNA, 2642 bp, Homo sapiens
  ENST00000469275
agctttaactggtagtagaaatggcaataaagaatatactcatgaagatgttgcacaaggataatggtgatgaagtttagggcagttttcatattgccacagttaatccgactattagcattttgtaaaaatactattagactgtaaaaccattctaaatatgccactatgttcatagaaattcaatttttgtagcctaaatgatatactaccttgtagcaaaatgtccccattttggcaggttttgtttttcattggaaacaaagagttacttaaagaaaatgagtcatttatttcagtctcaggtggctgagttgtcatttattcagtttggcttatcattaaataacagttattactatcattaacattattaacaaaatctttgtttagccattttggagactattccagaacccagctagttggtttttggtttctgttttttttttttttgagacagagtctcgccctgtcgccaggctgtagtgcagtggcacaatctccactcacttcaacctctgcctcccggttcaagcgattctcctgcctcagcctcccaagtagctgggactacaggcacctgccaccacgcccggctaatttttgtatttttagtagagacggggtttcaccatgttggccaggatggtctcgatctcttgaccttgtgatctgcccacctcagcttcccaaagtggtgggattataggcgtgagccactgcgcccggtgaacctagctagtttcttaatcatgaatacttcatagtttaaaaaagaaagtatttaactgtttgaggttcacatttcaaaacagtgtattttatgcatacatcccaaattttattgagccatgtttcagtgctgatttgacttgttacattttcttaattagtatctgtaaatcattttcctttaaataccttctagtagaagtacattttgctaacaacatgattaactggatttgatatttgagccatgtgaattcgagttatatatatagttgtattttgccttgttgtggatttgctagtccatcatgctgcctagggcaggaaaactcttcaacagcaagcccaaatgagaacctctcctgggctccaaatattccagtttgggagggtactttctattccgctcattgtttttaatttttttttttgtggccctccagaaaacattcatgacaagtaaataggatttaaaatattagcttaaaatagaatcttttatgtatcatcataacaggattaatttttcttcagccattgtttattttactaagatattttgaaaaattttagctcagttgtctttaaaaaggcttcatgttcctacagtatttatatgattttttaaaaatctacacaaacttacaaattttaaatattttttagtccatcaacaagcaataatattccgctaatgagggttgtacaatccatcaagcacacaaagaggaagagcagcacaatggtgaaggaagggtggatggtccattacaccagcagggataacctgagaaagaggcattattggagacttgacagcaaatgtctaacattatttcagaatgaatctggatcaaagtattataaggaaattccactttcagaaattctccgcatatcttcaccacgagatttcacaaacatttcacaaggcagcaatccacactgttttgaaatcattactgatactatggtatacttcgttggtgagaacaatggggacagctctcataatcctgttcttgctgccactggagttggacttgatgtagcacagagctgggaaaaagcaattcgccaagccctcatgcctgttactcctcaagcaagtgtttgcacttctccagggcaagggaaagatcacaaagatttgtctacaagtatctctgtatctaattgtcagattcaggagaatgtggatatcagtactgtttaccagatctttgcagatgaggtgcttggttcaggccagtttggcatcgtttatggaggaaaacatagaaagactgggagggatgtggctattaaagtaattgataagatgagattccccacaaaacaagaaagtcaactccgtaatgaagtggctattttacagaatttgcaccatcctgggattgtaaacctggaatgtatgtttgaaaccccagaacgagtctttgtagtaatggaaaagctgcatggagatatgttggaaatgattctatccagtgagaaaagtcggcttccagaacgaattactaaattcatggtcacacagatacttgttgctttgaggaatctgcattttaagaatattgtgcactgtgatttaaagccagaaaatgtgctgcttgcatcagcagagccatttcctcaggtgaagctgtgtgactttggatttgcacgcatcattggtgaaaagtcattcaggagatctgtggtaggaactccagcatacttagcccctgaagttctccggagcaaaggttacaaccgttccctagatatgtggtcagtgggagttatcatctatgtgagcctcagtggcacatttccttttaatgaggatgaagatataaatgaccaaatccaaaatgctgcatttatgtacccaccaaatccatggagagaaatttctggtgaag

SEQ ID NO: 16616 - DNA, 555 bp, Homo sapiens
  ENST00000452104
ctacaagtatctctgtatctaattgtcagattcaggagaatgtggatatcagtactgtttaccagatctttgcagatgaggtgcttggttcaggccagtttggcatcgtttatggaggaaaacatagaaagactgggagggatgtggctattaaagtaattgataagatgagattccccacaaaacaagaaagtcaactccgtaatgaagtggctattttacagatacttgttgctttgaggaatctgcattttaagaatattgtgcactgtgatttaaagccagaaaatgtgctgcttgcatcagcagagccatttcctcaggtgaagctgtgtgactttggatttgcacgcatcattggtgaaaagtcattcaggagatctgtggtaggaactccagcatacttagcccctgaagttctccggagcaaaggttacaaccgttccctagatatgtggtcagtgggagttatcatctatgtgagcctcagtggcacatttccttttaatgaggatgaagatataaatgaccaaatccaaaatgctgcatttatgt

SEQ ID NO: 16617 - DNA, 518 bp, Homo sapiens
  ENST00000443977
actgatactatggtatacttcgttggtgagaacaatggggacagctctcataatcctgttcttgctgccactggagttggacttgatgtagcacagagctgggaaaaagcaattcgccaagccctcatgcctgttactcctcaagcaagtgtttgcacttctccagggcaagggaaagatcacaaagatttgtctacaagtatctctgtatctaattgtcagattcaggagaatgtggatatcagtactgtttaccagatctttgcagatgaggtgcttggttcaggccagtttggcatcgtttatggagatttgtcagttttaagagtagttacatctctggaggacttcctgtcatcagaggaacaaagaactgtccgaggaaaacatagaaagactgggagggatgtggctattaaagtaattgataagatgagattccccacaaaacaagaaagtcaactccgtaatgaagtggctattttacagaatttgcaccatcctgggattgtaaacct

SEQ ID NO: 16618 - DNA, 4326 bp, Homo sapiens
  ENST00000494667
ggacatttgagaaggtgtcctatcaaattagtaaaccaaaggaaaagtactgaatagattaatccaaaacacttactgttttttaaacgaagaggatttcaccttgacagaaaaacaacttttattcaatatgtatttcctgaaattaaagagacaagtacagactgaaaggaaaatagattcgtaaataagctacgtcaactctatcctgctgaggatagctcagtgatgttaaatcctttacaaatccctggttgtcttcctacagacaagactgctttttgatgggactgatattaagagaaataggacctttggggcattcaactccttgataaaacttaaaagtatcggcatgagtggcttaacagaggaaataaagaagttttcaactaaatccaaaagtgcggtcattttctttactgctgttattttaaaaacctcttcataaccattgaaaaagaatcgacaactattttaaaagattaaagaaaggcagatgtctgcaaataattcccctccatcagcccagaagtctgtattacccacagctattcctgctgtgcttccagctgcttctccgtgttcaagtcctaagacgggactctctgcccgactctctaatggaagcttcagtgcaccatcactcaccaactccagaggctcagtgcatacagtttcatttctactgcaaattggcctcacacgggagagtgttaccattgaagcccaggaactgtctttatctgctgtcaaggatcttgtgtgctccatagtttatcaaaagtttccagagtgtggattctttggcatgtatgacaaaattcttctctttcgccatgacatgaactcagaaaacattttgcagctgattacctcagcagatgaaatacatgaaggagacctagtggaagtggttctttcagctttagccacagtagaagacttccagattcgtccacatactctctatgtacattcttacaaagctcctactttctgtgattactgtggtgagatgctctggggattggtacgtcaaggactgaaatgtgaaggctgtggattaaattaccataaacgatgtgccttcaagattccaaataactgtagtggagtaagaaagagacgtctgtcaaatgtatctttaccaggacccggcctctcagttccaagacccctacagcctgaatatgtagcccttcccagtgaagagtcacatgtccaccaggaaccaagtaagagaattccttcttggagtggtcgcccaatctggatggaaaagatggtaatgtgcagagtgaaagttccacacacatttgctgttcactcttacacccgtcccacgatatgtcagtactgcaagcggttactgaaaggcctctttcgccaaggaatgcagtgtaaagattgcaaattcaactgccataaacgctgtgcatcaaaagtaccaagagactgccttggagaggttactttcaatggagaaccttccagtctgggaacagatacagatataccaatggatattgacaataatgacataaatagtgatagtagtcggggtttggatgacacagaagagccatcacccccagaagataagatgttcttcttggatccatctgatctcgatgtggaaagagatgaagaagccgttaaaacaatcagtccatcaacaagcaataatattccgctaatgagggttgtacaatccatcaagcacacaaagaggaagagcagcacaatggtgaaggaagggtggatggtccattacaccagcagggataacctgagaaagaggcattattggagacttgacagcaaatgtctaacattatttcagaatgaatctggatcaaagtattataaggaaattccactttcagaaattctccgcatatcttcaccacgagatttcacaaacatttcacaaggcagcaatccacactgttttgaaatcattactgatactatggtatacttcgttggtgagaacaatggggacagctctcataatcctgttcttgctgccactggagttggacttgatgtagcacagagctgggaaaaagcaattcgccaagccctcatgcctgttactcctcaagcaagtgtttgcacttctccagggcaagggaaagatcacaaagatttgtctacaagtatctctgtatctaattgtcagattcaggagaatgtggatatcagtactgtttaccagatctttgcagatgaggtgcttggttcaggccagtttggcatcgtttatggaggtaagcaactacagccgtttgcatattgtacacattattttaaaaactggaaaatgtaaaacatctgccagctgttttgtcatctcatagttttgtccagtgccttttttttaaaggctgacttgttatctttcagctaaatccttctcactgtaatttgagtattcttcccttaatgtcattgcaaactttaaaaattaacagaatcagaaaattttacagtgtgttttatctcttcttgtagctcacacatacagatgtttgtcggaggcagggggggagatggtttgaagtttatgttgggctgagtgggcttattcattgaagtatattccctactagttttccaacacaaatggcaccatttgtctactgttggcatgattgttctattaagtctgaaaacctgaacctgaaatccaactttgcgatttaggatattgatgaagtcatttaaccttactgtgcgttagcatcttcaactgtttaatggaactaataaaacctgacctgtgtagctcatagggcttaaatattaattaaacttaatatatgtaaaggtactaagaaagaaatgttaaacccttgttatcccttgctaagacttggtacagtagtttcctagttggctgttctgcctccattcttaccttcttttcatacaactcttagagtcaatctttcagaaaattcacatctgatattagtattacctcacatagaacccttaagtggttcacagtcatctacagattcatagccagttttcttagcagaggatttcaaggctgctgtaatttatccctgcttctctagcctcagatctaattgcagcttcctctttgctttctatctttcagtcctgtttacatgcctccataccctttgcctctctgctccttctccatccctttgtctcttctagtgcacattttttcatacttcagggctcaactaaagggctttctctgtggaaatttcttgtccccgtacctatttctccatcaaataaaaacatggttcccctttggtactcctgctacccaacatacttctctcacaatatctattaccctttgggtttacattattgtcttcccactgaactttattggagcgttggctgtgagatgtctggatcttctttgtattcctagcacctagtattgtgacataaagcagtcgcctagaaaatgtgttgactctgcatgcatatataatatctatggtttgcaacttcagatttgtcagttttaagagtagttacatctctggaggacttcctgtcatcagaggaacaaagaactgtccgaggtacctttggcttcttaccaaaaatgcacacatttgttcagtcttttcaagtagacttacgattgtgccattgagacaaatgagttaatctaaaataaatagctatgtagagaagagcaagtcagatacatatttgaagaacaaataccaaaaatatacctgtcattttcactgcttaatctgtagcatctaaaggcatacctagtacataataggtataactagttaatttgaattaataaatgagggaatgactgttcattataataaacttctacctttttttaatatctagattctagaatatagagacaaatataaattttttatatctagattctagaatatagagacacccagagtttgtgggtacatggttaaatcactctgtgctgactcattgaatctagaataaaattgattcattcatacagtatttccatcttgacagagtctctgaaggactaggtcagggtaattaactatcattgatttaacaaggtagattacttttcagcaacaagttcattcaaattttctcctgtttagataatgcagctgactttattaggggcaaatattatgtatggaggggaaaacaattttttcctaaattaaaggtgagtgaaggagtgtggagaaagaacaaaaatgagccaaaaagaaaattcaagagtaaatacatataaatttcagtctgtggacaactccctaataaagctgtcagtttgcttca

SEQ ID NO: 16619 - DNA, 760 bp, Homo sapiens
  ENST00000475912
tactctctatgtacattcttacaaagctcctactttctgtgattactgtggtgagatgctctggggattggtacgtcaaggactgaaatgtgaaggctgtggattaaattaccataaacgatgtgccttcaagattccaaataactgtagtggagtaagaaagagacgtctgtcaaatgtatctttaccaggacccggcctctcagttccaagacccctacagcctgaatatgtagcccttcccagtgaagagtcacatgtccaccaggaaccaagtaagagaattccttcttggagtggtcgcccaatctggatggaaaagatggtaatgtgcagagtgaaagttccacacacatttgctgttcactcttacacccgtcccacgatatgtcagtactgcaagcggttactgaaaggcctctttcgccaaggaatgcagtgtaaagattgcaaattcaactgccataaacgctgtgcatcaaaagtaccaagagactgccttggagaggttactttcaatggaggtaaaattatttttcttaatttttgtgaaagatcagaaaaggccatgattctttggtgtattatctttggataaggttctgttttcctgatttattttgtttcttaaagattttcttctgatttaataatcaaacaaaatacacagaccactgacagtatacatttattagtaatcacgccttcccgtctttcctctggccacctgttactttgtagtctaatatagccagtggta

SEQ ID NO: 16620 - DNA, 695 bp, Homo sapiens
  ENST00000443187
ggagggagggaggaaggggcgccggaggcgggcgggatcctgcgaggcgcgtgaagcctcgctggcgcctcgtccggtactcagacgctggcgggcgcagtttctcacgacgggccgagcctgccacttttccagagtgtggattctttggcatgtatgacaaaattcttctctttcgccatgacatgaactcagaaaacattttgcagctgattacctcagcagatgaaatacatgaaggagacctagtggaagtggttctttcagctttagccacagtagaagacttccagattcgtccacatactctctatgtacattcttacaaagctcctactttctgtgattactgtggtgagatgctctggggattggtacgtcaaggactgaaatgtgaaggctgtggattaaattaccataaacgatgtgccttcaagattccaaataactgtagtggagtaagaaagagacgtctgtcaaatgtatctttaccaggacccggcctctcagttccaagacccctacagcctgaatatgtagcccttcccagtgaagagtcacatgtccaccaggaaccaagtaagagaattccttcttggagtggtcgcccaatctggatggaaaagatggtaatgtgcagagtgaaagttccacacacatttgctgttcactcttacacccgtcccacgatatgt

SEQ ID NO: 16621 - DNA, 436 bp, Homo sapiens
  ENST00000464552
gtgcaccatcactcaccaactccagaggctcagtgcatacagtttcatttctactgcaaattggcctcacacgggagagtgttaccattgaagcccaggaactgtctttatctgctgtcaaggatcttgtgtgctccatagtttatcaaaagtttccagagtgtggattctttggcatgtatgacaaaattcttctctttcgccatgacatgaactcagaaaacattttgcagctgattacctcagcagatgaaatacatgaaggagacctagtggaagtggttctttcaggtaagtaagtggctttttagagtgattgccttttcccctcaaagagcctaattttctgtactaaatgctgcaattcgattatatttagtctttgtattattgttacttaatttctttcatctctaataatggtcaccatatgatt

SEQ ID NO: 16622 - DNA, 539 bp, Homo sapiens
  ENST00000477132
aacttgggttcgcgctccgctggagaccaccgcgcccggcccatcggaggcgatccgttcccgggtctcccaaactagttcccgaagccagacccgcggcgctcgcagtgccgaattttggaccagctttttcgtttcatttcctcactttgcgttgtagtcgtctcaaaggggctaactatatgtcagaaagcatcagcttttctcgatggacccattcatctaatgaaatatgcctgtactattttaaaaagctttgtatttcgtcatagaaaagttcatccccccagaatgaaaatgaggacatttgagaaggtgatttaaggtgtggacatttgagaaggtgtcctatcaaattagtaaaccaaaggaaaagtactgaatagattaatccaaaacacttactgttttttaaacgaagaggatttcaccttgacagaaaaacaacttttattcaatatgtatttcctgaaattaaagagacaagtacagactgaaaggaaaatagattcgtaaataagctacgtcaactctatcct

SEQ ID NO: 16623 - DNA, 5900 bp, Homo sapiens
  ENST00000234179
aaagttcatccccccagaatgaaaatgaggacatttgagaaggtgatttaaggtgtggacatttgagaaggtgtcctatcaaattagtaaaccaaaggaaaagtactgaatagattaatccaaaacacttactgttttttaaacgaagaggatttcaccttgacagaaaaacaacttttattcaatatgtatttcctgaaattaaagagacaagtacagactgaaaggaaaatagattcgtaaataagctacgtcaactctatcctgctgaggatagctcagtgatgttaaatcctttacaaatccctggttgtcttcctacagacaagactgctttttgatgggactgatattaagagaaataggacctttggggcattcaactccttgataaaacttaaaagtatcggcatgagtggcttaacagaggaaataaagaagttttcaactaaatccaaaagtgcggtcattttctttactgctgttattttaaaaacctcttcataaccattgaaaaagaatcgacaactattttaaaagattaaagaaaggcagatgtctgcaaataattcccctccatcagcccagaagtctgtattacccacagctattcctgctgtgcttccagctgcttctccgtgttcaagtcctaagacgggactctctgcccgactctctaatggaagcttcagtgcaccatcactcaccaactccagaggctcagtgcatacagtttcatttctactgcaaattggcctcacacgggagagtgttaccattgaagcccaggaactgtctttatctgctgtcaaggatcttgtgtgctccatagtttatcaaaagtttccagagtgtggattctttggcatgtatgacaaaattcttctctttcgccatgacatgaactcagaaaacattttgcagctgattacctcagcagatgaaatacatgaaggagacctagtggaagtggttctttcagctttagccacagtagaagacttccagattcgtccacatactctctatgtacattcttacaaagctcctactttctgtgattactgtggtgagatgctctggggattggtacgtcaaggactgaaatgtgaaggctgtggattaaattaccataaacgatgtgccttcaagattccaaataactgtagtggagtaagaaagagacgtctgtcaaatgtatctttaccaggacccggcctctcagttccaagacccctacagcctgaatatgtagcccttcccagtgaagagtcacatgtccaccaggaaccaagtaagagaattccttcttggagtggtcgcccaatctggatggaaaagatggtaatgtgcagagtgaaagttccacacacatttgctgttcactcttacacccgtcccacgatatgtcagtactgcaagcggttactgaaaggcctctttcgccaaggaatgcagtgtaaagattgcaaattcaactgccataaacgctgtgcatcaaaagtaccaagagactgccttggagaggttactttcaatggagaaccttccagtctgggaacagatacagatataccaatggatattgacaataatgacataaatagtgatagtagtcggggtttggatgacacagaagagccatcacccccagaagataagatgttcttcttggatccatctgatctcgatgtggaaagagatgaagaagccgttaaaacaatcagtccatcaacaagcaataatattccgctaatgagggttgtacaatccatcaagcacacaaagaggaagagcagcacaatggtgaaggaagggtggatggtccattacaccagcagggataacctgagaaagaggcattattggagacttgacagcaaatgtctaacattatttcagaatgaatctggatcaaagtattataaggaaattccactttcagaaattctccgcatatcttcaccacgagatttcacaaacatttcacaaggcagcaatccacactgttttgaaatcattactgatactatggtatacttcgttggtgagaacaatggggacagctctcataatcctgttcttgctgccactggagttggacttgatgtagcacagagctgggaaaaagcaattcgccaagccctcatgcctgttactcctcaagcaagtgtttgcacttctccagggcaagggaaagatcacaaagatttgtctacaagtatctctgtatctaattgtcagattcaggagaatgtggatatcagtactgtttaccagatctttgcagatgaggtgcttggttcaggccagtttggcatcgtttatggaggaaaacatagaaagactgggagggatgtggctattaaagtaattgataagatgagattccccacaaaacaagaaagtcaactccgtaatgaagtggctattttacagaatttgcaccatcctgggattgtaaacctggaatgtatgtttgaaaccccagaacgagtctttgtagtaatggaaaagctgcatggagatatgttggaaatgattctatccagtgagaaaagtcggcttccagaacgaattactaaattcatggtcacacagatacttgttgctttgaggaatctgcattttaagaatattgtgcactgtgatttaaagccagaaaatgtgctgcttgcatcagcagagccatttcctcaggtgaagctgtgtgactttggatttgcacgcatcattggtgaaaagtcattcaggagatctgtggtaggaactccagcatacttagcccctgaagttctccggagcaaaggttacaaccgttccctagatatgtggtcagtgggagttatcatctatgtgagcctcagtggcacatttccttttaatgaggatgaagatataaatgaccaaatccaaaatgctgcatttatgtacccaccaaatccatggagagaaatttctggtgaagcaattgatctgataaacaatctgcttcaagtgaagatgagaaaacgttacagtgttgacaaatctcttagtcatccctggctacaggactatcagacttggcttgaccttagagaatttgaaactcgcattggagaacgttacattacacatgaaagtgatgatgctcgctgggaaatacatgcatacacacataaccttgtatacccaaagcacttcattatggctcctaatccagatgatatggaagaagatccttaatcactgagctaacctaaataaggaaggatttcattttatggactgatattttgctgtgtaacttgttctttgtagattgtcatctgcagtgctgcaaagatatgaagaaatatgataacgaataagtgacaccagtactgtagttcataatgagtaggtacaggcgggaaactgaataataagaagtcataatggaatcaaggtgaagctttttataaacttttttagcctaagcaataactggttttgtattttttcttaatccttcactttaatacaataggctcacttaatttgtcttcccatttctctttatatatatatatataaatataaatatatgtttgtttgtttttttaatgaaaaacaagtcaagctagcatccagttactatatagcttggctaaattatacaagacttacaagattgattactcgacaggcttgtatttaagaggtaactgtgaggttaccattatgtgatgttactataaggacttttaacattggtttaacaaaccatagaggcattgaagggtttttcttagatgcctagaaaaagcgcactgggctgttttacctttcttttttaggtcaatcaagactccaaaatagtgattcctaacctttttggagttgctctgctactctgaatatgttctatacagcataaggattgtcaccttctgtgtgttgcaacagcttctaagataattagggacaaatgatgttacaaaaggaagagtactgctggtctaagtgctgagttgtatgtctttgcatagctccactctgctgctaaatatgcatgttctgactgacaccatcttgatgccagtactggattccagcattcagcaggtgcagatctcggctttacacaatttatctttacctagggttcagtcagtaatttctgctttttagcagggccagtgcagggtcagttaatgctacagttactgtatagcaaacagtatccttttttctccttcccctagcctattgggctttgcagatatctggagtgttttaaagtcaattattttaagcagtttgaggggatgtgtaggagtggagcatgaaacagtttataaggctggggctgtattatcagcacagcaaattaaagaatgaaagaagtacttctttttacatttcagctccagcagccagctatttaaaaaatatttttaaatatcttccccaaagtttaagatgtgggaccatctacttgtaagaaacagtggcttatttcttcatttctcagtaatcattgtaaacctttttttttttcttctccactctaacaaaagtaaaagaacaaaacttttgctgaggtcttggactccactacttgttagttatgttggcctggacagatggcaggtctgtcggcagttcctcagtctgtaaaatgaagattatcattcttgcctctccctttgtcacagtgttgtcgtgaagatcagatatgtatgaatgcagtcaaataaactaaaaactaggaaagtgttaactatcgttgcccaccgaatttgaggtagcaaaaaaaaaaaagaatgttctggtacatgaacagactgagaaggcctttcgacatccctgaagctagtctcctgtctagactaaaaatatccttgaaagaatagtagcaaacagtatgcagtactcctgtgttctaagttcttttatgttttagtttaccctcacagcagccatagtgttaagtcattatgagcttcatcttaaagataagaaaactgaggcaaggggagattaacttactgccaaatttcaaacagttagtagtatttgagaccagtagtatggctctaatcttacccttagccctcccaaccattatgctgtactatctacccataaatacctccaggaaacattcccctcttggtaatttgtccttctatagaagcttcaaagattaaatcaaattaattttcaaaaaaaatttttttttagaaatgttattttccctgtgatagaggatgacttcccagtttcaccaaagtctgtttatatcaacacacacaaaatggaataattctgagtcactaggcaatcaatctactgtggttttactatgtaaggtgaaaattaactggaacgatgtttgtttgctatacttacatagtcaaactttacaagccatgaaattaattgcactctttgtatttgttgttaaatgcctaagaagttttctaaaaattttgtaaaggcactgtcagagaatctggagttgaatgattattccagatactgtataacctgcataactttttgtctttaagtcgtgtttgtaaaagaagtaattgctagaaacatttgataatgtacaaagtagtctataatgactgttcagtacatttttaatatttttttggttatatccaactttttgtaaatatactggaagcttgataataaaatgtatttcctatcaccatacttttccatgtgaaaacctgagcctatttctagtataagtatccaaagaaaagtttgacctggttgtgttattttaccagaccttggtaaaagaactattttggaaacagtatttgtaaatggaactaatgctatatttaaaaacactgatttttttttaacctgccaaaaataaaaaaaagctcattttataattttctact

SEQ ID NO: 16624 - DNA, 6487 bp, Homo sapiens
  ENST00000373985
gcggaggggctcagtgaaaaaatgagcgagctagaggaagactttgccaagattctcatgctcaaggaggagaggatcaaagagctggagaagcggctgtcagagaaggaggaagaaattcaggagctgaagaggaaactccacaaatgccagtcggtgctcccagtgccctcgacccacatcggcccccggaccacccgggcgcagggcatctcggccgagccgcagacgtacaggtccttccacgacctccgacaggcattccggaagttcaccaagtccgaaaggtccaaggatcttataaaggaagctatccttgacaatgactttatgaagaacttggagctgtcgcagatccaggagattgtggattgtatgtacccggtggagtatggcaaggacagttgcatcatcaaagaaggagacgtggggtcactggtgtatgtcatggaagatggtaaggttgaagttacaaaagaaggtgtgaagttgtgtaccatgggtccaggaaaagtgtttggggaattggctattctttacaactgtacccggacagcgaccgtcaagactcttgtaaatgtaaaactctgggccattgatcgacaatgttttcaaacaataatgatgaggacaggactcatcaagcataccgagtatatggaatttttaaaaagcgttccaacattccagagccttcctgaagagatcctcagcaagcttgctgatgtccttgaagagacccactatgaaaatggagaatatattatcaggcaaggtgcaagaggggacaccttctttatcatcagcaaaggaacggtaaatgtcactcgtgaagactcaccgagtgaagacccagtctttcttagaactttaggaaaaggagactggtttggagagaaagccttgcagggggaagatgtgagaacagcaaacgtaattgctgcagaagctgtaacctgccttgtgattgacagagactcttttaaacatttgattggagggctggatgatgtttctaataaagcatatgaagatgcagaagctaaagcaaaatatgaagctgaagcggctttcttcgccaacctgaagctgtctgatttcaacatcattgatacccttggagttggaggtttcggacgagtagaactggtccagttgaaaagtgaagaatccaaaacgtttgcaatgaagattctcaagaaacgtcacattgtggacacaagacagcaggagcacatccgctcagagaagcagatcatgcagggggctcattccgatttcatagtgagactgtacagaacatttaaggacagcaaatatttgtatatgttgatggaagcttgtctaggtggagagctctggaccattctcagggatagaggttcgtttgaagattctacaaccagattttacacagcatgtgtggtagaagcttttgcctatctgcattccaaaggaatcatttacagggacctcaagccagaaaatctcatcctagatcaccgaggttatgccaaactggttgattttggctttgcaaagaaaataggatttggaaagaaaacatggactttttgtgggactccagagtatgtagccccagagatcatcctgaacaaaggccatgacatttcagccgactactggtcactgggaatcctaatgtatgaactcctgactggcagcccacctttctcaggcccagatcctatgaaaacctataacatcatattgagggggattgacatgatagaatttccaaagaagattgccaaaaatgctgctaatttaattaaaaaactatgcagggacaatccatcagaaagattagggaatttgaaaaatggagtaaaagacattcaaaagcacaaatggtttgagggctttaactgggaaggcttaagaaaaggtaccttgacacctcctataataccaagtgttgcatcacccacagacacaagtaattttgacagtttccctgaggacaacgatgaaccaccacctgatgacaactcaggatgggatatagacttctaatgtatttctcttacctgcttctgccttgctgaagacagctttttctgagacacagctgccagcaaacctgagggaaagagagaagattagtgctcggggtcaccatgatgcctttgatcgatgctgctccagtaactacagtggcattaggacttaccgcttagatgacaatagtgctctttacatgttttctgtttgaacctaaaatagcagttgacatggtggtcctgaagcaaagcctttcaccagtaaaagatgttttctattgttgcaatgaccttgctttgctctgattataatttgaaagactgtaggaaacacttcaatgtagtataagagtctgtaccttgctggaatattcaagaagatgaaagaataatatattgggtacaatagattactatggtacagaaactgggctattccctttcttcaagtgaaggctgtgggatctattactgcaggccggtgtatataccatacaaaagaggaccacacatctgttggtcacagagttcatgtcacaccagtgctagaagtttcatgattttatttcccagcagtgctgatgacaagactgaatgttaccttttctttctgacagattttaaaaattgatatgataaaagcacaactgctatagattctgctgagacctctcatagtaggtatatatgagttttcacagaagactgaaaaataatgcatgatatttgtttgttttttttgataaattggcatgacagagtggggaaaaaaagcaattcacaaaaccatttcatattttttaaaatattgtgcttaaagatggtcctggaagtaaatgactagcagccaattggttttacttaacataccctcaaactgaggcttaaagtattcccttttataaaaataaatgcttggggtagggtggagtggggagggattaaaacccatccaaaaaataaataaaaactatataggtgctatgtatatctttcatctgtaaatgtcagtgtctgaacagacaacacaaattcaaatcattatacgtgtagccagaaactcaagcattttcactaaagttattaaaccaaactcctgtccaatttcacttatacaacatagtcagtctagagttgagagacaaaggtaattataaacctatttgaactagcttcttgtcttaggcctgaaccaaaaaacaacaaacaaacaaaaaacaagaatgaaaaacagaaataaaagaagtagaaaagacaaagaaagaaagcccaaagtcaaagttgttaatatttacaggtttaccagatctggaacattacttatttgaggtcagagaacaaaacaagaacctggccaggtgttgattaccttttagtgaataagctgagtccatatacttgtctaactaagaaagcagtacagaggaaaacaggaacctgatttttttaaaataaattttaaataaaatagaattactacaattctgcaatttcatactacctaaaaaagactagatttgaaaatgtcaagctgatttactttattcacatggagaaaagaatccacaaattaaactgagtccttcactggcatgccagttgactattattagctgtcataagtaactcagccatttggaagcatttcctggacaaaattacattatacctgtgaagaaaaatatagaagctttcaagctgtcattctgttttggccctgtgtgaatttggtatattaaattgacgcttgctttttttttcagtagagttttctttttaatcaatcaaacgcctacatttctggaagaaaaagtccaattagatcattacaccttaactaagaaggcaaatcttataaattttgcttgaattgttcttactcaaaactaccttagaatatggtatcttatgaaaatataatattcttaaaattttggaggataaaatgaaaagggtataaacttcaattagaactttaatcctaaaatattgttattcttgtatttttggagttttccgtcccttacaatttctccaaattggtctattccccaagatatccactgttttctacagattttagaatataaaattaaacatatcaacctaaaatctagctatgaatgttatttcaagagttttatatttttaattggctttttaaaaatatgtaattccaatattatagtgaatgttcagtaacttttgttgaaagataatgtggtttaggcttgctaaagaaaggcttgctagaatactaaatttaccttgttatttggaaagagaatctgctcctataacgttttaaaaatccccaaagtcccagagattagcacttgctatggattttggaactatggttcaagtctaagacaaccaatatgaataagttcaatggagaaggaagaagtagcattcagcacaagaaactgtagattgtttctcccacttgttactgcatctttgttcatttcacccatagcattgcatttgatgtctgaagtaattaccacaaaataaaggtaaactacatcttccaagatgtaccaacagaaaacattcgtctaattttgtcaacattgaatttttaggatttaaatcttgtcttaatgaagactctagggctaaaattcatggtcagttccataaaatgcatctcactttatttctgaatttttcacaacccctctattttcttacattaaagaacatctggataagttagaatagtgccaacttgtttgatttgttatatgattttcttgttaatgtgttgagtatgggaaataagggctttctgtgtgtcttgactcacaggaaaactgaaactgccaagggaagcaacattaaaacaactgggatagattgaatacatttgaaaaaataatttctggaaaaacgctatacatgctttttatgtttatatcttctttcttattaagacatgaatcagatccatgtggcattcaaaacaaatttattttggttatattctttacaagtcataatttttacctaaaattgtggaatatgcatgtgaattacacatgtgtagtaataaactcaactattgaatttttcctgtttcatttctaaatgactgaactgatggtaaacaaatttaatgaagtcagctaccatgttgaaaataaggatattagaactgatttcatacaatagaggtgatctgtgcattatccataacaacgttttctttcactataggaccacagacaaatatttatgtaaataggtatttttgtgtgatattttgtggtacatataactttttttagtgtttcacagcattattatttcattttatttgtattgaataatgtttttaggtccaagtagacttgaattaatgtcataattgtcagtattattgaaaattatgtcaactgtactgttattcatctgtcccatagtttagaacatgacctggctatctggcattgttgcaagtgccttaaattcatggcatcctattaaaaaaacaaatttggtgttatgctgcatgacaaagacaaacacacctcaaaatgttgtcctttcttagcttgctgcgttttacagttctttctgctaacaatttataagcctttattatataatattgatgaattacagaaatgatgaagttgttctcttatttctgttaaatgtaccagagctgtgtatctgttaatgagatacagcgtcatttctgtgaaatgtataaatgtatgtgcaggtcaaattaatatatgacattctatcagtctgtatacaggtattcctgttttgctaagctgtgcagattctgtaaaaataaattagtgcagtcaagttctaacatatctcattttatagactccattgacaatggtccaaccgaaaagaaaaattggaaatgactgctaaccagacctcgttatgaaaccaatgatgaaaaagtcacttggtgcacctctcaacaaaacaggatgctttttccgagttcttgtatatgcaaatcatttacgaggcaagttttcaacagacctagaaagcaaaacattgaaagtgtgttgttagccctcctctctgcccctgaatcaacagacagagctctgggaccttggcaatgactcagaggttggggctttctgagtaaagggacatttctttaagcatcatctatcaaatttatttcaatgtatgatgtttttacaactggtcagttcttttgtattcttacagctatggttatttgattgtcctcttacaatttgttctacatgaaagagttctttgttagtcagaatgcaacaaactgtcatcaaatggtcattgaccacttgcactcttttgatgtagattaaaaactttttcataaatttacctgctttgatttgctctgtatttttcctgcagctgtaattgctgagtgcctgttgtatactttatagagttgaaataaaaaaataattacttttgaa

SEQ ID NO: 16625 - DNA, 6928 bp, Homo sapiens
  ENST00000373980
gccccgcaagcttccttgggcgcccggcgcgagggactctgagagcccagccgctgcctcggagcccccattcacgtcccctcctcccgctcccccgccaccgcgcctccgactcttctcccccgcgccgcggcgcccaccgcgtctcaggtttaatcccgggttggacctgctggtttgctctccccgctctgagcctcacagccagcccagagaagtggaatctgcactgaaactctgggtggctggagccggcggactgggcatgctcagaagccagggctggctttggtctcaagtaggaagctttggcactcgggaggcagcggcgactttggggaaagttgatcggagaggggaggaagcctcaagacgcggagcagcggcaggaaggagcccccggcagcccggaggagcatgggcaccttgcgggatttacagtacgcgctccaggagaagatcgaggagctgaggcagcgggatgctctcatcgacgagctggagctggagttggatcagaaggacgaactgatccagaagctgcagaacgagctggacaagtaccgctcggtgatccgaccagccacccagcaggcgcagaagcagagcgcgagcaccttgcagggcgagccgcgcaccaagcggcaggcgatctccgccgagcccaccgccttcgacatccaggatctcagccatgtgaccctgcccttctaccccaagagcccacagtccaaggatcttataaaggaagctatccttgacaatgactttatgaagaacttggagctgtcgcagatccaggagattgtggattgtatgtacccggtggagtatggcaaggacagttgcatcatcaaagaaggagacgtggggtcactggtgtatgtcatggaagatggtaaggttgaagttacaaaagaaggtgtgaagttgtgtaccatgggtccaggaaaagtgtttggggaattggctattctttacaactgtacccggacagcgaccgtcaagactcttgtaaatgtaaaactctgggccattgatcgacaatgttttcaaacaataatgatgaggacaggactcatcaagcataccgagtatatggaatttttaaaaagcgttccaacattccagagccttcctgaagagatcctcagcaagcttgctgatgtccttgaagagacccactatgaaaatggagaatatattatcaggcaaggtgcaagaggggacaccttctttatcatcagcaaaggaacggtaaatgtcactcgtgaagactcaccgagtgaagacccagtctttcttagaactttaggaaaaggagactggtttggagagaaagccttgcagggggaagatgtgagaacagcaaacgtaattgctgcagaagctgtaacctgccttgtgattgacagagactcttttaaacatttgattggagggctggatgatgtttctaataaagcatatgaagatgcagaagctaaagcaaaatatgaagctgaagcggctttcttcgccaacctgaagctgtctgatttcaacatcattgatacccttggagttggaggtttcggacgagtagaactggtccagttgaaaagtgaagaatccaaaacgtttgcaatgaagattctcaagaaacgtcacattgtggacacaagacagcaggagcacatccgctcagagaagcagatcatgcagggggctcattccgatttcatagtgagactgtacagaacatttaaggacagcaaatatttgtatatgttgatggaagcttgtctaggtggagagctctggaccattctcagggatagaggttcgtttgaagattctacaaccagattttacacagcatgtgtggtagaagcttttgcctatctgcattccaaaggaatcatttacagggacctcaagccagaaaatctcatcctagatcaccgaggttatgccaaactggttgattttggctttgcaaagaaaataggatttggaaagaaaacatggactttttgtgggactccagagtatgtagccccagagatcatcctgaacaaaggccatgacatttcagccgactactggtcactgggaatcctaatgtatgaactcctgactggcagcccacctttctcaggcccagatcctatgaaaacctataacatcatattgagggggattgacatgatagaatttccaaagaagattgccaaaaatgctgctaatttaattaaaaaactatgcagggacaatccatcagaaagattagggaatttgaaaaatggagtaaaagacattcaaaagcacaaatggtttgagggctttaactgggaaggcttaagaaaaggtaccttgacacctcctataataccaagtgttgcatcacccacagacacaagtaattttgacagtttccctgaggacaacgatgaaccaccacctgatgacaactcaggatgggatatagacttctaatgtatttctcttacctgcttctgccttgctgaagacagctttttctgagacacagctgccagcaaacctgagggaaagagagaagattagtgctcggggtcaccatgatgcctttgatcgatgctgctccagtaactacagtggcattaggacttaccgcttagatgacaatagtgctctttacatgttttctgtttgaacctaaaatagcagttgacatggtggtcctgaagcaaagcctttcaccagtaaaagatgttttctattgttgcaatgaccttgctttgctctgattataatttgaaagactgtaggaaacacttcaatgtagtataagagtctgtaccttgctggaatattcaagaagatgaaagaataatatattgggtacaatagattactatggtacagaaactgggctattccctttcttcaagtgaaggctgtgggatctattactgcaggccggtgtatataccatacaaaagaggaccacacatctgttggtcacagagttcatgtcacaccagtgctagaagtttcatgattttatttcccagcagtgctgatgacaagactgaatgttaccttttctttctgacagattttaaaaattgatatgataaaagcacaactgctatagattctgctgagacctctcatagtaggtatatatgagttttcacagaagactgaaaaataatgcatgatatttgtttgttttttttgataaattggcatgacagagtggggaaaaaaagcaattcacaaaaccatttcatattttttaaaatattgtgcttaaagatggtcctggaagtaaatgactagcagccaattggttttacttaacataccctcaaactgaggcttaaagtattcccttttataaaaataaatgcttggggtagggtggagtggggagggattaaaacccatccaaaaaataaataaaaactatataggtgctatgtatatctttcatctgtaaatgtcagtgtctgaacagacaacacaaattcaaatcattatacgtgtagccagaaactcaagcattttcactaaagttattaaaccaaactcctgtccaatttcacttatacaacatagtcagtctagagttgagagacaaaggtaattataaacctatttgaactagcttcttgtcttaggcctgaaccaaaaaacaacaaacaaacaaaaaacaagaatgaaaaacagaaataaaagaagtagaaaagacaaagaaagaaagcccaaagtcaaagttgttaatatttacaggtttaccagatctggaacattacttatttgaggtcagagaacaaaacaagaacctggccaggtgttgattaccttttagtgaataagctgagtccatatacttgtctaactaagaaagcagtacagaggaaaacaggaacctgatttttttaaaataaattttaaataaaatagaattactacaattctgcaatttcatactacctaaaaaagactagatttgaaaatgtcaagctgatttactttattcacatggagaaaagaatccacaaattaaactgagtccttcactggcatgccagttgactattattagctgtcataagtaactcagccatttggaagcatttcctggacaaaattacattatacctgtgaagaaaaatatagaagctttcaagctgtcattctgttttggccctgtgtgaatttggtatattaaattgacgcttgctttttttttcagtagagttttctttttaatcaatcaaacgcctacatttctggaagaaaaagtccaattagatcattacaccttaactaagaaggcaaatcttataaattttgcttgaattgttcttactcaaaactaccttagaatatggtatcttatgaaaatataatattcttaaaattttggaggataaaatgaaaagggtataaacttcaattagaactttaatcctaaaatattgttattcttgtatttttggagttttccgtcccttacaatttctccaaattggtctattccccaagatatccactgttttctacagattttagaatataaaattaaacatatcaacctaaaatctagctatgaatgttatttcaagagttttatatttttaattggctttttaaaaatatgtaattccaatattatagtgaatgttcagtaacttttgttgaaagataatgtggtttaggcttgctaaagaaaggcttgctagaatactaaatttaccttgttatttggaaagagaatctgctcctataacgttttaaaaatccccaaagtcccagagattagcacttgctatggattttggaactatggttcaagtctaagacaaccaatatgaataagttcaatggagaaggaagaagtagcattcagcacaagaaactgtagattgtttctcccacttgttactgcatctttgttcatttcacccatagcattgcatttgatgtctgaagtaattaccacaaaataaaggtaaactacatcttccaagatgtaccaacagaaaacattcgtctaattttgtcaacattgaatttttaggatttaaatcttgtcttaatgaagactctagggctaaaattcatggtcagttccataaaatgcatctcactttatttctgaatttttcacaacccctctattttcttacattaaagaacatctggataagttagaatagtgccaacttgtttgatttgttatatgattttcttgttaatgtgttgagtatgggaaataagggctttctgtgtgtcttgactcacaggaaaactgaaactgccaagggaagcaacattaaaacaactgggatagattgaatacatttgaaaaaataatttctggaaaaacgctatacatgctttttatgtttatatcttctttcttattaagacatgaatcagatccatgtggcattcaaaacaaatttattttggttatattctttacaagtcataatttttacctaaaattgtggaatatgcatgtgaattacacatgtgtagtaataaactcaactattgaatttttcctgtttcatttctaaatgactgaactgatggtaaacaaatttaatgaagtcagctaccatgttgaaaataaggatattagaactgatttcatacaatagaggtgatctgtgcattatccataacaacgttttctttcactataggaccacagacaaatatttatgtaaataggtatttttgtgtgatattttgtggtacatataactttttttagtgtttcacagcattattatttcattttatttgtattgaataatgtttttaggtccaagtagacttgaattaatgtcataattgtcagtattattgaaaattatgtcaactgtactgttattcatctgtcccatagtttagaacatgacctggctatctggcattgttgcaagtgccttaaattcatggcatcctattaaaaaaacaaatttggtgttatgctgcatgacaaagacaaacacacctcaaaatgttgtcctttcttagcttgctgcgttttacagttctttctgctaacaatttataagcctttattatataatattgatgaattacagaaatgatgaagttgttctcttatttctgttaaatgtaccagagctgtgtatctgttaatgagatacagcgtcatttctgtgaaatgtataaatgtatgtgcaggtcaaattaatatatgacattctatcagtctgtatacaggtattcctgttttgctaagctgtgcagattctgtaaaaataaattagtgcagtcaagttctaacatatctcattttatagactccattgacaatggtccaaccgaaaagaaaaattggaaatgactgctaaccagacctcgttatgaaaccaatgatgaaaaagtcacttggtgcacctctcaacaaaacaggatgctttttccgagttcttgtatatgcaaatcatttacgaggcaagttttcaacagacctagaaagcaaaacattgaaagtgtgttgttagccctcctctctgcccctgaatcaacagacagagctctgggaccttggcaatgactcagaggttggggctttctgagtaaagggacatttctttaagcatcatctatcaaatttatttcaatgtatgatgtttttacaactggtcagttcttttgtattcttacagctatggttatttgattgtcctcttacaatttgttctacatgaaagagttctttgttagtcagaatgcaacaaactgtcatcaaatggtcattgaccacttgcactcttttgatgtagattaaaaactttttcataaatttacctgctttgatttgctctgtatttttcctgcagctgtaattgctgagtgcctgttgtatactttatagagttgaaataaaaaaataattacttttgaa

SEQ ID NO: 16626 - DNA, 585 bp, Homo sapiens
  ENST00000373976
agttgcatcatcaaagaaggagacgtggggtcactggtgtatgtcatggaagatggtaaggttgaagttacaaaagaaggtgtgaagttgtgtaccatgggtccaggaaaagtgtttggggaattggctattctttacaactgtacccggacagcgaccgtcaagactcttgtaaatgtaaaactctgggccattgatcgacaatgttttcaaacaataatgatgaggacaggactcatcaagcataccgagtatatggaatttttaaaaagcgttccaacattccagagccttcctgaagagatcctcagcaagcttgctgatgtccttgaagagacccactatgaaaatggagaatatattatcaggcaaggtgcaagaggggacaccttctttatcatcagcaaaggaacggtaaatgtcactcgtgaagactcaccgagtgaagacccagtctttcttagaactttaggaaaaggagactggtttggagagaaagccttgcagggctggacttggaatctgtttgaatacgttgtggaataaattccttaatttctaataaatcagtgttatattaattgg

SEQ ID NO: 16627 - DNA, 1786 bp, Homo sapiens
  ENST00000373975
ttcataggaggcacacataaataatgttggtttaattaattaaattaacaaaaggctgcactctcctaaccagattgtgtatctcctctgcacctgaagttcagacttggtaaagcaggattttacacattaatttgagaagatctggagacccactatgaaaatggagaatatattatcaggcaaggtgcaagaggggacaccttctttatcatcagcaaaggaacggtaaatgtcactcgtgaagactcaccgagtgaagacccagtctttcttagaactttaggaaaaggagactggtttggagagaaagccttgcaggggcatttgggaaatactgatggagaagcaaaacatgtttcttcatggatcttacattctgagggaagatgtgagaacagcaaacgtaattgctgcagaagctgtaacctgccttgtgattgacagagactcttttaaacatttgattggagggctggatgatgtttctaataaagcatatgaagatgcagaagctaaagcaaaatatgaagctgaagcggctttcttcgccaacctgaagctgtctgatttcaacatcattgatacccttggagttggaggtttcggacgagtagaactggtccagttgaaaagtgaagaatccaaaacgtttgcaatgaagattctcaagaaacgtcacattgtggacacaagacagcaggagcacatccgctcagagaagcagatcatgcagggggctcattccgatttcatagtgagactgtacagaacatttaaggacagcaaatatttgtatatgttgatggaagcttgtctaggtggagagctctggaccattctcagggatagaggttcgtttgaagattctacaaccagattttacacagcatgtgtggtagaagcttttgcctatctgcattccaaaggaatcatttacagggacctcaagccagaaaatctcatcctagatcaccgaggttatgccaaactggttgattttggctttgcaaagaaaataggatttggaaagaaaacatggactttttgtgggactccagagtatgtagccccagagatcatcctgaacaaaggccatgacatttcagccgactactggtcactgggaatcctaatgtatgaactcctgactggcagcccacctttctcaggcccagatcctatgaaaacctataacatcatattgagggggattgacatgatagaatttccaaagaagattgccaaaaatgctgctaatttaattaaaaaactatgcagggacaatccatcagaaagattagggaatttgaaaaatggagtaaaagacattcaaaagcacaaatggtttgagggctttaactgggaaggcttaagaaaaggtaccttgacacctcctataataccaagtgttgcatcacccacagacacaagtaattttgacagtttccctgaggacaacgatgaaccaccacctgatgacaactcaggatgggatatagacttctaatgtatttctcttacctgcttctgccttgctgaagacagctttttctgagacacagctgccagcaaacctgagggaaagagagaagattagtgctcggggtcaccatgatgcctttgatcgatgctgctccagtaactacagtggcattaggacttaccgcttagatgacaatagtgctctttacatgttttctgtttgaacctaaaatagcagttgacatggtggtcctgaagcaaagcctttcaccagtaaaagatgttttctattgttgcaatg

SEQ ID NO: 16628 - DNA, 5922 bp, Homo sapiens
  ENST00000401604
tccagctcttgtaaatgtaaaactctgggccattgatcgacaatgttttcaaacaataatgatgaggacaggactcatcaagcataccgagtatatggaatttttaaaaagcgttccaacattccagagccttcctgaagagatcctcagcaagcttgctgatgtccttgaagagacccactatgaaaatggagaatatattatcaggcaaggtgcaagaggggacaccttctttatcatcagcaaaggaacggtaaatgtcactcgtgaagactcaccgagtgaagacccagtctttcttagaactttaggaaaaggagactggtttggagagaaagccttgcagggggaagatgtgagaacagcaaacgtaattgctgcagaagctgtaacctgccttgtgattgacagagactcttttaaacatttgattggagggctggatgatgtttctaataaagcatatgaagatgcagaagctaaagcaaaatatgaagctgaagcggctttcttcgccaacctgaagctgtctgatttcaacatcattgatacccttggagttggaggtttcggacgagtagaactggtccagttgaaaagtgaagaatccaaaacgtttgcaatgaagattctcaagaaacgtcacattgtggacacaagacagcaggagcacatccgctcagagaagcagatcatgcagggggctcattccgatttcatagtgagactgtacagaacatttaaggacagcaaatatttgtatatgttgatggaagcttgtctaggtggagagctctggaccattctcagggatagaggttcgtttgaagattctacaaccagattttacacagcatgtgtggtagaagcttttgcctatctgcattccaaaggaatcatttacagggacctcaagccagaaaatctcatcctagatcaccgaggttatgccaaactggttgattttggctttgcaaagaaaataggatttggaaagaaaacatggactttttgtgggactccagagtatgtagccccagagatcatcctgaacaaaggccatgacatttcagccgactactggtcactgggaatcctaatgtatgaactcctgactggcagcccacctttctcaggcccagatcctatgaaaacctataacatcatattgagggggattgacatgatagaatttccaaagaagattgccaaaaatgctgctaatttaattaaaaaactatgcagggacaatccatcagaaagattagggaatttgaaaaatggagtaaaagacattcaaaagcacaaatggtttgagggctttaactgggaaggcttaagaaaaggtaccttgacacctcctataataccaagtgttgcatcacccacagacacaagtaattttgacagtttccctgaggacaacgatgaaccaccacctgatgacaactcaggatgggatatagacttctaatgtatttctcttacctgcttctgccttgctgaagacagctttttctgagacacagctgccagcaaacctgagggaaagagagaagattagtgctcggggtcaccatgatgcctttgatcgatgctgctccagtaactacagtggcattaggacttaccgcttagatgacaatagtgctctttacatgttttctgtttgaacctaaaatagcagttgacatggtggtcctgaagcaaagcctttcaccagtaaaagatgttttctattgttgcaatgaccttgctttgctctgattataatttgaaagactgtaggaaacacttcaatgtagtataagagtctgtaccttgctggaatattcaagaagatgaaagaataatatattgggtacaatagattactatggtacagaaactgggctattccctttcttcaagtgaaggctgtgggatctattactgcaggccggtgtatataccatacaaaagaggaccacacatctgttggtcacagagttcatgtcacaccagtgctagaagtttcatgattttatttcccagcagtgctgatgacaagactgaatgttaccttttctttctgacagattttaaaaattgatatgataaaagcacaactgctatagattctgctgagacctctcatagtaggtatatatgagttttcacagaagactgaaaaataatgcatgatatttgtttgttttttttgataaattggcatgacagagtggggaaaaaaagcaattcacaaaaccatttcatattttttaaaatattgtgcttaaagatggtcctggaagtaaatgactagcagccaattggttttacttaacataccctcaaactgaggcttaaagtattcccttttataaaaataaatgcttggggtagggtggagtggggagggattaaaacccatccaaaaaataaataaaaactatataggtgctatgtatatctttcatctgtaaatgtcagtgtctgaacagacaacacaaattcaaatcattatacgtgtagccagaaactcaagcattttcactaaagttattaaaccaaactcctgtccaatttcacttatacaacatagtcagtctagagttgagagacaaaggtaattataaacctatttgaactagcttcttgtcttaggcctgaaccaaaaaacaacaaacaaacaaaaaacaagaatgaaaaacagaaataaaagaagtagaaaagacaaagaaagaaagcccaaagtcaaagttgttaatatttacaggtttaccagatctggaacattacttatttgaggtcagagaacaaaacaagaacctggccaggtgttgattaccttttagtgaataagctgagtccatatacttgtctaactaagaaagcagtacagaggaaaacaggaacctgatttttttaaaataaattttaaataaaatagaattactacaattctgcaatttcatactacctaaaaaagactagatttgaaaatgtcaagctgatttactttattcacatggagaaaagaatccacaaattaaactgagtccttcactggcatgccagttgactattattagctgtcataagtaactcagccatttggaagcatttcctggacaaaattacattatacctgtgaagaaaaatatagaagctttcaagctgtcattctgttttggccctgtgtgaatttggtatattaaattgacgcttgctttttttttcagtagagttttctttttaatcaatcaaacgcctacatttctggaagaaaaagtccaattagatcattacaccttaactaagaaggcaaatcttataaattttgcttgaattgttcttactcaaaactaccttagaatatggtatcttatgaaaatataatattcttaaaattttggaggataaaatgaaaagggtataaacttcaattagaactttaatcctaaaatattgttattcttgtatttttggagttttccgtcccttacaatttctccaaattggtctattccccaagatatccactgttttctacagattttagaatataaaattaaacatatcaacctaaaatctagctatgaatgttatttcaagagttttatatttttaattggctttttaaaaatatgtaattccaatattatagtgaatgttcagtaacttttgttgaaagataatgtggtttaggcttgctaaagaaaggcttgctagaatactaaatttaccttgttatttggaaagagaatctgctcctataacgttttaaaaatccccaaagtcccagagattagcacttgctatggattttggaactatggttcaagtctaagacaaccaatatgaataagttcaatggagaaggaagaagtagcattcagcacaagaaactgtagattgtttctcccacttgttactgcatctttgttcatttcacccatagcattgcatttgatgtctgaagtaattaccacaaaataaaggtaaactacatcttccaagatgtaccaacagaaaacattcgtctaattttgtcaacattgaatttttaggatttaaatcttgtcttaatgaagactctagggctaaaattcatggtcagttccataaaatgcatctcactttatttctgaatttttcacaacccctctattttcttacattaaagaacatctggataagttagaatagtgccaacttgtttgatttgttatatgattttcttgttaatgtgttgagtatgggaaataagggctttctgtgtgtcttgactcacaggaaaactgaaactgccaagggaagcaacattaaaacaactgggatagattgaatacatttgaaaaaataatttctggaaaaacgctatacatgctttttatgtttatatcttctttcttattaagacatgaatcagatccatgtggcattcaaaacaaatttattttggttatattctttacaagtcataatttttacctaaaattgtggaatatgcatgtgaattacacatgtgtagtaataaactcaactattgaatttttcctgtttcatttctaaatgactgaactgatggtaaacaaatttaatgaagtcagctaccatgttgaaaataaggatattagaactgatttcatacaatagaggtgatctgtgcattatccataacaacgttttctttcactataggaccacagacaaatatttatgtaaataggtatttttgtgtgatattttgtggtacatataactttttttagtgtttcacagcattattatttcattttatttgtattgaataatgtttttaggtccaagtagacttgaattaatgtcataattgtcagtattattgaaaattatgtcaactgtactgttattcatctgtcccatagtttagaacatgacctggctatctggcattgttgcaagtgccttaaattcatggcatcctattaaaaaaacaaatttggtgttatgctgcatgacaaagacaaacacacctcaaaatgttgtcctttcttagcttgctgcgttttacagttctttctgctaacaatttataagcctttattatataatattgatgaattacagaaatgatgaagttgttctcttatttctgttaaatgtaccagagctgtgtatctgttaatgagatacagcgtcatttctgtgaaatgtataaatgtatgtgcaggtcaaattaatatatgacattctatcagtctgtatacaggtattcctgttttgctaagctgtgcagattctgtaaaaataaattagtgcagtcaagttctaacatatctcattttatagactccattgacaatggtccaaccgaaaagaaaaattggaaatgactgctaaccagacctcgttatgaaaccaatgatgaaaaagtcacttggtgcacctctcaacaaaacaggatgctttttccgagttcttgtatatgcaaatcatttacgaggcaagttttcaacagacctagaaagcaaaacattgaaagtgtgttgttagccctcctctctgcccctgaatcaacagacagagctctgggaccttggcaatgactcagaggttggggctttctgagtaaagggacatttctttaagcatcatctatcaaatttatttcaatgtatgatgtttttacaactggtcagttcttttgtattcttacagctatggttatttgattgtcctcttacaatttgttctacatgaaagagttctttgttagtcagaatgcaacaaactgtcatcaaatggtcattgaccacttgcactcttttgatgtagattaaaaactttttcataaatttacctgctttgatttgctctgtatttttcctgcagctgtaattgctgagtgcctgttgtatactttatagagttgaaataaaaaaataattacttttg

SEQ ID NO: 16629 - DNA, 3431 bp, Homo sapiens
  ENST00000395578
aggcggctggggagggcggcgtgggagaggacgctgagacgcaggggcggccgcgccgaggtgacaagctgcgcacctggaaagttacccggctgtctggtgaggtccctgagcaaaatgggaaatggttcagtgaaacctaaacattctaagcacccagatggacactctgggaacctcaccactgatgctctgcggaacaaggtgacagagctggagagagagttgaggaggaaggatgctgagatccaggagcgggagtaccatttgaaggagctgcgggagcagctgtcgaagcagactgtggccattgctgaactcacagaggagctccagaacaagtgcatccagctgaacaagctgcaggatgtggtgcatatgcagggaggaagcccgcttcaggcctctccagataaagtgcctcttgaggtccaccggaagacctctggattggtctctctccatagcaggaggggagcaaaggctggcgtgtctgctgagccaacaacccggacctatgacctgaacaaaccccctgaattttcctttgagaaagcaagagtcagaaaagactccagtgagaagaagctcattacagatgcccttaataaaaatcagtttctgaaaagactggatcctcagcagatcaaagacatggtggaatgcatgtatgggagaaactatcagcaagggagttacattattaagcaaggagaaccaggaaaccatatctttgtgctggcagagggtcgactagaggtgttccaaggggagaaattgctgtcctccatccctatgtggaccacatttggggagcttgccattttatacaattgtacaaggactgcctctgtgaaagctattaccaatgttaaaacatgggcactagatcgagaggtattccagaatataatgaggaggacagcccaagctagagatgaacaatacagaaacttcctcagaagtgtatccttgctgaagaatttacctgaagataaattaaccaagatcattgactgcttggaagtggaatactatgacaaaggagattacatcattagagagggcgaggaaggaagtacctttttcattttggcaaaaggaaaggtaaaagtaacacagagcacagaaggccatgatcaaccacagctgataaaaacactgcagaaaggagaatactttggagaaaaagctcttatcagtgatgatgtcaggtcagctaacattattgctgaagaaaatgatgttgcatgcctggttatagatcgagaaacattcaaccaaactgtcggtacatttgaagagctgcaaaaataccttgaaggatatgtggcaaacctgaaccgtgatgatgaaaaaagacatgcgaagcggtccatgtctaactggaagctgtccaaagcactctctctggaaatgattcagctgaaggagaaggtggccagattttcctcatcatccccattccagaaccttgagattattgcaacactgggcgttggtgggttcggaagagttgagcttgttaaagtaaaaaatgagaatgttgcttttgctatgaagtgtataaggaagaagcacatagttgacaccaagcagcaggagcatgtctactcagagaagaggatcctagaggagctgtgctctccattcattgtgaaattatatcgtactttcaaggacaataagtatgtatacatgcttctggaggcctgcttaggtggggagctctggagtatattaagggacagaggcagctttgatgaacccacctccaaattctgcgttgcttgtgtgacagaagcatttgattacctgcatcgactaggtattatctacagagacttgaaaccagaaaacttaattctagatgctgagggttaccttaaattggttgactttggatttgcgaagaaaatagggtctggacagaaaacatggacattctgtgggactccagaatatgtagctcctgaagtcattctcaacaagggacatgacttcagtgtggatttctggtcactgggaattctagtgtatgagctcctaacgggcaacccacccttttctggggttgaccaaatgatgacctacaatttgattctcaaaggaattgaaaaaatggattttcccaggaagataacacgacgacctgaggatttgattcggaggctttgcaggcaaaatccaacagaaaggctgggaaatctgaagaatggaataaatgacattaagaaacacaggtggttaaatggttttaattgggagggactgaaagcacggagccttccatcacctttgcaaagagagctcaagggacccatagatcacagctactttgacaaatatcctcctgaaaagggaatgcctccagatgagctatcaggctgggataaagacttctgacagaagaaaagttgattactgcctgtactctacagaagaggacctcaaggatcaataatccaacacattattttcttttcagagtattataatatctttggaagaccattagggaaaagaaattcctgcacaatgggaagaggagaatggtgtggatatggttctgagttatagtgtcttatttagatgctgtgaattattgatgtattacattatttgcttttctcaactgctagaggctaccccattttcctttccacaatcagagccatttttgttaaagtggcagttttttctgcaatctattgttccattccaatcatatccttctcgtttgagtactactaacgtttaaaaagggtcttgcccttgaataactaagtcatacaaatagaaggaaaaacaatggtgaattttggagagctccccagctctcagcaacttcatataagcatggtggtatcttaaaatggtggtttgcagaaaccatggtagccaacagaacctcctgactttcacctgcttttaacctgaaaatatattaatacgcctctgacatgagtccagggagaggcaagattgagcaatagtcagtggcaccatttcctaaagtaactgaatcaatcaatccagtcaggtaattattttctattggggaacttagaaaaaaaagtaaagcaagaaatattttctctcctttatgatcagtgataccttagagacttttcgaaagtccttgttaaagatagttacaatgtgtggttaaatgatgctaaaatattttcacaaccagagtagaaaacgtgctggaacaaaattgcgaaggcttttgcctcccagtaaatagaaaggaaaatatattctagtaggtaagactgctgactctttgaaaatctgaggtattttgaaaaattctgtgatagttgctattaataaaccaaaattgtatagaatcatcgttaatttttaatataaatcccattgacaaatgttgatgcactgtagtcactgctgagttaatagcg

SEQ ID NO: 16630 - DNA, 2623 bp, Homo sapiens
  ENST00000628926
gagctgacctgcgctgggctccggcgccgcaggcggctggggagggcggcgtgggagaggacgctgagacgcaggggcggccgcgccgaggtgacaagctgcgcacctggaaagttacccggctgtctggtccctgagcaaaatgggaaatggttcagtgaaacctaaacattctaagcacccagatggacactctgggaacctcaccactgatgctctgcggaacaaggtgacagagctggagagagagttgaggaggaaggatgctgagatccaggagcgggagtaccatttgaaggagctgcgggagcagctgtcgaagcagactgtggccattgctgaactcacagaggagctccagaacaagtgcatccagctgaacaagctgcaggatgtggtgcatatgcagggaggaagcccgcttcaggcctctccagataaagtgcctcttgaggtccaccggaagacctctggattggtctctctccatagcaggaggggagcaaaggctggcgtgtctgctgagccaacaacccggacctatgacctgaacaaaccccctgaattttcctttgagaaagcaagagtcagaaaagactccagtgagaagaagctcattacagatgcccttaataaaaatcagtttctgaaaagactggatcctcagcagatcaaagacatggtggaatgcatgtatgggagaaactatcagcaagggagttacattattaagcaaggagaaccaggaaaccatatctttgtgctggcagagggtcgactagaggtgttccaaggggagaaattgctgtcctccatccctatgtggaccacatttggggagcttgccattttatacaattgtacaaggactgcctctgtgaaagctattaccaatgttaaaacatgggcactagatcgagaggtattccagaatataatgaggaggacagcccaagctagagatgaacaatacagaaacttcctcagaagtgtatccttgctgaagaatttacctgaagataaattaaccaagatcattgactgcttggaagtggaatactatgacaaaggagattacatcattagagagggcgaggaaggaagtacctttttcattttggcaaaaggaaaggtaaaagtaacacagagcacagaaggccatgatcaaccacagctgataaaaacactgcagaaaggagaatactttggagaaaaagctcttatcagtgatgatgtcaggtcagctaacattattgctgaagaaaatgatgttgcatgcctggttatagatcgagaaacattcaaccaaactgtcggtacatttgaagagctgcaaaaataccttgaaggatatgtggcaaacctgaaccgtgatgatgaaaaaagacatgcgaagcggtccatgtctaactggaagctgtccaaagcactctctctggaaatgattcagctgaaggagaaggttaaagtaaaaaatgagaatgttgcttttgctatgaagtgtataaggaagaagcacatagttgacaccaagcagcaggagcatgtctactcagagaagaggatcctagaggagctgtgctctccattcattgtgaaattatatcgtactttcaaggacaataagtatgtatacatgcttctggaggcctgcttaggtggggagctctggagtatattaagggacagaggcagctttgatgaacccacctccaaattctgcgttgcttgtgtgacagaagcatttgattacctgcatcgactaggtattatctacagagacttgaaaccagaaaacttaattctagatgctgagggttaccttaaattggttgactttggatttgcgaagaaaatagggtctggacagaaaacatggacattctgtgggactccagaatatgtagctcctgaagtcattctcaacaagggacatgacttcagtgtggatttctggtcactgggaattctagtgtatgagctcctaacgggcaacccacccttttctggggttgaccaaatgatgacctacaatttgattctcaaaggaattgaaaaaatggattttcccaggaagataacacgacgacctgaggatttgattcggaggctttgcaggcaaaatccaacagaaaggctgggaaatctgaagaatggaataaatgacattaagaaacacaggtggttaaatggttttaattgggagggactgaaagcacggagccttccatcacctttgcaaagagagctcaagggacccatagatcacagctactttgacaaatatcctcctgaaaagggaatgcctccagatgagctatcaggctgggataaagacttctgacagaagaaaagttgattactgcctgtactctacagaagaggacctcaaggatcaataatccaacacattattttcttttcagagtattataatatctttggaagaccattagggaaaagaaattcctgcacaatgggaagaggagaatggtgtggatatggttctgagttatagtgtcttatttagatgctgtgaattattgatgtattacattatttgcttttctcaactgctagaggctaccccattttcctttccacaatcagagccatttttgtt

SEQ ID NO: 16631 - DNA, 1774 bp, Homo sapiens
  ENST00000509169
agactgctgtgctagcaatcagcaagactccgtgggcgtaggaccctccgagccaggaatactatgacaaaggagattacatcattagagagggcgaggaaggaagtacctttttcattttggcaaaaggaaaggtcctccactttggacagataaaggagcttctaccagtagagtcccatgcaattctgtttgaacactggctttggagtggaggccacaggaccccctaagaaataataacttcttagtgatgttatgtaaaagtaacacagagcacagaaggccatgatcaaccacagctgataaaaacactgcagaaaggagaatactttggagaaaaagctcttatcagtgatgatgtcaggtcagctaacattattgctgaagaaaatgatgttgcatgcctggttatagatcgagaaacattcaaccaaactgtcggtacatttgaagagctgcaaaaataccttgaaggatatgtggcaaacctgaaccgtgatgatgaaaaaagacatgcgaagcggtccatgtctaactggaagctgtccaaagcactctctctggaaatgattcagctgaaggagaaggtggccagattttcctcatcatccccattccagaaccttgagattattgcaacactgggcgttggtgggttcggaagagttgagcttgttaaagtaaaaaatgagaatgttgcttttgctatgaagtgtataaggaagaagcacatagttgacaccaagcagcaggagcatgtctactcagagaagaggatcctagaggagctgtgctctccattcattgtgaaattatatcgtactttcaaggacaataagtatgtatacatgcttctggaggcctgcttaggtggggagctctggagtatattaagggacagaggcagctttgatgaacccacctccaaattctgcgttgcttgtgtgacagaagcatttgattacctgcatcgactaggtattatctacagagacttgaaaccagaaaacttaattctagatgctgagggttaccttaaattggttgactttggatttgcgaagaaaatagggtctggacagaaaacatggacattctgtgggactccagaatatgtagctcctgaagtcattctcaacaagggacatgacttcagtgtggatttctggtcactgggaattctagtgtatgagctcctaacgggcaacccacccttttctggggttgaccaaatgatgacctacaatttgattctcaaaggaattgaaaaaatggattttcccaggaagataacacgacgacctgaggatttgattcggaggctttgcaggcaaaatccaacagaaaggctgggaaatctgaagaatggaataaatgacattaagaaacacaggtggttaaatggttttaattgggagggactgaaagcacggagccttccatcacctttgcaaagagagctcaagggacccatagatcacagctactttgacaaatatcctcctgaaaagggaatgcctccagatgagctatcaggctgggataaagacttctgacagaagaaaagttgattactgcctgtactctacagaagaggacctcaaggatcaataatccaacacattattttcttttcagagtattataatatctttggaagaccattagggaaaagaaattcctgcacaatgggaagaggagaatggtgtggatatggttctgagttatagtgtcttatttagatgctgtgaattattgatgtattacatta

SEQ ID NO: 16632 - DNA, 1640 bp, Homo sapiens
  ENST00000509474
agtttgagcttcctggctgctttgtttacctaagcaagcctgggcaatggcgggcgcccctccccgagcctcgctgctgccttgcagtttgatctcagactgctgtgctagcaatcagcaagactccgtgggcgtaggaccctccgagccaggaatactatgacaaaggagattacatcattagagagggcgaggaaggaagtacctttttcattttggcaaaaggaaaggtaaaagtaacacagagcacagaaggccatgatcaaccacagctgataaaaacactgcagaaaggagaatactttggagaaaaagctcttatcagtgatgatgtcaggtcagctaacattattgctgaagaaaatgatgttgcatgcctggttatagatcgagaaacattcaaccaaactgtcggtacatttgaagagctgcaaaaataccttgaaggatatgtggcaaacctgaaccgtgatgatgaaaaaagacatgcgaagcggtccatgtctaactggaagctgtccaaagcactctctctggaaatgattcagctgaaggagaaggtggccagattttcctcatcatccccattccagaaccttgagattattgcaacactgggcgttggtgggttcggaagagttgagcttgttaaagtaaaaaatgagaatgttgcttttgctatgaagtgtataaggaagaagcacatagttgacaccaagcagcaggagcatgtctactcagagaagaggatcctagaggagctgtgctctccattcattgtgaaattatatcgtactttcaaggacaataagtatgtatacatgcttctggaggcctgcttaggtggggagctctggagtatattaagggacagaggcagctttgatgaacccacctccaaattctgcgttgcttgtgtgacagaagcatttgattacctgcatcgactaggtattatctacagagacttgaaaccagaaaacttaattctagatgctgagggttaccttaaattggttgactttggatttgcgaagaaaatagggtctggacagaaaacatggacattctgtgggactccagaatatgtagctcctgaagtcattctcaacaagggacatgacttcagtgtggatttctggtcactgggaattctagtgtatgagctcctaacgggcaacccacccttttctggggttgaccaaatgatgacctacaatttgattctcaaaggaattgaaaaaatggattttcccaggaagataacacgacgacctgaggatttgattcggaggctttgcaggcaaaatccaacagaaaggctgggaaatctgaagaatggaataaatgacattaagaaacacaggtggttaaatggttttaattgggagggactgaaagcacggagccttccatcacctttgcaaagagagctcaagggacccatagatcacagctactttgacaaatatcctcctgaaaagggaatgcctccagatgagctatcaggctgggataaagacttctgacagaagaaaagttgattactgcctgtactctacagaagaggacctcaaggatcaataatccaacacattattttcttttcagagtattataatatctttggaagaccatta

SEQ ID NO: 16633 - DNA, 493 bp, Homo sapiens
  ENST00000456882
agcaatcagcaagactccgtgggcgtaggaccctccgagccaggaatactatgacaaaggagattacatcattagagagggcgaggaaggaagtacctttttcattttggcaaaaggaaaggtaaaagtaacacagagcacagaaggccatgatcaaccacagctgataaaaacactgcagaaaggagaatactttggagaaaaagctcttatcagtgatgatgtcaggtcagctaacattattgctgaagaaaatgatgttgcatgcctggttatagatcgagaaacattcaaccaaactgtcggtacatttgaagagctgcaaaaataccttgaaggatatgtggcaaacctgaaccgtgatgatgaaaaaagacatgcgaagcggtccatgtctaactggaagctgtccaaagcactctctctggaaatgattcagctgaaggagaaggttaaagtaaaaaatgagaatgttgcttttgctatgaagtgt

SEQ ID NO: 16634 - DNA, 3852 bp, Homo sapiens
  ENST00000545647
catcccaacaggaatactatgacaaaggagattacatcattagagagggcgaggaaggaagtacctttttcattttggcaaaaggaaaggtcctccactttggacagataaaggagcttctaccagtagagtcccatgcaattctgtttgaacactggctttggagtggaggccacaggaccccctaagaaataataacttcttagtgatgttatgtaaaagtaacacagagcacagaaggccatgatcaaccacagctgataaaaacactgcagaaaggagaatactttggagaaaaagctcttatcagtgatgatgtcaggtcagctaacattattgctgaagaaaatgatgttgcatgcctggttatagatcgagaaacattcaaccaaactgtcggtacatttgaagagctgcaaaaataccttgaaggatatgtggcaaacctgaaccgtgatgatgaaaaaagacatgcgaagcggtccatgtctaactggaagctgtccaaagcactctctctggaaatgattcagctgaaggagaaggtggccagattttcctcatcatccccattccagaaccttgagattattgcaacactgggcgttggtgggttcggaagagttgagcttgttaaagtaaaaaatgagaatgttgcttttgctatgaagtgtataaggaagaagcacatagttgacaccaagcagcaggagcatgtctactcagagaagaggatcctagaggagctgtgctctccattcattgtgaaattatatcgtactttcaaggacaataagtatgtatacatgcttctggaggcctgcttaggtggggagctctggagtatattaagggacagaggcagctttgatgaacccacctccaaattctgcgttgcttgtgtgacagaagcatttgattacctgcatcgactaggtattatctacagagacttgaaaccagaaaacttaattctagatgctgagggttaccttaaattggttgactttggatttgcgaagaaaatagggtctggacagaaaacatggacattctgtgggactccagaatatgtagctcctgaagtcattctcaacaagggacatgacttcagtgtggatttctggtcactgggaattctagtgtatgagctcctaacgggcaacccacccttttctggggttgaccaaatgatgacctacaatttgattctcaaaggaattgaaaaaatggattttcccaggaagataacacgacgacctgaggatttgattcggaggctttgcaggcaaaatccaacagaaaggctgggaaatctgaagaatggaataaatgacattaagaaacacaggtggttaaatggttttaattgggagggactgaaagcacggagccttccatcacctttgcaaagagagctcaagggacccatagatcacagctactttgacaaatatcctcctgaaaagggaatgcctccagatgagctatcaggctgggataaagacttctgacagaagaaaagttgattactgcctgtactctacagaagaggacctcaaggatcaataatccaacacattattttcttttcagagtattataatatctttggaagaccattagggaaaagaaattcctgcacaatgggaagaggagaatggtgtggatatggttctgagttatagtgtcttatttagatgctgtgaattattgatgtattacattatttgcttttctcaactgctagaggctaccccattttcctttccacaatcagagccatttttgttaaagtggcagttttttctgcaatctattgttccattccaatcatatccttctcgtttgagtactactaacgtttaaaaagggtcttgcccttgaataactaagtcatacaaatagaaggaaaaacaatggtgaattttggagagctccccagctctcagcaacttcatataagcatggtggtatcttaaaatggtggtttgcagaaaccatggtagccaacagaacctcctgactttcacctgcttttaacctgaaaatatattaatacgcctctgacatgagtccagggagaggcaagattgagcaatagtcagtggcaccatttcctaaagtaactgaatcaatcaatccagtcaggtaattattttctattggggaacttagaaaaaaaagtaaagcaagaaatattttctctcctttatgatcagtgataccttagagacttttcgaaagtccttgttaaagatagttacaatgtgtggttaaatgatgctaaaatattttcacaaccagagtagaaaacgtgctggaacaaaattgcgaaggcttttgcctcccagtaaatagaaaggaaaatatattctagtaggtaagactgctgactctttgaaaatctgaggtattttgaaaaattctgtgatagttgctattaataaaccaaaattgtatagaatcatcgttaatttttaatataaatcccattgacaaatgttgatgcactgtagtcactgctgagttaatagcgctttttaaagacatctgagtcatggatgtgtttataaatttagattgttaagacaggcaagccaccagaaaagtgataggatttcagaagtaaaagggacaacagcatccctcctatcccttccttgcactctcccaaataataagtaggatagtttcaatagcatgggacctagtacctaagaacttcactggtgaatggttgtatgtattgaccatgatcattcccttaccctccttccaaaatgaatgagaagcagagacttttctgtattttttaaatctagcagagtaaaaatactgtataagttccgggattattcaagcttctggttatattttcatatgttaatgttctatgtcaaaaggaacctctacccagtccccactcataatttcatcatccagaaaaaagccagctatatgcttccttaatgagttaagctagataagtgaagcccaatccagaaaggtgcatccttaacaaattagatttccacatttataatccttttgctgaaccaaagagtttttgtttcctggagctgtatttttaaagattatgtattgtacatagaataatcatttttaataggattgacataacctgcttaaagaatttctaagagtttttaaagatttttatttgaatttggttggtttgtactgtatgtttttccatgtatatatttttaaatttccaacctataaagatagaaaatttatgtattgggtggatattagaactatacagttataataggaatgatattctcaaagcagatcaatagttgtaatttttaaaaccctacatatatagaaataaccaagttagagtactacaggtttatttttcctgtgattgaccatgtcaatgtgttatcctcccatgtgattttttattgtttccttagagtactttaaaagatgaagaaatgagagactgaaccattgaataatcccaactccaccatttcctaactgagtgactctgggaaagtgatttagcttttttgagtactagctttctcattcatagaaaaaggcagagtaaagtaatatttacttagaggtttgtttcagggattaagttatgtagagagtcttttgcccggtatctgtgaaataaccattgctgcatagacgggagctactgttactgtctctattaaaattaaaggggccttaataaccatttagtcctgaatcttatgtatcattggtatctgtatgcagaattgtacttatcaaatccagtatctgtcttttttttcttttaaatcatgaagtaaaaatgattgaccaaaaacttcg

SEQ ID NO: 16635 - DNA, 4822 bp, Homo sapiens
  ENST00000264399
gagccggcagccccgggcccacgctgcgcaccgtgtgcacggcggggctggctgagctgacctgcgctgggctccggcgccgcaggcggctggggagggcggcgtgggagaggacgctgagacgcaggggcggccgcgccgaggtgacaagctgcgcacctggaaagttacccggctgtctggtccctgagcaaaatgggaaatggttcagtgaaacctaaacattctaagcacccagatggacactctgggaacctcaccactgatgctctgcggaacaaggtgacagagctggagagagagttgaggaggaaggatgctgagatccaggagcgggagtaccatttgaaggagctgcgggagcagctgtcgaagcagactgtggccattgctgaactcacagaggagctccagaacaagtgcatccagctgaacaagctgcaggatgtggtgcatatgcagggaggaagcccgcttcaggcctctccagataaagtgcctcttgaggtccaccggaagacctctggattggtctctctccatagcaggaggggagcaaaggctggcgtgtctgctgagccaacaacccggacctatgacctgaacaaaccccctgaattttcctttgagaaagcaagagtcagaaaagactccagtgagaagaagctcattacagatgcccttaataaaaatcagtttctgaaaagactggatcctcagcagatcaaagacatggtggaatgcatgtatgggagaaactatcagcaagggagttacattattaagcaaggagaaccaggaaaccatatctttgtgctggcagagggtcgactagaggtgttccaaggggagaaattgctgtcctccatccctatgtggaccacatttggggagcttgccattttatacaattgtacaaggactgcctctgtgaaagctattaccaatgttaaaacatgggcactagatcgagaggtattccagaatataatgaggaggacagcccaagctagagatgaacaatacagaaacttcctcagaagtgtatccttgctgaagaatttacctgaagataaattaaccaagatcattgactgcttggaagtggaatactatgacaaaggagattacatcattagagagggcgaggaaggaagtacctttttcattttggcaaaaggaaaggtaaaagtaacacagagcacagaaggccatgatcaaccacagctgataaaaacactgcagaaaggagaatactttggagaaaaagctcttatcagtgatgatgtcaggtcagctaacattattgctgaagaaaatgatgttgcatgcctggttatagatcgagaaacattcaaccaaactgtcggtacatttgaagagctgcaaaaataccttgaaggatatgtggcaaacctgaaccgtgatgatgaaaaaagacatgcgaagcggtccatgtctaactggaagctgtccaaagcactctctctggaaatgattcagctgaaggagaaggtggccagattttcctcatcatccccattccagaaccttgagattattgcaacactgggcgttggtgggttcggaagagttgagcttgttaaagtaaaaaatgagaatgttgcttttgctatgaagtgtataaggaagaagcacatagttgacaccaagcagcaggagcatgtctactcagagaagaggatcctagaggagctgtgctctccattcattgtgaaattatatcgtactttcaaggacaataagtatgtatacatgcttctggaggcctgcttaggtggggagctctggagtatattaagggacagaggcagctttgatgaacccacctccaaattctgcgttgcttgtgtgacagaagcatttgattacctgcatcgactaggtattatctacagagacttgaaaccagaaaacttaattctagatgctgagggttaccttaaattggttgactttggatttgcgaagaaaatagggtctggacagaaaacatggacattctgtgggactccagaatatgtagctcctgaagtcattctcaacaagggacatgacttcagtgtggatttctggtcactgggaattctagtgtatgagctcctaacgggcaacccacccttttctggggttgaccaaatgatgacctacaatttgattctcaaaggaattgaaaaaatggattttcccaggaagataacacgacgacctgaggatttgattcggaggctttgcaggcaaaatccaacagaaaggctgggaaatctgaagaatggaataaatgacattaagaaacacaggtggttaaatggttttaattgggagggactgaaagcacggagccttccatcacctttgcaaagagagctcaagggacccatagatcacagctactttgacaaatatcctcctgaaaagggaatgcctccagatgagctatcaggctgggataaagacttctgacagaagaaaagttgattactgcctgtactctacagaagaggacctcaaggatcaataatccaacacattattttcttttcagagtattataatatctttggaagaccattagggaaaagaaattcctgcacaatgggaagaggagaatggtgtggatatggttctgagttatagtgtcttatttagatgctgtgaattattgatgtattacattatttgcttttctcaactgctagaggctaccccattttcctttccacaatcagagccatttttgttaaagtggcagttttttctgcaatctattgttccattccaatcatatccttctcgtttgagtactactaacgtttaaaaagggtcttgcccttgaataactaagtcatacaaatagaaggaaaaacaatggtgaattttggagagctccccagctctcagcaacttcatataagcatggtggtatcttaaaatggtggtttgcagaaaccatggtagccaacagaacctcctgactttcacctgcttttaacctgaaaatatattaatacgcctctgacatgagtccagggagaggcaagattgagcaatagtcagtggcaccatttcctaaagtaactgaatcaatcaatccagtcaggtaattattttctattggggaacttagaaaaaaaagtaaagcaagaaatattttctctcctttatgatcagtgataccttagagacttttcgaaagtccttgttaaagatagttacaatgtgtggttaaatgatgctaaaatattttcacaaccagagtagaaaacgtgctggaacaaaattgcgaaggcttttgcctcccagtaaatagaaaggaaaatatattctagtaggtaagactgctgactctttgaaaatctgaggtattttgaaaaattctgtgatagttgctattaataaaccaaaattgtatagaatcatcgttaatttttaatataaatcccattgacaaatgttgatgcactgtagtcactgctgagttaatagcgctttttaaagacatctgagtcatggatgtgtttataaatttagattgttaagacaggcaagccaccagaaaagtgataggatttcagaagtaaaagggacaacagcatccctcctatcccttccttgcactctcccaaataataagtaggatagtttcaatagcatgggacctagtacctaagaacttcactggtgaatggttgtatgtattgaccatgatcattcccttaccctccttccaaaatgaatgagaagcagagacttttctgtattttttaaatctagcagagtaaaaatactgtataagttccgggattattcaagcttctggttatattttcatatgttaatgttctatgtcaaaaggaacctctacccagtccccactcataatttcatcatccagaaaaaagccagctatatgcttccttaatgagttaagctagataagtgaagcccaatccagaaaggtgcatccttaacaaattagatttccacatttataatccttttgctgaaccaaagagtttttgtttcctggagctgtatttttaaagattatgtattgtacatagaataatcatttttaataggattgacataacctgcttaaagaatttctaagagtttttaaagatttttatttgaatttggttggtttgtactgtatgtttttccatgtatatatttttaaatttccaacctataaagatagaaaatttatgtattgggtggatattagaactatacagttataataggaatgatattctcaaagcagatcaatagttgtaatttttaaaaccctacatatatagaaataaccaagttagagtactacaggtttatttttcctgtgattgaccatgtcaatgtgttatcctcccatgtgattttttattgtttccttagagtactttaaaagatgaagaaatgagagactgaaccattgaataatcccaactccaccatttcctaactgagtgactctgggaaagtgatttagcttttttgagtactagctttctcattcatagaaaaaggcagagtaaagtaatatttacttagaggtttgtttcagggattaagttatgtagagagtcttttgcccggtatctgtgaaataaccattgctgcatagacgggagctactgttactgtctctattaaaattaaaggggccttaataaccatttagtcctgaatcttatgtatcattggtatctgtatgcagaattgtacttatcaaatccagtatctgtcttttttttcttttaaatcatgaagtaaaaatgattgaccaaaaacttcg

SEQ ID NO: 16636 - DNA, 7218 bp, Homo sapiens
  ENST00000528056
gcacgcggccaccgagctggaggaggcggcgggcgtgagaccgggaatgcttggggcccccgccttcctcgcagccatccagcactcggtgcacgccccgcgaggccagcggctgctccctcccggggctattgctgctagtgccgtgagcaccgcccagccattgtctctgtgtctccgtcagccgtgccgagccgcgcacccagaggcgagggcgcgcatggggagcctccgttgatgctgccgcggctgccgcgccgccctccgaggctgcgtcccggggagtccggcttcccgagcgctccggcctggcccggcgccccggacctgagtgcctccccatggaggcgcccgggccggcccaggcggccgcggcggagagcaactcccgagaggtgacggaggatgccgccgactgggcgcccgcgctctgccccagccccgaggcgcggtcgccggaggcgcctgcctaccgcctgcaggactgcgacgcgctggtcaccatgggcactgggacgttcgggcgggtgcacctggtgaaggagaagacagccaagcatttcttcgccctcaaggtgatgagcattcccgacgtcatccgccggaagcaggagcagcacgtgcacaatgagaagtctgtcctgaaggaagtcagccacccgttcctcatcaggctgttctggacgtggcatgaggagcgcttcctctacatgctcatggagtatgtgccgggtggcgagctcttcagctacctgcgcaaccgggggcacttctccagcaccacggggctcttctactctgcggagatcatctgtgccattgagtacctgcactccaaggagatcgtctacagggatttgaagccggagaacatcctgctggatagggatggtcacatcaagctcacggactttgggtttgccaagaagctggtagacaggacttggaccctctgtggaacacccgagtacctagcccccgaagtcattcagagcaagggccacggaagggccgtggactggtgggccctcggcatcctgatattcgagatgctttcggggtttcctccattttttgatgacaacccgtttggcatttatcagaaaattcttgcaggcaaactatatttccccagacatttggatttccatgtaaaaacggggcgaatgatgtgaaacaccatcggtggttccgctccgtggactggaaagctgttccgcagagaaaactgaagcctcccatcgtgcccacgatagctggcaacggcgacacttccaacttcgaaacttaccctgagcatgactgggacacagccgcgcccgtgccgcagaaggatttagaaatcttcaagaatttctgaggacgagctcacatctggaagaaacaggaagattggaatctgcctggaacaaagaactgcacctaagcagaccagaagcaaaatgtcttcttcacggcctgaggacatttccagttttctctgtacctgtgtgtatagaaatagatcagagcacagttgaaattcatggaactggcattatttaagcaaccagaattccacactgtaggaaggttttgaaaattgtttcgttatagattttatcttatcttttggtgttgtcttggtttttctcatagactttataagtttgaactggacttatttgattataaccacaaattgtgtgtgtgtgtgtgtgtgtatatatagaagtcattatggcagatgcacaaattgtgcagtgatgtaaatatacatacttcacagagcctattatttttatttttcaattcagtttctcaaattatcttcccttctcttggggacaacatctgaagggtatgttgcatgcatttttaaaaaaatcatctcatatgcattgtatagtttgggggaataagatatccgggggccgggggtgtctacattcagtatctttagttcttcctacctagtaacttgagactttaaaagaagaaacatggagaagatgtgggagcgaatttattgcaggaatccacaatgactttgaagttgttggagcaatgcattgtattcagaaaacctgtgtcacattaaaaaatttcatctaggctaggtgcagtggcttgttcctgtagtcccagcactctgggaacctgggttgggaggattgcttaaggccaggagtttgagaccagcttgggcaacatagtgaaaccctgtctgtatggaatttacacaaattataaaaattagtcgggtgtcattgtgcatacctgtagtcccagctattcaggagctgtggtaggaggatggcttgagctcaagaggttgaggctgcagtgagccctgattgtgccagtgcactccagcctggacgacagagcaagaccctgtattaaaaaaaaaattcatcctgcacagggaaatggctacctattaaagtcccagttgaaattttttgaaaaaatacacctcccacagttcacaaataacttttaagatcagctcatctataaggctgaccttcatgcagagattttatttcacctttagttttgggaaaagcgagaaacagatgatctataggatgtgagtgggtggcagagtcaaaaggaacctcacctgttcctaatttctccttttaaatattcatgttgagtgtgcctaatactctcctcgacaagtcatgctgttttatgcagaataatccaggcgtgagagtgttctcttgggaaatgactggggagacacctgaaaggagcaacctccagatgttcttccctgggtgttgatgtcatgacagccatacagtgagtttgttctgaaacatctcttgctaaatgtgggtcatgctagacacagcataaactgagggtgtgggttctggctttgtacataactcattttctcccttgctttttctctggaccatcctggctggaaacttggctgtagacatctgaagagggtgcaccttttctctttactgtgactcacctcaaatatggcattgctcaaatctgctgtgtatgaggtcacagggcccagctgtggcaggggtgagtgcattgaagaagtaggttttggagccttccaggaattccttgttgacaacaggggtacactcacacagacctccaagactttcttctccacctcttctttttctcatgccctgccttcatctgtctccttctgcacccagagtaggggtggagtatacccttgccatgtgttagtgaaaatgtgtgcagtgagaagccagttgggtcccctcggctcctaatctcttctcaaaactcagtagctcaggttctctggagccatccggtgcattccttgctattggagctgtttttccaagcaatatctgggaagagatttctccctctagcacttgctacctctcttctgcacacatatcacacatcagtactgtggagagtttctgttaggaaaagccatacatttttaaaaatgtagcaaaatgtcaagggaaatgtaatcagatttggccagagttcgcctacagataagaaggcactgggccaggctcacacctgtaatcctaagtaacactttgggaggctggggcgagaggattgcttgagcccaggagttcaatacctgtctgggaaacacctcatctctacaaaatacaaaaaagttaactgggcatggtggagcatgcctgtagtctcagctactcaggaggctgagatgagaggatcacttgagcctgaggaggtccaggccacagtgatctgagatcacaccattgccctccagcctgggtgacagagtgagaccctgttccaaaaaaaaaaaaaaacccaaaaaacctcaatggctttttgcttttgaaggtggtatgaagagaacgtccactttaaggctttaaaagacagtgaagctggttgtagggctcacttttataatcctaggatttggggaagctgaagcagaaagattgcttgagcctgggagtttgagactggcctgggcagcatagcgagaccccatctctatataaaaaaaaagatgttaaaacagtgaaattacagaaacagaacatagccaccctgtttcatcagtgaccttttcttcacgtgacggtcaactcagtaggtgagaataattagtaggttcagcagaataaactctttacaattaataactcagtggaaaatgatgttcagatggtgaaatgtggaaatgttttagacaactctattttcagcctgtgcttctcactcaccatcctgttgggattaacagttgagggccatcgctgcctaaacatttagcgtgcggtttcccatcagttttactgtgaatgtgaaaaggtgaaactgttgctgacttcggcagcaggtatactaaaattggaatgacacagaggagattagcatggccccctgcgcgaggaagatccgcagattcatgcagcattccatatttttttaaaaaaaggttacactgtgcaccgacgtggagctagaaggaaaagcatgaagtctcatgtttgctgactataaaaataaatcatagtaataatattattgaacattctactttaaaaattattaataaaaccataaatgaaacacttgagcacactttaaaaagtacataaacccatgagtccatatgtgtaattttatgttgtctgttttattatccaggatttcatactcagatgagcattagcatcaggaaagcctgaaatgccttaattgtgaactgatacgcaggaaaatgaaatatgtaagcacattggtgaccttgttctttacagacatcatgatcagcctccagccatacagaacaaatgagaaattagaagcaattccaagaacgtgtgatggtgtgaaacccacttttgaccgtcacacacatttcagcatttgaagagacacaggctacctggaaactgcccatggcggggtcataatttaaatgtcccaatgtcatatagaggttaatttaatcaaaatgagctaaaacatggaacaatcactgaataatttaaaaagagtttacctggcagagtgtgtcatgcctgcaatcccagcactttgggaggccaaggcaggcagatcacctgaggtcaggagtttgagaccagcctggccaacatgatgaaacccttgtctctattaaaaacacaaaaattagccagatgtggtggcacatgcctgtaatcccagttagtcgggaggctgaggcaggagaatatggaactcaggaggcggaggctgcagtcaaccaagattgcgccactgcactccagccagggcgaaggagtgagactcccatctcaaaaaataaaaaaaaaaataaataaaaatagttgacccgggtgggcattccaaaatgttcccatagatgatcgtgaaacaatcactgtgcaaaatgtagaggaaaattcttacgataatcacaaaatttgtatcagaaaaacattacaaatttactttgctccatgtaattttatgaattggcagtattttcttaaattgggatacagtaagagaatatctttaggaaatggaaatgttaaaacaagaagtaacaagaggttgtttttctgaagggaaatgccaccggcctgctttcataggcattgataaagccaggaaggaaataaagtcacaaccgaatagtatacactgtatctactgaattcttctaattccttcacaacagaagtctaaatcctgcttagcctaaacatatctatagccagcgatgggcaaattatatttgctgtcagcatgatggaataagaaacagaaaccccccagcagtggggtaagattgcacgcttcatcccctcaaaatgcagttcagccccactccctctccatgcccatcaaacaactgcaaaatcacttgttactgaatttctcattcagcgttttgtttctttctgtccatacttaaagaccaaattatttgtttgctttgaagaaaaagcaaaagcaacaaaaacaccaaatcatttgaaatcactacccattaaaaaaaatcaccagtggaactaaacagttgagtggtttgggatgtgttgttcgccatttctgtgtttgacctacatggtctctagttctttggacaattgtaactgtgaaactatggcttaacactgttaaagactccaaggctccactctgtagccaggtgcaactcaggctgcacaaataccccaccagaatgtcacaatcattcattgctccagctgctgagtgaacagagtgcaagacagcactggcttgggttttatttttgcagccagttaactttgcatcaggtctacacagtccttgcagcctttgatttctccagttgtacagatttgaaatggggtgcccgggttcctctcgtttttccttcaatctacctagcatgcattttacacacattggaggagtcgtatgcactgtttttctcttgctgatggaggcaagaacgccttctaattagtataacttaaatggacgggattcacttaaaagcaagaagaaaagcacatgaacaggtgtcttaatgcatttggatactttggggtgtgtgcctgtctgtgtgtgtgtcttggtgaaggtgggctgtattttcaccaagccttttcataatcaagtttgctttgcaaaccatctggccttgcccccagcagtacagtccttcctaataacggggatgctctgtcatgtttctctgtaaattgttgtgtgttgggaagttctgttgaggcttagtttgatcttccatggtggacatgtctgttctgtatataaaaagcattacatctgtgttttagcaggtgggatttgaagcttttccacagtccttgtgctctgagatggctgttgagctctgctcagctgtcacagctgaattctttttttgtgctgaacactgggcagcctcaccttgttgccaacgtgcttctggggcccctgtgactgctgccggatgctgtgcacacaggcagagtgccttggcaggtttgtgcaccccttggcgagccagaactgggaaccccgcggagtgaccccaccttctcatggggggtcagggaggggagtgcctatttttaatcttgtttgttgcgcaatggaaatcactgtgatttgtacatatgccctaggaaaattttaccgctgtctaatttatgtaataatactgatgattctaggtttgtttaataaaactttatatcttttcagaag

SEQ ID NO: 16637 - DNA, 1019 bp, Homo sapiens
  ENST00000533551
atggaggcgcccgggccggcccaggcggccgcggcggagagcaactcccgagaggtgacggaggatgccgccgactgggcgcccgcgctctgccccagccccgaggcgcggtcgccggaggcgcctgcctaccgcctgcaggactgcgacgcgctggtcaccatgggcactgggacgttcgggcgggtgcacctggtgaaggagaagacagccaagcatttcttcgccctcaaggtgatgagcattcccgacgtcatccgccggaagcaggagcagcacgtgcacaatgagaagtctgtcctgaaggaagtcagccacccgttcctcatcaggctgttctggacgtggcatgaggagcgcttcctctacatgctcatggagtatgtgccgggtggcgagctcttcagctacctgcgcaaccgggggcacttctccagcaccacggggctcttctactctgcggagatcatctgtgccattgagtacctgcactccaaggagatcgtctacagggatttgaagccggagaacatcctgctggatagggatggtcacatcaagctcacggactttgggtttgccaagaagctggtagacaggacttggaccctctgtggaacacccgagtacctagcccccgaagtcattcagagcaagggccacggaagggccgtggactggtgggccctcggcatcctgatattcgagatgctttcggggtttcctccattttttgatgacaacccgtttggcatttatcagaaaattcttgcaggcaaactatatttccccagacatttggatttccatgtaaaaacggggcgaatgatgtgaaacaccatcggtggttccgctccgtggactggaaagctgttccgcagagaaaactgaagcctcccatcgtgcccacgatagctggcaacggcgacacttccaacttcgaaacttaccctgagcatgactgggacacagccgcgcccgtgccgcagaaggatttagaaatcttcaagaatttctga

SEQ ID NO: 16638 - DNA, 480 bp, Homo sapiens
  ENST00000495163
aggagatcgtctacagggatttgaagccggagaacatcctgctggatagggatggtcacatcaagctcacggactttgggtttgccaagaagctggtagacagacagggtctcatcctgtcacccaagctgaagtgccgttgcacaatcttgtctcactacagcctcaaactcctcggctcaagtgatcctccctcctcagcctctgaagtagctgggactacaggcatgtgccaccataccaggctaatttttttatttttaattttagagatgtgatctcactttattgctcaggctggtcttgaactcttggccccaagatatcgtcccacctcagcttcccaaagcactggaattagaagcatgtgccactgtgcctggccaattctatttttgaatttaacatttttagcaccagacagttgttaaatcagtatcattttattatttgtttatttatttagatggagtctcactc

SEQ ID NO: 16639 - DNA, 288 bp, Homo sapiens
  ENST00000472666
accttccaaagtgttgggattacaggtgtgagccaacgcaccaggtcttgaataacatttttgaacgtttcccagaaaggacttggaccctctgtggaacacccgagtacctagcccccgaagtcattcagagcaagggccacggaagggccgtggactggtgggccctcggcatcctgatattcgagatgctttcggggtttcctccattttttgatgacaacccgtttggcatttatcagaaaattcttgcaggcaaactatatttccccagacatttggatttcc

SEQ ID NO: 16640 - DNA, 1204 bp, Homo sapiens
  ENST00000452611
atttctgcaccagggaggcttgctgtttgaatgtgtgccaggttgaatggagtctctggcttcagatggattcaagctgaaagaggtttcttctgtgaacagccccccctcccagcccccccagcccgtcgtccctgctaagcccgtgcaatgcgtccatcatgtgtccactcaacccagctgcccaggacggggcaagatgtccaagctgctgaacccagaggagatgacctcgagagattattacttcgactcctatgcccactttgggatccacgaggaaatgctgaaggatgaggtgcggactctcacttaccggaactccatgtaccacaacaagcacgtgttcaaggacaaagtggtactggatgtggggagtggtactgggatcctttccatgttcgctgccaaggcaggggccaagaaggtgtttgggatcgaatgctccagtatttctgactactcagagaagatcattaaggccaaccacttggacaacatcatcaccatatttaagggtaaagtggaagaggtggagctgcctgtggagaaggtggacatcatcatcagcgagtggatgggctactgtctgttctatgagtccatgctcaacacggtgatctttgccagggacaagtggctgaaacctggagggcttatgtttccagaccgggcagctttgtacgtggtagcgattgaagacagacagtacaaggacttcaaaatccactggtgggagaatgtctatggctttgacatgacctgcatccgggacgtggccatgaaggagcctctagtggacatcgtggatccaaagcaagtggtgaccaatgcctgtttgataaaggaggtggacatttacacagtgaagacggaagagctatcgttcacatctgcattctgcctgcagatacagcgcaacgactacgtccacgccctggtcacctattttaatattgaatttaccaagtgccacaagaaaatggggttttccacagcccctgatgctccctacacccactggaagcagaccgtcttctacttggaagattacctcactgtccggaggggggaggaaatctacgggaccatatccatgaagccaaatgccaaaaatgtgcgagacctcgatttcacagtagacttggattttaagggacagctgtgtgaaacatctgtatctaatgactacaaaatgcgttag

SEQ ID NO: 16641 - DNA, 2366 bp, Homo sapiens
  ENST00000382622
agttggcggctgcctccggccggccggactttgcgagcagcctggagaggatccgcgaccgccgccgccgccgccgcggaggcttcggggctgcttccctcgagcttagcccgcagcgcgggtggagaggggcggggagggggtcgggggcacgagaagaacttgaaaccgtgtgaaggaatccggagcagatgagaagggaggaaaataaaagaaagtggagactgcagaacagactccgctgtggctgactgtgccggccgacgctccagctgaggggctgggttggatttttttttttctcccatcctctcgctctctcttttaaagcgacaccagctctctctcctcctctactatctcggtatcaccaaacccttgccggctcttatgggcatgaaacactcctcccgctgcctgctcctgaggaggaaaatggcggagaacgcggccgagagcaccgaggtgaacagccccccctcccagcccccccagcccgtcgtccctgctaagcccgtgcaatgcgtccatcatgtgtccactcaacccagctgcccaggacggggcaagatgtccaagctgctgaacccagaggagatgacctcgagagattattacttcgactcctatgcccactttgggatccacgaggaaatgctgaaggatgaggtgcggactctcacttaccggaactccatgtaccacaacaagcacgtgttcaaggacaaagtggtactggatgtggggagtggtactgggatcctttccatgttcgctgccaaggcaggggccaagaaggtgtttgggatcgaatgctccagtatttctgactactcagagaagatcattaaggccaaccacttggacaacatcatcaccatatttaagggtaaagtggaagaggtggagctgcctgtggagaaggtggacatcatcatcagcgagtggatgggctactgtctgttctatgagtccatgctcaacacggtgatctttgccagggacaagtggctgaaacctggagggcttatgtttccagaccgggcagctttgtacgtggtagcgattgaagacagacagtacaaggacttcaaaatccactggtgggagaatgtctatggctttgacatgacctgcatccgggacgtggccatgaaggagcctctagtggacatcgtggatccaaagcaagtggtgaccaatgcctgtttgataaaggaggtggacatttacacagtgaagacggaagagctatcgttcacatctgcattctgcctgcagatacagcgcaacgactacgtccacgccctggtcacctattttaatattgaatttaccaagtgccacaagaaaatggggttttccacagcccctgatgctccctacacccactggaagcagaccgtcttctacttggaagattacctcactgtccggaggggggaggaaatctacgggaccatatccatgaagccaaatgccaaaaatgtgcgagacctcgatttcacagtagacttggattttaagggacagctgtgtgaaacatctgtatctaatgactacaaaatgcgttagcacacgtgggaagctgcagagagcaacgagaaaaggaactctcacctcgatctgccgtgccgtcccaaagaataccgtttgcaggactacacacttgaaaaccagagttttcaactctgccttgaagattggtgaactccccagggctcccgtgggctctgccactggacagaaggcctccagctcctccgctctgccctggtagcccttcacgaaggctttgtgttgccaacaaagagcgacctggcgtgctgtggctgggccccgagggtggaaacgtattcgcgtctccccgtctcctccttaactgtgactctccgggtcttctgagttttgcatgctgcgggtgtctaggacagattgcttccactagaacctggagacatagcatctttgatagcataagccagattatctgtgtgtgcggtggtgtgcgtgtgcgtgcatgtgtgaatgtgagcagcatagttgatatttacccacaaacacctgtatatgcgtgcatatacaaccaagtgggtagacctaggtgttctctcagaggggtgtgtgtgtgtgtgcgtgcgcgtgtgcctagaatatatattactctcagaggagattctgttgcttttgaataggaatttgttttgtgattagttcgccccttccccaccccttaccagatgttaagcagctatgaaacattctctgtactagttctggtctccttttgactggactgtggctctgaaccttgagcatagtaccacggactccgtgggcgctcaataaacacacatgagaacaaa

SEQ ID NO: 16642 - DNA, 5899 bp, Homo sapiens
  ENST00000543701
ccggactttgcgagcagcctggagaggatccgcgaccgccgccgccgccgccgcggaggcttcggggctgcttccctcgagcttagcccgcagcgcgggtggagaggggcggggagggggtcgggggcacgagaagaacttgaaaccgtgtgaaggaatccggagcagatgagaagggaggaaaataaaagaaagtggagactgcagaacagactccgctgtggctgactgtgccggccgacgctccagctgaggggctgggttggatttttttttttctcccatcctctcgctctctcttttaaagcgacaccagctctctctcctcctctactatctcggtatcaccaaacccttgccggctcttatgggcatgaaacactcctcccgctgcctgctcctgaggaggaaaatggcggagaacgcggccgagagcaccgaggtgaacagccccccctcccagcccccccagcccgtcgtccctgctaagcccgtgcaatgcgtccatcatgtgtccactcaacccagctgcccaggacggggcaagatgtccaagctgctgaacccagaggagatgacctcgagagattattacttcgactcctatgcccactttgggatccacgaggaaatgctgaaggatgaggtgcggactctcacttaccggaactccatgtaccacaacaagcacgtgttcaaggacaaagtggtactggatgtggggagtggtactgggatcctttccatgttcgctgccaaggcaggggccaagaaggtgtttggggtgagcacgccgcttcctcctgcatgctggcttccacagagccagcctcttgccctctgcctccacccgcccttctagaagtacaaaatttggtccatctcttttgctggggtcacaccttcgaggagtagaagaaatcaggtgtgactctcaggaaggggagcaggctgcctgtcccctgtgcatggctcctggatccttacaaccactgacatttgcggaggaactgtggctttcctgagaccattccaatgtcatcatgacctttcagtgcttagccccaaggtcagcttcagaggcagtgcaggtggttactcgggggagctctggtttgaatctctgcatttccattcactaggcatgtgaccttggactattcacttccctgcacctcactttttctccatctataaaatgagcttaatagcagtcccttgcccatagggtgattgtgaggattaaatgagtataatacatatgtaaagtgcttaaaacagtgcccagcatatggcaaatgctcggcgtctattattatagttgagatggggccctagagataatgggaacatctccttcttgttttctttagagggcaagtcggtcaacttaaattctgttgctttggctgtggcagcgtttccaggctagatgtggaggctgaccctctgggaagcctcctacctatcccctggctctcccaaggcagctttgcccagcctgatgacagagggcctgggaaggtccagagctggaaagaaactaaaaagaagagctgcgagatgctggctgatatttgaaaaatgcagtgggcccagggctggagcacaagcattcatcttggtcaaaatgaaaggcaaaccacaatgagattcccagtctgcatgtgagccggcccatttgcagaggcctcagcgacctgagcagcattcagtgggtctttgctcccatgcatttggttgggccatcccatagccagccctggggacccccccccgcccactgactcccaggttgactagatccccctagatcctcctggccacctgctgcctccagaggtctgctcctaagtcacccagcagggcagcattcctcctccaagcctgacttggaaaacccttgggccatggctgccgagggtcttctggaagcttgggctgccctcaagctgcctcaggtgcagctttgaccaggaaaagctgtgacgttctcagccgaggcacttgctgagggcaggggcccatccggaggcccaagggcaggtcatgtcatcatcactggtataactgctggttctccaggatggagacctcaggcaagggtcttagtgaggtcacagggcatcagagctggacttgagtcctctggtgacccccacgtgctttctttcccagcaccgaggccccgtctcagtgccggccttggtgggggacagggctgagcatggtgtccctggcgcctgagtcatccgggggctccagccaaggagctgtcaggaggaggctcccacttggcgccttccagctgcggtgacttggcgcgatctgtctgcctcccgcccttttctctaacagctcttttataaatggctccaccacatttagctgggctcctttccggatggctcatttcacagtttctcctgttccagacccccttccacccactgctgtcctccagtggggagacgagatggcgggagagagagacagagagagagggagggaggaagaccatcgtcccagagtggagacaggcacagagaaagagacagatgtgacaagagcaatggagaggagacagagacagagaaaggtgcagagaaaagctagagaaatgggagaggggcctggaaaagcagaaagaagacaaagtagaaagcacaaaagaaaagaatcggcagaggctggtggatcacctgaggtcaggagttcaagaccagcctggccaacatggcgaaaccctgtctctactaaaaatacaaaaattagccgggcatggtggcgggtgcctgtaattccagctacttggagactgaggctggagaatcgcttgaacccgggaggcggaggttgcagtgagtccagatcgcgccattgcactccagcctgggcgacaaagtgagattttgtctcaaaaaataagaatcagaaaagtgaagacaggtggtaaagagagaagagggaagaaatggaagaggagaagatggaagaaaggaaaatgaggagggaaggacaccgccccgcactctgagtgttgagcaagcttcggctgagtttaccctcacacactcacgtgcattgggggcttcgacttctctcgggaggacactgaggcgcagttaggaagggcagtggccaggcataaatccaggcctggctccgggtcgcatgctcctcatcactcaacatggtcgcctcttgcagatcagatgatgacatggccagagggggagaagaagaggagggaatcacaccccacagacagtgcagcctgaaggccagggacctggcagcccaggaaagggctggttctcctgggacctgcaccctggctggagtcggcctccttggatgcagctctaaccaagtgaccccttctgaccccgtaggtgccctcacccttcctcaaggcgtggccagaggcgtcagaaactccctcagtgcccctttgcgagtacttctcaagggaatggtccctgcccgaggcctgggggtagtctgaggggcccccaagtgtggaggtgagtagagcccagggccttagcacaggccagcctctgtaagagagccggctccggaggtgaggacggctcttggcagctgcccctccatgtccagaacccctggcagtgtgcctgagacgctaaccctgggctggagcttggcttccaaccattcccatgagggcctgctctcagggaaggtccactcatctctcaaataccttggccctttgcttaggaggtctggagagcctggaaagacgtctgaattaaaaggaataatttctttcaaagatgaagcggcgagagctaacgtggggggtgggaggggaagagaaagatcttaaaccagccctgaggtcttgacctggctttttccagatggtcccatcctggcacgcggctcgtttaccctggaagggctgggctgcggtggggaggatcatgtcgagggaggctcgcaactctggcttggatctgccttcccgcgtcccccacggtggggaggacgtactgcctcctgccattctctgctggccaggagcatgaggtctgccagccccttttgagtctccagcacagagatcaatccctccatcacgggtggtgactagacatcagtcttttcgcaaaggcagcccaatttcgtggaaggccgctggccttgaggtgggggggctgggtttcggttttcagtctgccacaaagttgtgatgcagccgtgggcaagtcaccacccctgtctgggcctcagcgtctctatccattgaatcggtgtgggtcttgctgtgattttttttgacgccttgctcctttgtcctatgccctttccagatcgaatgctccagtatttctgactactcagagaagatcattaaggccaaccacttggacaacatcatcaccatatttaagggtaaagtggaagaggtggagctgcctgtggagaaggtggacatcatcatcagcgagtggatgggctactgtctgttctatgagtccatgctcaacacggtgatctttgccagggacaagtggctgaaacctggagggcttatgtttccagaccgggcagctttgtacgtggtagcgattgaagacagacagtacaaggacttcaaaatccactggtgggagaatgtctatggctttgacatgacctgcatccgggacgtggccatgaaggagcctctagtggacatcgtggatccaaagcaagtggtgaccaatgcctgtttgataaaggaggtggacatttacacagtgaagacggaagagctatcgttcacatctgcattctgcctgcagatacagcgcaacgactacgtccacgccctggtcacctattttaatattgaatttaccaagtgccacaagaaaatggggttttccacagcccctgatgctccctacacccactggaagcagaccgtcttctacttggaagattacctcactgtccggaggggggaggaaatctacgggaccatatccatgaagccaaatgccaaaaatgtgcgagacctcgatttcacagtagacttggattttaagggacagctgtgtgaaacatctgtatctaatgactacaaaatgcgttagcacacgtgggaagctgcagagagcaacgagaaaaggaactctcacctcgatctgccgtgccgtcccaaagaataccgtttgcaggactacacacttgaaaaccagagttttcaactctgccttgaagattggtgaactccccagggctcccgtgggctctgccactggacagaaggcctccagctcctccgctctgccctggtagcccttcacgaaggctttgtgttgccaacaaagagcgacctggcgtgctgtggctgggccccgagggtggaaacgtattcgcgtctccccgtctcctccttaactgtgactctccgggtcttctgagttttgcatgctgcgggtgtctaggacagattgcttccactagaacctggagacatagcatctttgatagcataagccagattatctgtgtgtgcggtggtgtgcgtgtgcgtgcatgtgtgaatgtgagcagcatagttgatatttacccacaaacacctgtatatgcgtgcatatacaaccaagtgggtagacctaggtgttctctcagaggggtgtgtgtgtgtgtgcgtgcgcgtgtgcctagaatatatattactctcagaggagattctgttgcttttgaataggaatttgttttgtgattagttcgccccttccccaccccttaccagatgttaagcagctatgaaacattctctgtactagttctggtctccttttgactggactgtggctctgaaccttgagcatagtaccacggactccgtgggcgctcaataaacacacatgagaac

SEQ ID NO: 16643 - DNA, 2595 bp, Homo sapiens
  ENST00000261252
attctctttcctgtgaacctccagaacaatttgcttgaacttctcttgtagaacaaaccttattccagcatctatcagagacaataagggtcttagaatctagaaaacagggtcctgggagggcacagttcccacacgtctatttcttccacaggacctgcacgctgccttgctgttggagatctgtgcagtaggcagttgtggaattaaaagcaacaccccatgtcgctgaatgttcagggatcacaggccactgccgtttcccacccactcccagcctccggggagtcttagcctgtggagtcccaggaagcacatggaaaagagagccttggaaccagagtggagtgacagctaaggggtgctggaggcccctgtgaccttgaccatgcacaatgcccagaccagctccgactttttcctctccttcacatatttaaatggagtcgatattggggtcagcttcatgcacggagccttcttcagctttagaggtgaacagccccccctcccagcccccccagcccgtcgtccctgctaagcccgtgcaatgcgtccatcatgtgtccactcaacccagctgcccaggacggggcaagatgtccaagctgctgaacccagaggagatgacctcgagagattattacttcgactcctatgcccactttgggatccacgaggaaatgctgaaggatgaggtgcggactctcacttaccggaactccatgtaccacaacaagcacgtgttcaaggacaaagtggtactggatgtggggagtggtactgggatcctttccatgttcgctgccaaggcaggggccaagaaggtgtttggggtgccctcacccttcctcaaggcgtggccagaggcgtcagaaactccctcagtgcccctttgcgagtacttctcaagggaatggtccctgcccgaggcctgggggtagtctgaggggcccccaagtgtggagatcgaatgctccagtatttctgactactcagagaagatcattaaggccaaccacttggacaacatcatcaccatatttaagggtaaagtggaagaggtggagctgcctgtggagaaggtggacatcatcatcagcgagtggatgggctactgtctgttctatgagtccatgctcaacacggtgatctttgccagggacaagtggctgaaacctggagggcttatgtttccagaccgggcagctttgtacgtggtagcgattgaagacagacagtacaaggacttcaaaatccactggctactgggaaataaatggccagcagaaagaagaaaaaaaaatctaatcccttgggtgatctgtgctctgaatgattgaaggtggggcagtccagctgaggagataagacccaaattaacccatataaagggtgggagaatgtctatggctttgacatgacctgcatccgggacgtggccatgaaggagcctctagtggacatcgtggatccaaagcaagtggtgaccaatgcctgtttgataaagatacagcgcaacgactacgtccacgccctggtcacctattttaatattgaatttaccaagtgccacaagaaaatggggttttccacagcccctgatgctccctacacccactggaagcagaccgtcttctacttggaagattacctcactgtccggaggggggaggaaatctacgggaccatatccatgaagccaaatgccaaaaatgtgcgagacctcgatttcacagtagacttggattttaagggacagctgtgtgaaacatctgtatctaatgactacaaaatgcgttagcacacgtgggaagctgcagagagcaacgagaaaaggaactctcacctcgatctgccgtgccgtcccaaagaataccgtttgcaggactacacacttgaaaaccagagttttcaactctgccttgaagattggtgaactccccagggctcccgtgggctctgccactggacagaaggcctccagctcctccgctctgccctggtagcccttcacgaaggctttgtgttgccaacaaagagcgacctggcgtgctgtggctgggccccgagggtggaaacgtattcgcgtctccccgtctcctccttaactgtgactctccgggtcttctgagttttgcatgctgcgggtgtctaggacagattgcttccactagaacctggagacatagcatctttgatagcataagccagattatctgtgtgtgcggtggtgtgcgtgtgcgtgcatgtgtgaatgtgagcagcatagttgatatttacccacaaacacctgtatatgcgtgcatatacaaccaagtgggtagacctaggtgttctctcagaggggtgtgtgtgtgtgtgcgtgcgcgtgtgcctagaatatatattactctcagaggagattctgttgcttttgaataggaatttgttttgtgattagttcgccccttccccaccccttaccagatgttaagcagctatgaaacattctctgtactagttctggtctccttttgactggactgtggctctgaaccttgagcatagtaccacggactccgtgggcgctcaataaacacacatgagaacaaa

SEQ ID NO: 16644 - DNA, 3528 bp, Homo sapiens
  ENST00000322396
agcgtgcgccgctggccaggtgcgcaatagtggggtatgcgtcacggtctgcgccgcccgcggggccaggacggggcggagcttccgcctgggctggggttggcgagttcacccgcggcggagggtaactttgctgtgctgttttttgagcagttgtctggtccctggaagtgtagcatcgagagagttttctaattacgtttacaaaatatcttccctttggccatacaagtggtgactgccatgtcgaactcgcggcccaggtcccgccgagacgccgggggtggcgctggggcagccggccgggacgagctggtgtcgcggtccttgcagagcgcagagcactgtctgggcgtccaggacttcggcactgcctatgcccactacctcctcgtgctcagcctggcgccggagctgaaacacgacgtgaaggaaacttttcagtacacacttttcagatgggctgaagagcttgatgctctcagtcggatacaagacttacttggttgctatgagcaggccttggaactgtttcctgatgatgaagtgatttgcaatagtatgggggagcatctcttcagaatgggctttagggatgaagcagctgggtattttcataaagcagtgaagctaaaccctgatttcagtgatgcaaaggagaatttttatcgtgttgcaaactggttggtggaacgctggcactttatcatgcttaatgacaccaagaggaatacaatttataatgcagcaatccaaaaggcagtttgtttggggtccaaaagtgttttggacattggagcaggaactggaatactaagcatgtttgctaaaaaagctggagcacattccgtgtatgcctgtgagttatccaagaccatgtatgaacttgcctgtgatgtcgtggcagcaaacaagatggaagcagggatcaaactcttacatacgaagtcacttgacatagagattccaaaacatattcccgaaagagtgtccctagttgtaacagaaactgtcgatgcaggtttatttggagaaggaattgtggagagtttgattcatgcatgggagcatttacttttacagccaaagaccaaaggtgaaagtgctaattgtgaaaagtatgggaaagttataccagcaagtgctgttatatttgggatggcagtagaatgtgcagagataagaagacatcatagagtgggtattaaggacattgctggtatccatttgccaacaaatgtgaaatttcagagtccggcttattcttctgtagatactgaagaaacaattgaaccttatacaactgaaaagatgagtcgagttcctggaggatatttggctttgacagagtgctttgaaattatgacagtagatttcaacaaccttcaggaattaaaaagtcttgcaactaaaaagcctgataagattggtattcctgttattaaagaaggcatactagatgctattatggtttggtttgtgctccagcttgatgatgaacatagtttatccacaagtcctagtgaggaaacatgttgggaacaggctgtctaccccgtacaggaccttgcagactactggataaagcctggagaccatgtgatgatggaagtatcttgtcaagactgttacttaagaatccagagtattagtgtcttgggtttggaatgtgaaatggatgttgcaaaaagttttacccagaataaagacttgttatcgttaggaaatgaggctgaactttgtagtgccctcgctaaccttcagaccagtaaaccagatgctgtagagcagacatgtatattggaatctacagaaattgctttgcttaacaacatcccatatcatgaaggctttaaaatggcaatgagcaaagttttgtcttcactgactccagagaaactgtatcagaccatggatactcactgtcagaatgagatgagctctggaactggacagagtaatactgtacagaacatccttgaacctttctacgtgttagatgtgtccgaaggcttctctgttctgcctgttattgctggcacacttgggcaggttaaaccatacagttctgtggagaaagaccagcatcgtattgctctggacctcatatctgaagccaatcactttcctaaagaaacacttgagttttggctgagacatgtggaggatgaatctgctatgttacaaaggccaaaatcagacaagttatggagcataattatattggatgtcattgagccatctgggctcattcagcaggaaataatggaaaaagctgcaatatccaggtgtttactacaatctggaggcaagatctttcctcagtatgtgctgatgtttgggttgcttgtggaatcacagacactcctagaggagaatgctgttcaaggaacagaacgtactcttggattaaatatagcaccttttattaaccagtttcaggtacctatacgtgtatttttggacctatcctcattgccctgtatacctttaagcaagccagtggaactcttaagactagatttaatgactccgtatttgaacacctctaacagagaagtaaaggtatacgtttgtaaatctggaagactgactgctattccattttggtatcatatgtaccttgatgaagagattaggttggatacttcaagtgaagcctcccactggaaacaagctgcagttgttttagataatcccatccaggttgaaatgggagaggaacttgtactcagcattcagcatcacaaaagcaatgtcagcatcacagtaaagcaatgaagagcagttttccaatgaaaactgtgtaaatagagcatcaacaagtacaaaattcttgtcttaattagtgggggtatataaaaattccttgtaatggtcaaatattttttaaaattgacattaataaagcatattttaaaagattctaaataaaagggtagcattattatagaaatactgctgcagatttgctttctggaaaaggatacatcactagttttttaaattaggaaacttcttttgctcgattttacagaatagggattttaaaagtcttatcgttattgacatgtgtaagtaaagcaaaactttacttttgtaggcatcttggccttttttcttaaatccaaacttgtaattgggaaacactgaaaggcttccactgaagactgagggttatggttacctgtaaattccaatcttgcttcctttaaatactcagtgtacatctgaaacatctcaggttttgttttgagaatgcaagcttgaaaaagaatttaagctataagctaaatgtaattaaaacagtaaaggagttagggaatacatcttcaggaggcagcatttttcttggtctactttggcaaaagaacatttaaaagctggtaacaaaacaaagttaaattgaaggaagacttaatcctatactatttttcaaagttttgatttggatgtacaataagtacattaattgatccaatttttacaaacttttgaaataaaggaagatcattattatgcctccta

SEQ ID NO: 16645 - DNA, 2012 bp, Homo sapiens
  ENST00000510269
acaaatatcttagttgcttgctttttactttattacagggtgtttttttttttttttagtgagcagacattcttaattttattatagacctatttatagttgttttcctttatagttagtggttttatatgtgtgtgtattatgtagttatgtttaagaaatctttgctcatgaggttttatttcatttttgtatttttttctggactcagtattagatatgttacttgattctaaaaaaatccatcttcctacccctcccctattttctctctctccagagtgggtattaaggacattgctggtatccatttgccaacaaatgtgaaatttcagagtccggcttattcttctgtagatactgaagaaacaattgaaccttatacaactgaaaagatgagtcgagttcctggaggatatttggctttgacagagtgctttgaaattatgacagtagatttcaacaaccttcaggaattaaaaagtcttgcaactaaaaagcctgataagattggtattcctgttattaaagaaggcatactagatgctattatggtttggtttgtgctccagcttgatgatgaacatagtttatccacaagtcctagtgaggaaacatgttgggaacaggctgtctaccccgtacaggaccttgcagactactggataaagcctggagaccatgtgatgatggaagtatcttgtcaagactgttacttaagaatccagagtattagtgtcttgggtttggaatgtgaaatggatgttgcaaaaagttttacccagaataaagacttgttatcgttaggaaatgaggctgaactttgtagtgccctcgctaaccttcagaccagtaaaccagatgctgtagagcagacatgtatattggaatctacagaaattgctttgcttaacaacatcccatatcatgaaggctttaaaatggcaatgagcaaagttttgtcttcactgactccagagaaactgtatcagaccatggatactcactgtcagaatgagatgagctctggaactggacagagtaatactgtacagaacatccttgaacctttctacgtgttagatgtgtccgaaggcttctctgttctgcctgttattgctggcacacttgggcaggttaaaccatacagttctgtggagaaagaccagcatcgtattgctctggacctcatatctgaagccaatcactttcctaaagaaacacttgagttttggctgagacatgtggaggatgaatctgctatgttacaaaggccaaaatcagacaagttatggagcataattatattggatgtcattgagccatctgggctcattcagcaggaaataatggaaaaagctgcaatatccaggtgtttactacaatctggaggcaagatctttcctcagtatgtgctgatgtttgggttgcttgtggaatcacagacactcctagaggagaatgctgttcaaggaacagaacgtactcttggattaaatatagcaccttttattaaccagtttcaggtacctatacgtgtatttttggacctatcctcattgccctgtatacctttaagcaagccagtggaactcttaagactagatttaatgactccgtatttgaacacctctaacagagaagtaaaggtatacgtttgtaaatctggaagactgactgctattccattttggtatcatatgtaccttgatgaagagattaggttggatacttcaagtgaagcctcccactggaaacaagctgcagttgttttagataatcccatccaggttgaaatgggagaggaacttgtactcagcattcagcatcacaaaagcaatgtcagcatcacagtaaagcaatgaagagcagttttccaatgaaaactgtgtaaatagagcatcaacaagtacaaaattcttgtcttaattagtgggggtatataaaaattccttgtaatggtcaaatattttttaaaattgacattaataaagcatattttaaaagattct

SEQ ID NO: 16646 - DNA, 2674 bp, Homo sapiens
  ENST00000514886
agttcacccgcggcggagggtaactttgctgtgctgttttttgagcagttgtctggtccctggaagtgtagcatcgagagagttttctaattacgtttacaaaatatcttccctttggccatacaagtggtgactgccatgtcgaactcgcggcccaggtcccgccgagacgccgggggtggcgctggggcagccggccgggacgagctggtgtcgcggtccttgcagagcgcagagcactgtctgggcgtccaggacttcggcactgcctatgcccactacctcctcgtgctcagcctggcgccggagctgaaacacgacgtgaagaatgggctttagggatgaagcagctgggtattttcataaagcagtgaagctaaaccctgatttcagtgatgcaaaggagaatttttatcgtgttgcaaactggttggtggaacgctggcactttatcatgcttaatgacaccaagaggaatacaatttataatgcagcaatccaaaaggcagtttgtttggggtccaaaagtgttttggacattggagcaggaactggaatactaagcatgtttgctaaaaaagctggagcacattccgtgtatgcctgtgagttatccaagaccatgtatgaacttgcctgtgatgtcgtggcagcaaacaagatggaagcagggatcaaactcttacatacgaagtcacttgacatagagattccaaaacatattcccgaaagagtgtccctagttgtaacagaaactgtcgatgcaggtttatttggagaaggaattgtggagagtttgattcatgcatgggagcatttacttttacagccaaagaccaaaggtgaaagtgctaattgtgaaaagtatgggaaagttataccagcaagtgctgttatatttgggatggcagtagaatgtgcagagataagaagacatcatagagtgggtattaaggacattgctggtatccatttgccaacaaatgtgaaatttcagagtccggcttattcttctgtagatactgaagaaacaattgaaccttatacaactgaaaagatgagtcgagttcctggaggatatttggctttgacagagtgctttgaaattatgacagtagatttcaacaaccttcaggaattaaaaagtcttgcaactaaaaagcctgataagattggtattcctgttattaaagaaggcatactagatgctattatggtttggtttgtgctccagcttgatgatgaacatagtttatccacaagtcctagtgaggaaacatgttgggaacaggctgtctaccccgtacaggaccttgcagactactggataaagcctggagaccatgtgatgatggaagtatcttgtcaagactgttacttaagaatccagagtattagtgtcttgggtttggaatgtgaaatggatgttgcaaaaagttttacccagaataaagacttgttatcgttaggaaatgaggctgaactttgtagtgccctcgctaaccttcagaccagtaaaccagatgctgtagagcagacatgtatattggaatctacagaaattgctttgcttaacaacatcccatatcatgaaggctttaaaatggcaatgagcaaagttttgtcttcactgactccagagaaactgtatcagaccatggatactcactgtcagaatgagatgagctctggaactggacagagtaatactgtacagaacatccttgaacctttctacgtgttagatgtgtccgaaggcttctctgttctgcctgttattgctggcacacttgggcaggttaaaccatacagttctgtggagaaagaccagcatcgtattgctctggacctcatatctgaagccaatcactttcctaaagaaacacttgagttttggctgagacatgtggaggatgaatctgctatgttacaaaggccaaaatcagacaagttatggagcataattatattggatgtcattgagccatctgggctcattcagcaggaaataatggaaaaagctgcaatatccaggtgtttactacaatctggaggcaagatctttcctcagtatgtgctgatgtttgggttgcttgtggaatcacagacactcctagaggagaatgctgttcaaggaacagaacgtactcttggattaaatatagcaccttttattaaccagtttcaggtacctatacgtgtatttttggacctatcctcattgccctgtatacctttaagcaagccagtggaactcttaagactagatttaatgactccgtatttgaacacctctaacagagaagtaaaggtatacgtttgtaaatctggaagactgactgctattccattttggtatcatatgtaccttgatgaagagattaggttggatacttcaagtgaagcctcccactggaaacaagctgcagttgttttagataatcccatccaggttgaaatgggagaggaacttgtactcagcattcagcatcacaaaagcaatgtcagcatcacagtaaagcaatgaagagcagttttccaatgaaaactgtgtaaatagagcatcaacaagtacaaaattcttgtcttaattagtgggggtatataaaaattccttgtaatggtcaaatattttttaaaattgacattaataaagcatattttaaaagattct

SEQ ID NO: 16647 - DNA, 401 bp, Homo sapiens
  ENST00000511687
tttttgtactggaacaatgaaagttctaatgaaagccagccttagcttgatgtgggaatataaaggaggtaatgtaaaaagcattctgtcaagtactattgagtcaagtacaaagcaatccctgaccacaaaaggaatgtgtaaaagtgaaaaacttgagccctgaccacaaaaagaaaaagtgaaagtgaaaaatttatactttctctaggtacctatacgtgtatttttggacctatcctcattgccctgtatacctttaagcaagccagtggaactcttaagactagatttaatgactccgtatttgaacacctctaacagagaagtaaaggtatacgtttgtaaatctggaagactgactgctattccattttggtatcatatgtaccttgatgaag

SEQ ID NO: 16648 - DNA, 2657 bp, Homo sapiens
  ENST00000379440
gaatctcaactcgttttttccggtgactcattcccggccctgcttggcagcgctgcaccctttaacttaaacctcggccggccgcccgccgggggcacagagtgtgcgccgggccgcgcggcaattggtccccgcgccgacctccgcccgcgagcgccgccgcttcccttccccgccccgcgtccctccccctcggccccgcgcgtcgcctgtcctccgagccagtcgctgacagccgcggcgccgcgagcttctcctctcctcacgaccgaggcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacatgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcaccacc

SEQ ID NO: 16649 - DNA, 2539 bp, Homo sapiens
  ENST00000430350
cgcgcggcaattggtccccgcgccgacctccgcccgcgagcgccgccgcttcccttccccgccccgcgtccctccccctcggccccgcgcgtcgcctgtcctccgagccagtcgctgacagccgcggcgccgcgagcttctcctctcctcacgaccgagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacatgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcaccacc

SEQ ID NO: 16650 - DNA, 806 bp, Homo sapiens
  ENST00000424424
agtcgctgacagccgcggcgccgcgagcttctcctctcctcacgaccgaggcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacatgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttc

SEQ ID NO: 16651 - DNA, 855 bp, Homo sapiens
  ENST00000457586
gggggcaggggagccgcgggggccgagtgaggaccccgggcctcgggtcccaggcgcaagggtgcccggccgggcggggtcgggaccccagtgaggaggggccgggggctgccccgcgggcgcgtgacgcgtctcgggcctgcccggctgcgctggtctccgctcgggtgaggcggcttggcttcgcttttcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacatgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccag

SEQ ID NO: 16652 - DNA, 1348 bp, Homo sapiens
  ENST00000216968
cttctcttttccctagactgcagccagcggagcccgcagccggcccgagccaggaacccaggtccggagcctcaacttcaggatgttgacaacattgctgccgatactgctgctgtctggctgggccttttgtagccaagacgcctcagatggcctccaaagacttcatatgctccagatctcctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaagggagccaaacaagccgctcctacacttcgctggtcctgggcgtcctggtgggcagtttcatcattgctggtgtggctgtaggcatcttcctgtgcacaggtggacggcgatgttaattactctccagccccctcagaaggggctggattgatggaggctggcaagggaaagtttcagctcactgtgaagccagactccccaactgaaacaccagaaggtttggagtgacagctcctttcttctcccacatctgcccactgaagatttgagggaggggagatggagaggagaggtggacaaagtacttggtttgctaagaacctaagaacgtgtatgctttgctgaattagtctgataagtgaatgtttatctatctttgtggaaaacagataatggagttggggcaggaagcctatggcccatcctccaaagacagacagaatcacctgaggcgttcaaaagatataaccaaataaacaagtcatccacaatcaaaatacaacattcaatacttccaggtgtgtcagacttgggatgggacgctgatataatagggtagaaagaagtaacacgaagaagtggtggaaatgtaaaatccaagtcatatggcagtgatcaattattaatcaattaataatattaataaatttcttatatttaaggca

SEQ ID NO: 16653 - DNA, 642 bp, Homo sapiens
  ENST00000635377
cctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaagataatggagttggggcaggaagcctatggcccatcctccaaagacagacagaatcacctgaggcgttcaaaagatataaccaaataaacaagtcatccacaatcaaaatacaacattcaatacttccagatctctactaag

SEQ ID NO: 16654 - DNA, 442 bp, Homo sapiens
  ENST00000634509
gcctacaaccgcactcggtatgaactgcgggaattcctggaggacacctgtgtgcagtatgtgcagaaacatatttccgcggaaaacacgaaagatctctactaagaatgtcactctggccgggcgcagtggctcactcctgtaatcccagcactttgggaggccgaggcaggaggatcacttgaggttgggagttcgagaccagcatgaccaacatggaaaaaccccgtctctactaaaaatacaaaattagccaggcgtggtggtgcatgtctgtaatcccagctactcgggaggctgaggcaggagaatcacttgaacccgggaggcaggggttgcggtgagccgagatcacaccattgcactccagcctgggctacaagagcgaaactctgtctcaaataaataaataaataaaacaaaataaaaaataaagaatgtc

SEQ ID NO: 16655 - DNA, 3106 bp, Homo sapiens
  ENST00000491604
gtcccgccatggctctgaggcgcgccctgcccgcgctgcgcccctgcattccccgcttcgtcccgctgtccacggcgccggcctcccgcgagcagcccgcagcgggcccagcggccgtgccaggaggtgggtcggccacggcagtgcggccgccggtgcccgccgtggacttcggcaacgcgcaggaggcgtaccgcagccggcgaacctgggagctggcgcggagcctgctggtgctgcgcttgtgcgcctggcccgcgctgctggcgcgccacgagcagctgctgtatgtttccaggaaacttctaggacagaggctattcaacaagctcatgaagatgaccttctatgggcattttgtagccggggaggaccaggagtccatccagcccctgcttcggcactacagggccttcggtgtcagcgccatcctggactatggagtggaggaggacctgagccccgaggaggcagagcacaaggagatggagtcctgcacctcagctgcggagagggatggcagtggcacgaataagcgggacaagcaataccaggcccactgggccttcggggaccgcaggaatggtgtcatcagtgcccgcacctacttctacgccaatgaggccaagtgcgacagccacatggagacattcttgcgctgcatcgaagcctcaggtagagtcagcgatgacggcttcatagccattaagctcacagcactggggagaccccagtttctgctgcagttctcagaggtgctggccaagtggaggtgcttctttcaccaaatggctgtggagcaagggcaggcgggcctggctgccatggacaccaagctggaggtggcggtgctgcaggaaagtgtcgcaaagttgggcatcgcatccagggctgagattgaggactggttcacggcagagaccctgggagtgtctgggtgagagcagcccccaggctgagaggacacgagcatcagccatggttccagccaagccccagtgacgtctcccagtcctggctgccctgcctgagagggtgggccctgggatgacagtgctgaaggaactgcttttcacacagcaggacttgatggcttcaggagtccctgaggctggggctgggctgggcaggggagacacagggccagcacagaccccatagagggctctttatagaattatctgggtccagagcaaaggtggcactctcagccctccctggagtccacgccggcaggtgaaggatcagagccccatgccccatccttggagccaggggctgggacccagatcaccaggagcctccagttgaagtggggaggtgactggggtggtgcagtagtgagccatcccctcacacactgccagccttgcccactgtgtcctccctggccgcccggagctgtgtccgcctcctgcctggctgcctgtgctcggcccctccacaagcccaaaacagcctagggtactcagtgttttcagagccgcctagatgcaggactgtttgtgttttggttttaaatttatttaattaatttattttttatagagaccaggtctcaccatgttgcccaggctggtttcaaacccctgggctcaagtgacctgcccgccgcagcccccaaagtgctgggattataagtttgagcccccgcatgccactggttttaaatttttaaacagaaaacaatatttatatttcctctgtcttttaaaactgaacaccgaggtgggttttgtggtgggtggtgaacggacaggtttgggcctcgatcccccacccgaccctagcacccacaggtgggggtgccccctctgctgatgcgcctcctccctcagcaccatggacctgctggactggagcagcctcatcgacagcaggaccaagctgtccaagcacttggtagtccccaacgcacagacaggacagctggagcccctgctgtcccggttcactgaggaggaggagctacagatgaccaggatgctacagcggatggatgtcctggccaagaaagccacagagatgggcgtgcggctgatggtggatgccgagcagacctacttccagccggccatcagccgcctgacgctggagatgcagcggaagttcaatgtggagaagccgctcatcttcaacacataccagtgctacctcaaggatgcctatgacaatgtgaccctggacgtggagctggctcgccgtgagggctggtgttttggggccaagctggtgcggggcgcatacctggcccaggagcgagcccgtgcggcagagatcggctatgaggaccccatcaaccccacgtacgaggccaccaacgccatgtaccacaggtgcctggactacgtgttggaggagctgaagcacaacgccaaggccaaggtgatggtggcctcccacaatgaggacacagtgcgctttgcactgcgcaggatggaggagctgggcctgcatcctgctgaccaccgggtgtactttggacagctgctaggcatgtgtgaccagatcagcttcccgctgggccaggccggctaccccgtgtacaagtacgtgccctatggccccgtgatggaggtgctgccctacttgtcccgccgtgccctggagaacagcagcctcatgaagggcacccatcgggagcggcagctgctgtggctggagctcttgaggcggctccgaactggcaacctcttccatcgccctgcctagcacccgccagcacacccttagcctccagcaccccccgcccccgcccaggccatcaccacagctgcagccaaccccatcctcacacagattcaccttttttcaccccacacttgcagagctgctggaggtgaggtcaggtgcctcccagccctgcccagagtatgggcactcaggtgtgggccgaacctgatacctgcctgggacagccactggaaacttttgggaactctcctcgaatgtgtgggcccaaggcccccacctctgtgacccccatgtccttggacctagaggattgtccaccttctgccaaggccagcccacacagcccgagccccttggggagcagtggccgggctggggaggcctgcctggtcaataaaccactgttcctgca

SEQ ID NO: 16656 - DNA, 2034 bp, Homo sapiens
  ENST00000420436
cgtcccgccatggctctgaggcgcgccctgcccgcgctgcgcccctgcattccccgcttcgtcccgctgtccacggcgccggcctcccgcgagcagcccgcagcgggcccagcggccgtgccaggaggaaacttctaggacagaggctattcaacaagctcatgaagatgaccttctatgggcattttgtagccggggaggaccaggagtccatccagcccctgcttcggcactacagggccttcggtgtcagcgccatcctggactatggagtggaggaggacctgagccccgaggaggcagagcacaaggagatggagtcctgcacctcagctgcggagagggatggcagtggcacgaataagcgggacaagcaataccaggcccactgggccttcggggaccgcaggaatggtgtcatcagtgcccgcacctacttctacgccaatgaggccaagtgcgacagccacatggagacattcttgcgctgcatcgaagcctcaggtagagtcagcgatgacggcttcatagccattaagctcacagcactggggagaccccagtttctgctgcagttctcagaggtgctggccaagtggaggtgcttctttcaccaaatggctgtggagcaagggcaggcgggcctggctgccatggacaccaagctggaggtggcggtgctgcaggaaagtgtcgcaaagttgggcatcgcatccagggctgagattgaggactggttcacggcagagaccctgggagtgtctggcaccatggacctgctggactggagcagcctcatcgacagcaggaccaagctgtccaagcacttggtagtccccaacgcacagacaggacagctggagcccctgctgtcccggttcactgaggaggaggagctacagatgaccaggatgctacagcggatggatgtcctggccaagaaagccacagagatgggcgtgcggctgatggtggatgccgagcagacctacttccagccggccatcagccgcctgacgctggagatgcagcggaagttcaatgtggagaagccgctcatcttcaacacataccagtgctacctcaaggatgcctatgacaatgtgaccctggacgtggagctggctcgccgtgagggctggtgttttggggccaagctggtgcggggcgcatacctggcccaggagcgagcccgtgcggcagagatcggctatgaggaccccatcaaccccacgtacgaggccaccaacgccatgtaccacaggtgcctggactacgtgttggaggagctgaagcacaacgccaaggccaaggtgatggtggcctcccacaatgaggacacagtgcgctttgcactgcgcaggatggaggagctgggcctgcatcctgctgaccaccgggtgtactttggacagctgctaggcatgtgtgaccagatcagcttcccgctgggccaggccggctaccccgtgtacaagtacgtgccctatggccccgtgatggaggtgctgccctacttgtcccgccgtgccctggagaacagcagcctcatgaagggcacccatcgggagcggcagctgctgtggctggagctcttgaggcggctccgaactggcaacctcttccatcgccctgcctagcacccgccagcacacccttagcctccagcaccccccgcccccgcccaggccatcaccacagctgcagccaaccccatcctcacacagattcaccttttttcaccccacacttgcagagctgctggaggtgaggtcaggtgcctcccagccctgcccagagtatgggcactcaggtgtgggccgaacctgatacctgcctgggacagccactggaaacttttgggaactctcctcgaatgtgtgggcccaaggcccccacctctgtgacccccatgtccttggacctagaggattgtccaccttctgccaaggccagcccacacagcccgagccccttggggagcagtggccgggctggggaggcctgcctggtcaataaaccactgttcctgca

SEQ ID NO: 16657 - DNA, 2961 bp, Homo sapiens
  ENST00000313755
aatatttatatttcctctgtcttttaaaactgaacaccgaggtgggttttgtggtgggtggtgaacggacaggtttgggcctcgatcccccacccgaccctagcacccacaggtgggggtgccccctctgctgatgcgcctcctccctcagcaccatggacctgctggactggagcagcctcatcgacagcaggaccaagctgtccaagcacttggtagtccccaacgcacaggtaacacctccgctcctcagtgaggcccagctcagcagggcgctgcgctaagaagggaattcagcctgccacgtgtgtctcttgttgcctaccctgggaacttaacatgaccaaaatcactgcacactatggccccacagaccccctgtggtccagggggaagaagacaagcccactagtgtccacagagtgcttggcgggacagagacccacgcggagccttaagacaccacaaggagagggggtctgggggccttccccaagtcatctgtcttgtgcatcaggtcaccccaaacttcagaggcctgaaacggcagcagccactctgcttctgcctcatggttctggggttgacagggctcagctgggcagtcctcccctggggtctcctgggtagctgtactcacagagtggtggcgctgggacctgggggaggcacccattcacatgtctgggagttggtgctggctgtggcttgggctttttcccaacatggcagctgggctctaagggccagtgtcacctgagacgtgagagccaggcagaagctgggtgaccttttcctgcctcgcctcagaagtcacacggtgtcttttctggcaagttctgtttgttagaagcatgtcaccaggccagcctgtatacagcggggagaggaatgagactcatctgcctgtgggaggggggcccaggacctggcagactgcttgaaaccacagcttaaactgggattcaaagaaagaacagaagcaccttcagaaaacatcctgcagaggcagctttccatgacacatctagccccagtccactaagggcccagcctcaaacttagagcccccgacccagagcctcggggcgcagtgcgtacagtgtggctgtgcaccaaggccaccagctgttggagactttagcatggtgtagcaagggatagagtggtactgtttgtgcccagtgaggcaaggctgctggggccagcaaaggggtgagcgggaggccctgcgggatgggtccccacggcctctgagcaccagcaacttgaaggcctcatcctggtggttgccctggtccctggctacgtgtcagcacgtgctgcacaactgccctgtctgcctgtagccaggggtcttcctcctgggccctctgcctgctccgggtggagcccttctgtttgacgattgggtgatcagtgttcacttgttcaatgtcacatgggagttgcagggggctctcccacaacggtggggcctctgtgggaactggggagtacacacttcggagtgcaggcctggactgagcctggggcccactgacatgggcactgagctccctcgtggtacccctaggccccgcatagggcagtgcactggctgcgttggaggttcaggggcactgtgctgcttgtccaggtggccctccctcccagccctgcacagacgggtgagagggttcctgtgggctgggaatactgagagaggtttagcctgggcctcagggtggcactttcccgcccttgctgtggcctgaccgcgtgttgcacccccagacaggacagctggagcccctgctgtcccggttcactgaggaggaggagctacagatgaccaggatgctacagcggatggatgtcctggccaagaaagccacagagatgggcgtgcggctgatggtggatgccgagcagacctacttccagccggccatcagccgcctgacgctggagatgcagcggaagttcaatgtggagaagccgctcatcttcaacacataccagtgctacctcaaggatgcctatgacaatgtgaccctggacgtggagctggctcgccgtgagggctggtgttttggggccaagctggtgcggggcgcatacctggcccaggagcgagcccgtgcggcagagatcggctatgaggaccccatcaaccccacgtacgaggccaccaacgccatgtaccacaggtgcctggactacgtgttggaggagctgaagcacaacgccaaggccaaggtgatggtggcctcccacaatgaggacacagtgcgctttgcactgcgcaggatggaggagctgggcctgcatcctgctgaccaccgggtgtactttggacagctgctaggcatgtgtgaccagatcagcttcccgctgggccaggccggctaccccgtgtacaagtacgtgccctatggccccgtgatggaggtgctgccctacttgtcccgccgtgccctggagaacagcagcctcatgaagggcacccatcgggagcggcagctgctgtggctggagctcttgaggcggctccgaactggcaacctcttccatcgccctgcctagcacccgccagcacacccttagcctccagcaccccccgcccccgcccaggccatcaccacagctgcagccaaccccatcctcacacagattcaccttttttcaccccacacttgcagagctgctggaggtgaggtcaggtgcctcccagccctgcccagagtatgggcactcaggtgtgggccgaacctgatacctgcctgggacagccactggaaacttttgggaactctcctcgaatgtgtgggcccaaggcccccacctctgtgacccccatgtccttggacctagaggattgtccaccttctgccaaggccagcccacacagcccgagccccttggggagcagtggccgggctggggaggcctgcctggtcaataaaccactgttcctgc

SEQ ID NO: 16658 - DNA, 2567 bp, Homo sapiens
  ENST00000429300
ctcctggcctcaagcgaaccttacactttggcctcccaaagtgctgggattataggtgcatgccgctgcacctggcacttctgagcagtgcttggaagccgcctcctgatgggggctgagggtcagagtggccagctgaatgctgggccatcagggtgaggggcgtcttctcctcgtccattgcctgttctcccagggcaggtggaaggggaaggccctgcattggggtggcgtgaaacaagatgagatggtaagatctgctttcactttaaaggaacatttctggttgttgcttggaaagaagtgtcaggggcaagaatgctgcaggagggctggcctggaggacagggtgggactgcgggctggctgcacgggggcaggagcctgcgcttgcgtcagaggttcctgagagactcggtctctggggcagaggcctgagcaaggggacctcgctggggtgtctctgtcttagccacgctcggtgtttctgggtcctgtgacccacgtgtgagcagcctgtggtgctggtggcacagggaaggaaaccgaggcagggagcctgtgggggctgcttggcaggggacaggcagctcctgtgcccactgctgtcccacacctgcatggaaacagaaaccccgccacggagccccctcccatctccacagggcctctagagcgccatgtgcaaggacttcatgggcggggtggggtggggtcaggagcctgctgtgggctggccaggccctggccctccctgtcgcaccctgcgctgcctccatgcacctctcagggctgtcatggcttttcctgtggcttctgacaggtagagtcagcgatgacggcttcatagccattaagctcacagcactggggagaccccagtttctggtaagtgctagaaccttccacctgcagagtctggtgctgtgcgagatctcagggcagctgtgggcatccaccaaaaacacaggtgcccatgccttagaggcctgagctggccacaggggctgtgtgggggactggggtgggcaggggcgtgtgcagatggcattcaggcctgcgtttgcagctgcagttctcagaggtgctggccaagtggaggtgcttctttcaccaaatggctgtggagcaagggcaggcgggcctggctgccatggacaccaagctggaggtggcggtgctgcaggaaagtgtcgcaaagttgggcatcgcatccagggctgagattgaggactggttcacggcagagaccctgggagtgtctggcaccatggacctgctggactggagcagcctcatcgacagcaggaccaagctgtccaagcacttggtagtccccaacgcacagacaggacagctggagcccctgctgtcccggttcactgaggaggaggagctacagatgaccaggatgctacagcggatggatgtcctggccaagttgctcccactctcccaccccctgcgcctctcagaaagccacagagatgggcgtgcggctgatggtggatgccgagcagacctacttccagccggccatcagccgcctgacgctggagatgcagcggaagttcaatgtggagaagccgctcatcttcaacacataccagtgctacctcaaggatgcctatgacaatgtgaccctggacgtggagctggctcgccgtgagggctggtgttttggggccaagctggtgcggggcgcatacctggcccaggagcgagcccgtgcggcagagatcggctatgaggaccccatcaaccccacgtacgaggccaccaacgccatgtaccacaggtgcctggactacgtgttggaggagctgaagcacaacgccaaggccaaggtgatggtggcctcccacaatgaggacacagtgcgctttgcactgcgcaggatggaggagctgggcctgcatcctgctgaccaccgggtgtactttggacagctgctaggcatgtgtgaccagatcagcttcccgctgggccaggccggctaccccgtgtacaagtacgtgccctatggccccgtgatggaggtgctgccctacttgtcccgccgtgccctggagaacagcagcctcatgaagggcacccatcgggagcggcagctgctgtggctggagctcttgaggcggctccgaactggcaacctcttccatcgccctgcctagcacccgccagcacacccttagcctccagcaccccccgcccccgcccaggccatcaccacagctgcagccaaccccatcctcacacagattcaccttttttcaccccacacttgcagagctgctggaggtgaggtcaggtgcctcccagccctgcccagagtatgggcactcaggtgtgggccgaacctgatacctgcctgggacagccactggaaacttttgggaactctcctcgaatgtgtgggcccaaggcccccacctctgtgacccccatgtccttggacctagaggattgtccaccttctgccaaggccagcccacacagcccgagccccttggggagcagtggccgggctggggaggcctgcctggtcaataaaccactgttcctgc

SEQ ID NO: 16659 - DNA, 4676 bp, Homo sapiens
  ENST00000482858
cggtgcccgccgtggacttcggcaacgcgcaggaggcgtaccgcagccggcgaacctgggagctggcgcggagcctgctggtgctgcgcttgtgcgcctggcccgcgctgctggcgcgccacgagcagctgctgtatgtttccaggaaacttctaggacagaggctattcaacaagctcatgaagatgaccttctatgggcattttgtagccggggaggaccaggagtccatccagcccctgcttcggcactacagggccttcggtgtcagcgccatcctggactatggagtggaggaggacctgagccccgaggaggcagagcacaaggagatggagtcctgcacctcagctgcggagagggatggcagtggcacgaataagcgggacaagcaataccaggcccactgggccttcggggaccgcaggaatggtgtcatcagtgcccgcacctacttctacgccaatgaggccaagtgcgacagccacatggagacattcttgcgctgcatcgaagcctcaggtagagtcagcgatgacggcttcatagccattaagctcacagcactggggagaccccagtttctggtaagtgctagaaccttccacctgcagagtctggtgctgtgcgagatctcagggcagctgtgggcatccaccaaaaacacaggtgcccatgccttagaggcctgagctggccacaggggctgtgtgggggactggggtgggcaggggcgtgtgcagatggcattcaggcctgcgtttgcagctgcagttctcagaggtgctggccaagtggaggtgcttctttcaccaaatggctgtggagcaagggcaggcgggcctggctgccatggacaccaagctggaggtggcggtgctgcaggaaagtgtcgcaaagttgggcatcgcatccagggctgagattgaggactggttcacggcagagaccctgggagtgtctgggtgagagcagcccccaggctgagaggacacgagcatcagccatggttccagccaagccccagtgacgtctcccagtcctggctgccctgcctgagagggtgggccctgggatgacagtgctgaaggaactgcttttcacacagcaggacttgatggcttcaggagtccctgaggctggggctgggctgggcaggggagacacagggccagcacagaccccatagagggctctttatagaattatctgggtccagagcaaaggtggcactctcagccctccctggagtccacgccggcaggtgaaggatcagagccccatgccccatccttggagccaggggctgggacccagatcaccaggagcctccagttgaagtggggaggtgactggggtggtgcagtagtgagccatcccctcacacactgccagccttgcccactgtgtcctccctggccgcccggagctgtgtccgcctcctgcctggctgcctgtgctcggcccctccacaagcccaaaacagcctagggtactcagtgttttcagagccgcctagatgcaggactgtttgtgttttggttttaaatttatttaattaatttattttttatagagaccaggtctcaccatgttgcccaggctggtttcaaacccctgggctcaagtgacctgcccgccgcagcccccaaagtgctgggattataagtttgagcccccgcatgccactggttttaaatttttaaacagaaaacaatatttatatttcctctgtcttttaaaactgaacaccgaggtgggttttgtggtgggtggtgaacggacaggtttgggcctcgatcccccacccgaccctagcacccacaggtgggggtgccccctctgctgatgcgcctcctccctcagcaccatggacctgctggactggagcagcctcatcgacagcaggaccaagctgtccaagcacttggtagtccccaacgcacaggtaacacctccgctcctcagtgaggcccagctcagcagggcgctgcgctaagaagggaattcagcctgccacgtgtgtctcttgttgcctaccctgggaacttaacatgaccaaaatcactgcacactatggccccacagaccccctgtggtccagggggaagaagacaagcccactagtgtccacagagtgcttggcgggacagagacccacgcggagccttaagacaccacaaggagagggggtctgggggccttccccaagtcatctgtcttgtgcatcaggtcaccccaaacttcagaggcctgaaacggcagcagccactctgcttctgcctcatggttctggggttgacagggctcagctgggcagtcctcccctggggtctcctgggtagctgtactcacagagtggtggcgctgggacctgggggaggcacccattcacatgtctgggagttggtgctggctgtggcttgggctttttcccaacatggcagctgggctctaagggccagtgtcacctgagacgtgagagccaggcagaagctgggtgaccttttcctgcctcgcctcagaagtcacacggtgtcttttctggcaagttctgtttgttagaagcatgtcaccaggccagcctgtatacagcggggagaggaatgagactcatctgcctgtgggaggggggcccaggacctggcagactgcttgaaaccacagcttaaactgggattcaaagaaagaacagaagcaccttcagaaaacatcctgcagaggcagctttccatgacacatctagccccagtccactaagggcccagcctcaaacttagagcccccgacccagagcctcggggcgcagtgcgtacagtgtggctgtgcaccaaggccaccagctgttggagactttagcatggtgtagcaagggatagagtggtactgtttgtgcccagtgaggcaaggctgctggggccagcaaaggggtgagcgggaggccctgcgggatgggtccccacggcctctgagcaccagcaacttgaaggcctcatcctggtggttgccctggtccctggctacgtgtcagcacgtgctgcacaactgccctgtctgcctgtagccaggggtcttcctcctgggccctctgcctgctccgggtggagcccttctgtttgacgattgggtgatcagtgttcacttgttcaatgtcacatgggagttgcagggggctctcccacaacggtggggcctctgtgggaactggggagtacacacttcggagtgcaggcctggactgagcctggggcccactgacatgggcactgagctccctcgtggtacccctaggccccgcatagggcagtgcactggctgcgttggaggttcaggggcactgtgctgcttgtccaggtggccctccctcccagccctgcacagacgggtgagagggttcctgtgggctgggaatactgagagaggtttagcctgggcctcagggtggcactttcccgcccttgctgtggcctgaccgcgtgttgcacccccagacaggacagctggagcccctgctgtcccggttcactgaggaggaggagctacagatgaccaggatgctacagcggatggatgtcctggccaagaaagccacagagatgggcgtgcggctgatggtggatgccgagcagacctacttccagccggccatcagccgcctgacgctggagatgcagcggaagttcaatgtggagaagccgctcatcttcaacacataccagtgctacctcaaggatgcctatgacaatgtgaccctggacgtggagctggctcgccgtgagggctggtgttttggggccaagctggtgcggggcgcatacctggcccaggagcgagcccgtgcggcagagatcggctatgaggaccccatcaaccccacgtacgaggccaccaacgccatgtaccacaggtgcctggactacgtgttggaggagctgaagcacaacgccaaggccaaggtgatggtggcctcccacaatgaggacacagtgcgctttgcactgcgcaggatggaggagctgggcctgcatcctgctgaccaccgggtgtactttggacagctgctaggcatgtgtgaccagatcagcttcccgctgggccaggccggctaccccgtgtacaagtacgtgccctatggccccgtgatggaggtgctgccctacttgtcccgccgtgccctggagaacagcagcctcatgaagggcacccatcgggagcggcagctgctgtggctggagctcttgaggcggctccgaactggcaacctcttccatcgccctgcctagcacccgccagcacacccttagcctccagcaccccccgcccccgcccaggccatcaccacagctgcagccaaccccatcctcacacagattcaccttttttcaccccacacttgcagagctgctggaggtgaggtcaggtgcctcccagccctgcccagagtatgggcactcaggtgtgggccgaacctgatacctgcctgggacagccactggaaacttttgggaactctcctcgaatgtgtgggcccaaggcccccacctctgtgacccccatgtccttggacctagaggattgtccaccttctgccaaggccagcccacacagcccgagccccttggggagcagtggccgggctggggaggcctgcctggtcaataaaccactgttcctgc

SEQ ID NO: 16660 - DNA, 1985 bp, Homo sapiens
  ENST00000334029
gctgaagtgccagggtgcttgtgaagtctaagcccttgtctggcatttgtcaggaatataggctgctgtatgtttccaggaaacttctaggacagaggctattcaacaagctcatgaagatgaccttctatgggcattttgtagccggggaggaccaggagtccatccagcccctgcttcggcactacagggccttcggtgtcagcgccatcctggactatggagtggaggaggacctgagccccgaggaggcagagcacaaggagatggagtcctgcacctcagctgcggagagggatggcagtggcacgaataagcgggacaagcaataccaggcccactgggccttcggggaccgcaggaatggtgtcatcagtgcccgcacctacttctacgccaatgaggccaagtgcgacagccacatggagacattcttgcgctgcatcgaagcctcaggtagagtcagcgatgacggcttcatagccattaagctcacagcactggggagaccccagtttctgctgcagttctcagaggtgctggccaagtggaggtgcttctttcaccaaatggctgtggagcaagggcaggcgggcctggctgccatggacaccaagctggaggtggcggtgctgcaggaaagtgtcgcaaagttgggcatcgcatccagggctgagattgaggactggttcacggcagagaccctgggagtgtctggcaccatggacctgctggactggagcagcctcatcgacagcaggaccaagctgtccaagcacttggtagtccccaacgcacagacaggacagctggagcccctgctgtcccggttcactgaggaggaggagctacagatgaccaggatgctacagcggatggatgtcctggccaagaaagccacagagatgggcgtgcggctgatggtggatgccgagcagacctacttccagccggccatcagccgcctgacgctggagatgcagcggaagttcaatgtggagaagccgctcatcttcaacacataccagtgctacctcaaggatgcctatgacaatgtgaccctggacgtggagctggctcgccgtgagggctggtgttttggggccaagctggtgcggggcgcatacctggcccaggagcgagcccgtgcggcagagatcggctatgaggaccccatcaaccccacgtacgaggccaccaacgccatgtaccacaggtgcctggactacgtgttggaggagctgaagcacaacgccaaggccaaggtgatggtggcctcccacaatgaggacacagtgcgctttgcactgcgcaggatggaggagctgggcctgcatcctgctgaccaccgggtgtactttggacagctgctaggcatgtgtgaccagatcagcttcccgctgggccaggccggctaccccgtgtacaagtacgtgccctatggccccgtgatggaggtgctgccctacttgtcccgccgtgccctggagaacagcagcctcatgaagggcacccatcgggagcggcagctgctgtggctggagctcttgaggcggctccgaactggcaacctcttccatcgccctgcctagcacccgccagcacacccttagcctccagcaccccccgcccccgcccaggccatcaccacagctgcagccaaccccatcctcacacagattcaccttttttcaccccacacttgcagagctgctggaggtgaggtcaggtgcctcccagccctgcccagagtatgggcactcaggtgtgggccgaacctgatacctgcctgggacagccactggaaacttttgggaactctcctcgaatgtgtgggcccaaggcccccacctctgtgacccccatgtccttggacctagaggattgtccaccttctgccaaggccagcccacacagcccgagccccttggggagcagtggccgggctggggaggcctgcctggtcaataaaccactgttcctgc

SEQ ID NO: 16661 - DNA, 2462 bp, Homo sapiens
  ENST00000357068
ggtctcactctgttgctgtcttcacggagagcaggagcagaggctttgagaagccagtgggccttggcctcagccctgccggcagagggtccccaccatgcagctgaagtgccagggtgcttgtgaagtctaagcccttgtctggcatttgtcaggaatatagggtgaggcctctgggaccgagcggggcggggcggggcggggcggggcggggcgggaccaacagcgcacacttaagcggcccgggcgggtaccgccgtcccgccatggctctgaggcgcgccctgcccgcgctgcgcccctgcattccccgcttcgtcccgctgtccacggcgccggcctcccgcgagcagcccgcagcgggcccagcggccgtgccaggaggtgggtcggccacggcagtgcggccgccggtgcccgccgtggacttcggcaacgcgcaggaggcgtaccgcagccggcgaacctgggagctggcgcggagcctgctggtgctgcgcttgtgcgcctggcccgcgctgctggcgcgccacgagcagctgctgtatgtttccaggaaacttctaggacagaggctattcaacaagctcatgaagatgaccttctatgggcattttgtagccggggaggaccaggagtccatccagcccctgcttcggcactacagggccttcggtgtcagcgccatcctggactatggagtggaggaggacctgagccccgaggaggcagagcacaaggagatggagtcctgcacctcagctgcggagagggatggcagtggcacgaataagcgggacaagcaataccaggcccactgggccttcggggaccgcaggaatggtgtcatcagtgcccgcacctacttctacgccaatgaggccaagtgcgacagccacatggagacattcttgcgctgcatcgaagcctcaggtagagtcagcgatgacggcttcatagccattaagctcacagcactggggagaccccagtttctgctgcagttctcagaggtgctggccaagtggaggtgcttctttcaccaaatggctgtggagcaagggcaggcgggcctggctgccatggacaccaagctggaggtggcggtgctgcaggaaagtgtcgcaaagttgggcatcgcatccagggctgagattgaggactggttcacggcagagaccctgggagtgtctggcaccatggacctgctggactggagcagcctcatcgacagcaggaccaagctgtccaagcacttggtagtccccaacgcacagacaggacagctggagcccctgctgtcccggttcactgaggaggaggagctacagatgaccaggatgctacagcggatggatgtcctggccaagaaagccacagagatgggcgtgcggctgatggtggatgccgagcagacctacttccagccggccatcagccgcctgacgctggagatgcagcggaagttcaatgtggagaagccgctcatcttcaacacataccagtgctacctcaaggatgcctatgacaatgtgaccctggacgtggagctggctcgccgtgagggctggtgttttggggccaagctggtgcggggcgcatacctggcccaggagcgagcccgtgcggcagagatcggctatgaggaccccatcaaccccacgtacgaggccaccaacgccatgtaccacaggtgcctggactacgtgttggaggagctgaagcacaacgccaaggccaaggtgatggtggcctcccacaatgaggacacagtgcgctttgcactgcgcaggatggaggagctgggcctgcatcctgctgaccaccgggtgtactttggacagctgctaggcatgtgtgaccagatcagcttcccgctgggccaggccggctaccccgtgtacaagtacgtgccctatggccccgtgatggaggtgctgccctacttgtcccgccgtgccctggagaacagcagcctcatgaagggcacccatcgggagcggcagctgctgtggctggagctcttgaggcggctccgaactggcaacctcttccatcgccctgcctagcacccgccagcacacccttagcctccagcaccccccgcccccgcccaggccatcaccacagctgcagccaaccccatcctcacacagattcaccttttttcaccccacacttgcagagctgctggaggtgaggtcaggtgcctcccagccctgcccagagtatgggcactcaggtgtgggccgaacctgatacctgcctgggacagccactggaaacttttgggaactctcctcgaatgtgtgggcccaaggcccccacctctgtgacccccatgtccttggacctagaggattgtccaccttctgccaaggccagcccacacagcccgagccccttggggagcagtggccgggctggggaggcctgcctggtcaataaaccactgttcctgc

SEQ ID NO: 16662 - DNA, 4739 bp, Homo sapiens
  ENST00000609229
cttttaaaactgaacaccgaggtgggttttgtggtgggtggtgaacggacaggtttgggcctcgatcccccacccgaccctagcacccacaggtgggggtgccccctctgctgatgcgcctcctccctcagcaccatggacctgctggactggagcagcctcatcgacagcaggaccaagctgtccaagcacttggtagtccccaacgcacaggtaacacctccgctcctcagtgaggcccagctcagcagggcgctgcgctaagaagggaattcagcctgccacgtgtgtctcttgttgcctaccctgggaacttaacatgaccaaaatcactgcacactatggccccacagaccccctgtggtccagggggaagaagacaagcccactagtgtccacagagtgcttggcgggacagagacccacgcggagccttaagacaccacaaggagagggggtctgggggccttccccaagtcatctgtcttgtgcatcaggtcaccccaaacttcagaggcctgaaacggcagcagccactctgcttctgcctcatggttctggggttgacagggctcagctgggcagtcctcccctggggtctcctgggtagctgtactcacagagtggtggcgctgggacctgggggaggcacccattcacatgtctgggagttggtgctggctgtggcttgggctttttcccaacatggcagctgggctctaagggccagtgtcacctgagacgtgagagccaggcagaagctgggtgaccttttcctgcctcgcctcagaagtcacacggtgtcttttctggcaagttctgtttgttagaagcatgtcaccaggccagcctgtatacagcggggagaggaatgagactcatctgcctgtgggaggggggcccaggacctggcagactgcttgaaaccacagcttaaactgggattcaaagaaagaacagaagcaccttcagaaaacatcctgcagaggcagctttccatgacacatctagccccagtccactaagggcccagcctcaaacttagagcccccgacccagagcctcggggcgcagtgcgtacagtgtggctgtgcaccaaggccaccagctgttggagactttagcatggtgtagcaagggatagagtggtactgtttgtgcccagtgaggcaaggctgctggggccagcaaaggggtgagcgggaggccctgcgggatgggtccccacggcctctgagcaccagcaacttgaaggcctcatcctggtggttgccctggtccctggctacgtgtcagcacgtgctgcacaactgccctgtctgcctgtagccaggggtcttcctcctgggccctctgcctgctccgggtggagcccttctgtttgacgattgggtgatcagtgttcacttgttcaatgtcacatgggagttgcagggggctctcccacaacggtggggcctctgtgggaactggggagtacacacttcggagtgcaggcctggactgagcctggggcccactgacatgggcactgagctccctcgtggtacccctaggccccgcatagggcagtgcactggctgcgttggaggttcaggggcactgtgctgcttgtccaggtggccctccctcccagccctgcacagacgggtgagagggttcctgtgggctgggaatactgagagaggtttagcctgggcctcagggtggcactttcccgcccttgctgtggcctgaccgcgtgttgcacccccagacaggacagctggagcccctgctgtcccggttcactgaggaggaggagctacagatgaccaggatgctacagcggatggatgtcctggccaaggtgagctgtcccgctcgggcagagggtacctgggactcgtggagaagagggcacctgcctcacttgagcaacagttgctcccactctcccaccccctgcgcctctcagaaagccacagagatgggcgtgcggctgatggtggatgccgagcagacctacttccagccggccatcagccgcctgacgctggagatgcagcggaagttcaatgtggagaagccgctcatcttcaacacataccagtgctacctcaaggatgcctatgacaatgtgaccctggacgtggagctggctcgccgtgagggctggtgttttggggccaagctggtgcggggcgcatacctggcccaggagcgagcccgtgcggcagagatcggctatgaggaccccatcaaccccacgtacgaggccaccaacgccatgtaccacaggtgcctggactacgtgttggaggagctgaagcacaacgccaaggccaaggtgatggtggcctcccacaatgaggacacagtgcgctttgcactgcgcaggtaggtgtgccccaccctgcaccgaaaccccaacctgagccgttgtctcctccggctggggagaggtggcagcagcgcagagctcagggtgggcagagcgacctgctgggtggtcgggcatttgtggggaaaggctggtgaaatgagctggagggtggcttcagtgggcaggcccaggcccgctggcgttctggacatcggactgtgagagcacaatggctttttgcagttacgttggtttttaaaattaacttttttctttttttgagatagaatctcgctctgtcacctatgctggagtgcagtggcgtggtctcggctcactgcaacctccgcttcccaagttcaagcaattcttcatgcctcagcctcccaagtagctgggattacaggcatgtgccaccacgcctggctaatgttttgtatttttagcagagacagggtttcaccgtgttggccagactggtctcaaactcctggcctcaagtgatcctcccttcttggcctcccaaagtgctgggattacaagcatcagccactgtacccagacttttaaaaattaacatctgacttattaaacttcacaattaaaaaactaaatttcatcagggtattcggatggctcctgaaaggtacaaatgcagtgttggaggccagtccctcaggaggcctccacagtgccacctcattaatacgcccttaacattttaactacatctggaatgtaacggtttgttttctctttaaacatttgtcccatggagcacaacttcggtagaattctaacaagtcaaatgcagaagttaggtgaagtcagttcttggatactcctgtactgtcaccctggtcttatctcatgccttagtccaagctatgcacacaatggggtcctaggtccccctcccctcccagattccgccttcccagggatgggaccccctagaaccctcgggggcctgggcagtggcctcgctggctctcgccttcctaggagctgagcaggagctccactctcagcagggcagggtgccccagatccagggcttgtggcacgagggggctccccaagaagctgtgaagccacagggccaggcttggggccagggctgcagccaacaggacacatcctggtgctgctcgggagctgactcacggctctgaaatcattcagtgatgtccacattcagcctttgtttacgatgctgctactttttcatggcctgaaattgcagcacacccatttttgtgccctgatcctctgctaattgtcatagatgtgtcggtgatgggacagactcactttctccacacgcacaggcctggtggccagcactgcccagcactcgggagctggtgggggttcctctcagcttgtaatcaggactcccagcctctgggtggactctcaatgctggtggactcacagcctgactagacacatcaccatccaactccgaaaggacagcctgccctcagcagggcttcctctctccagcttccgcccggcacctgtctgtccctactatcttgctgtggcagtggcttccccagtggacacagcttccccctcccctgagtggcagccgggctctctcctcttggccccaagggccctgtgccaggctcccccagtaccacgctcacatccctgcctgagaggctggacccctgcaggcttcagctctgcccctgctgtgggtggttggggagctctggggagctggggtcccctcccatgggtaagtggttctagactatggcagctgctctgtcctgtgctgggcccagactgccacaccacccaccctcaaacaatcggagttggctttggccaaggaacaaaccagccccaaacttagaggctggaacagtggcatgttctgtaggccaggggtgggctggctcagctgatgcttctgctgctggctgtgcctgtgtccctcctgcgtctgtgatctggggccggtggggcctaatgagctcattcatggctggggcagtaaaggagactgcatcccgggtccagcgtcccacaggccagcccaggcttgagcacgtggtgggctcaggcttccagaaggcctggagagggcaagcctctgcttgtgtcacctttggtacctccctgctggccaaagtgcctcacgaggccaagcccagatgccaggtggagtgagccactgtcctgtgctgggaggagccgcagtcacatggcagaggctgtgcacaccagcaggggagggggcagccagcagtggcacccggctctcgggttcatgtcctggggttgaggaagacacaagatggaagccagggcgatgtggcagagatgggtgcctgctttagactgggtggtcccg

SEQ ID NO: 16663 - DNA, 441 bp, Homo sapiens
  ENST00000446371
accgaggtgggttttgtggtgggtggtgaacggacaggtttgggcctcgatcccccacccgaccctagcacccacaggtgggggtgccccctctgctgatgcgcctcctccctcagcaccatggacctgctggactggagcagcctcatcgacagcaggaccaagctgtccaagcacttggtagtccccaacgcacagacaggacagctggagcccctgctgtcccggttcactgaggaggaggagctacagatgaccaggatgctacagcggatggatgtcctggccaaggtgagctgtcccgctcgggcagagggtacctgggactcgtggagaagagggcacctgcctcacttgagcaacagttgctcccactctcccaccccctgcgcctctcagaaagccacagagatgggcgtgcggctgatggtggatgccgag

SEQ ID NO: 16664 - DNA, 553 bp, Homo sapiens
  ENST00000438924
cggtgcccgccgtggacttcggcaacgcgcaggaggcgtaccgcagccggcgaacctgggagctggcgcggagcctgctggtgctgcgcttgtgcgcctggcccgcgctgctggcgcgccacgagcaggtcctgcacctcagctgcggagagggatggcagtggcacgaataagcgggacaagcaataccaggcccactgggccttcggggaccgcaggaatggtgtcatcagtgcccgcacctacttctacgccaatgaggccaagtgcgacagccacatggagacattcttgcgctgcatcgaagcctcagctgcagttctcagaggtgctggccaagtggaggtgcttctttcaccaaatggctgtggagcaagggcaggcgggcctggctgccatggacaccaagctggaggtggcggtgctgcaggaaagtgtcgcaaagttgggcatcgcatccagggctgagattgaggactggttcacggcagagaccctgggagtgtctggcaccatggacctgctggactggagcagcctcatcgacagcagg

SEQ ID NO: 16665 - DNA, 472 bp, Homo sapiens
  ENST00000399694
ttcatgggcggggtggggtggggtcaggagcctgctgtgggctggccaggccctggccctccctgtcgcaccctgcgctgcctccatgcacctctcagggctgtcatggcttttcctgtggcttctgacaggtagagtcagcgatgacggcttcatagccattaagctcacagcactggggagaccccagtttctgctgcagttctcagaggtgctggccaagtggaggtgcttctttcaccaaatggctgtggagcaagggcaggcgggcctggctgccatggacaccaagctggaggtggcggtgctgcaggaaagtgtcgcaaagttgggcatcgcatccagggctgagattgaggactggttcacggcagagaccctgggagtgtctgggtgagagcagcccccaggctgagaggacacgagcatcagccatggttccagccaagccccagtgacgtctcccagtcct

SEQ ID NO: 16666 - DNA, 594 bp, Homo sapiens
  ENST00000450579
gggccagtcgtgcagaagccatgcccaccttgtggccgggatggagtggggactaggaaggcaccagccggggaggaccaggagtccatccagcccctgcttcggcactacagggccttcggtgtcagcgccatcctggactatggagtggaggaggacctgagccccgaggaggcagagcacaaggagatggagtcctgcacctcagctgcggagagggatggcagtggcacgaataagcgggacaagcaataccaggcccactgggccttcggggaccgcaggaatggtgtcatcagtgcccgcacctacttctacgccaatgaggccaagtgcgacagccacatggagacattcttgcgctgcatcgaagcctcaggtagagtcagcgatgacggcttcatagccattaagctcacagcactggggagaccccagtttctgctgcagttctcagaggtgctggccaagtggaggtgcttctttcaccaaatggctgtggagcaagggcaggcgggcctggctgccatggacaccaagctggaggtggcggtgctgcaggaaagtgtcgcaaagttgggcatcgcatccagg

SEQ ID NO: 16667 - DNA, 491 bp, Homo sapiens
  ENST00000457083
cccgcgctgcgcccctgcattccccgcttcgtcccgctgtccacggcgccggcctcccgcgagcagcccgcagcgggcccagcggccgtgccaggaggtgggtcggccacggcagtgcggccgccggtgcccgccgtggacttcggcaacgcgcaggaggcgtaccgcagccggcgaacctgggagctggcgcggagcctgctggtgctgcgcttgtgcgcctggcccgcgctgctggcgcgccacgagcaggtcctgcacctcagctgcggagagggatggcagtggcacgaataagcgggacaagcaataccaggcccactgggccttcggggaccgcaggaatggtgtcatcagtgcccgcacctacttctacgccaatgaggccaagtgcgacagccacatggagacattcttgcgctgcatcgaagcctcagctgcagttctcagaggtgctggccaagtggaggtgcttctttcaccaaatggct

SEQ ID NO: 16668 - DNA, 632 bp, Homo sapiens
  ENST00000496625
aggaccaggagtccatccagcccctgcttcggcactacagggccttcggtgtcagcgccatcctggactatggagtggaggaggacctgagccccgaggaggcagagcacaaggagatggagtcctgcacctcagctgcggagagggatggcagtggcacgaataagcgggacaagcaataccaggcccactgggccttcggggaccgcaggaatggtgtcatcagtgcccgcacctacttctacgccaatgaggccaagtgcgacagccacatggagacattcttgcgctgcatcgaagcctcaggtggggccccctctttgctggctatacccctgccatgtcccagcctgagcggacccctgggctcatggaggtgccggtgggtgaacactaagctggggcaggagccagagggctgggttctgaccacacttgggtccctcactgttcagccccttcctgaggggccccactgcctcccagaaggcatctcctctcctgccccagctccctgttccctgatcccgcctcatgccccccacccttctccctggctcagggccaggatcgggagctgcaggaagttggtccatgtcagctgccgagccacacttagcccagggtggagg

SEQ ID NO: 16669 - DNA, 2405 bp, Homo sapiens
  ENST00000610940
ggtctcactctgttgctgtcttcacggagagcaggagcagaggctttgagaagccagtgggccttggcctcagccctgccggcagagggtccccaccatgcagctgaagtgccagggtgcttgtgaagtctaagcccttgtctggcatttgtcaggaatataggcgcacacttaagcggcccgggcgggtaccgccgtcccgccatggctctgaggcgcgccctgcccgcgctgcgcccctgcattccccgcttcgtcccgctgtccacggcgccggcctcccgcgagcagcccgcagcgggcccagcggccgtgccaggaggtgggtcggccacggcagtgcggccgccggtgcccgccgtggacttcggcaacgcgcaggaggcgtaccgcagccggcgaacctgggagctggcgcggagcctgctggtgctgcgcttgtgcgcctggcccgcgctgctggcgcgccacgagcagctgctgtatgtttccaggaaacttctaggacagaggctattcaacaagctcatgaagatgaccttctatgggcattttgtagccggggaggaccaggagtccatccagcccctgcttcggcactacagggccttcggtgtcagcgccatcctggactatggagtggaggaggacctgagccccgaggaggcagagcacaaggagatggagtcctgcacctcagctgcggagagggatggcagtggcacgaataagcgggacaagcaataccaggcccactgggccttcggggaccgcaggaatggtgtcatcagtgcccgcacctacttctacgccaatgaggccaagtgcgacagccacatggagacattcttgcgctgcatcgaagcctcaggtagagtcagcgatgacggcttcatagccattaagctcacagcactggggagaccccagtttctgctgcagttctcagaggtgctggccaagtggaggtgcttctttcaccaaatggctgtggagcaagggcaggcgggcctggctgccatggacaccaagctggaggtggcggtgctgcaggaaagtgtcgcaaagttgggcatcgcatccagggctgagattgaggactggttcacggcagagaccctgggagtgtctggcaccatggacctgctggactggagcagcctcatcgacagcaggaccaagctgtccaagcacttggtagtccccaacgcacagacaggacagctggagcccctgctgtcccggttcactgaggaggaggagctacagatgaccaggatgctacagcggatggatgtcctggccaagaaagccacagagatgggcgtgcggctgatggtggatgccgagcagacctacttccagccggccatcagccgcctgacgctggagatgcagcggaagttcaatgtggagaagccgctcatcttcaacacataccagtgctacctcaaggatgcctatgacaatgtgaccctggacgtggagctggctcgccgtgagggctggtgttttggggccaagctggtgcggggcgcatacctggcccaggagcgagcccgtgcggcagagatcggctatgaggaccccatcaaccccacgtacgaggccaccaacgccatgtaccacaggtgcctggactacgtgttggaggagctgaagcacaacgccaaggccaaggtgatggtggcctcccacaatgaggacacagtgcgctttgcactgcgcaggatggaggagctgggcctgcatcctgctgaccaccgggtgtactttggacagctgctaggcatgtgtgaccagatcagcttcccgctgggccaggccggctaccccgtgtacaagtacgtgccctatggccccgtgatggaggtgctgccctacttgtcccgccgtgccctggagaacagcagcctcatgaagggcacccatcgggagcggcagctgctgtggctggagctcttgaggcggctccgaactggcaacctcttccatcgccctgcctagcacccgccagcacacccttagcctccagcaccccccgcccccgcccaggccatcaccacagctgcagccaaccccatcctcacacagattcaccttttttcaccccacacttgcagagctgctggaggtgaggtcaggtgcctcccagccctgcccagagtatgggcactcaggtgtgggccgaacctgatacctgcctgggacagccactggaaacttttgggaactctcctcgaatgtgtgggcccaaggcccccacctctgtgacccccatgtccttggacctagaggattgtccaccttctgccaaggccagcccacacagcccgagccccttggggagcagtggccgggctggggaggcctgcctggtcaataaaccactgttcctgcagctg

SEQ ID NO: 16670 - DNA, 900 bp, Homo sapiens
  ENST00000471129
ctggagaggagattcccagccttcctgcccaacccgaaacttttccaacacacgcaggcgtattcctcgcaggattcggcggtcccgagtcgcagtcagggaggaggctcgggaagcacacgtgccctggcacactggaggagggtcccgggattcttgagctgtgcccagctgacgagcttttgaagatggcacaataaccgtccagtgatgcctgaccatgacagcacagccctcttaagccggcaaaccaagaggagaagagttgacattggagtgaaaaggacggtagggacagcatctgcattttttgctaaggcaagagcaacgttttttagtgccatgaatccccaaggttctgagcaggatgttgagtattcagtggtgcagcatgcagatggggaaaagtcaaatgtactccgcaagctgctgaagagggcgaactcgtatgaagatgccatgatgccttttccaggagcaaccataatttcccagctgttgaaaaataacatgaacaaaaatggtggcacggagcccagtttccaagccagcggtctctctagtacaggctccgaagtacatcaggaggatatatgcagcaactcttcaagagacagccccccagagtgtctttccccttttggcaggcctactatgagccagtttgatatggatcgcttatgtgatgagcacctgagagcaaagcgcgcccgggttgagaatataattcggggtatgagccattcccccagtgtggcattaaggggcaatgaaaatgaaagagagatggccccgcagtctgtgagtccccgagaaagttacagagaaaacaaacgcaagcaaaagcttccccagcagcagcaacagagtttccagcagctggtttcagcccgaaaagaa

SEQ ID NO: 16671 - DNA, 8240 bp, Homo sapiens
  ENST00000366958
aagtaaatcttgttgtggagcggagccctcagctgagggagcgctctgaaataatacaccattgcagccggggaaagcagagcggcgcaaaagagctctcgccgggtccgcctgctccctctccgcttcgctcctcttctcttctttacccttctcctctctcctcctctgctgctctctcctctcctcccgctcttctctctcctcctctcctgctctctcctcttcccttagctcctcttcttttcttctcctcttcttccctctcctcgcctctcccctgctcctcttctctcgtctcccctcccctcccgcctctctctcccctctccctctcccactcgccccgctcgctcgctcgctgtcgcacagactcaccgtcccttgtccaattatcatattcatcacccgcaagatatcaccgtgtgtgcactcgcgtgttttcctctctctgccgggggaaaaaaaagagagagagagagatagagagagagagagagagagagagagagaggctcggtcccactgctccctgcaccgcggtcccgggattcttgagctgtgcccagctgacgagcttttgaagatggcacaataaccgtccagtgatgcctgaccatgacagcacagccctcttaagccggcaaaccaagaggagaagagttgacattggagtgaaaaggacggtagggacagcatctgcattttttgctaaggcaagagcaacgttttttagtgccatgaatccccaaggttctgagcaggatgttgagtattcagtggtgcagcatgcagatggggaaaagtcaaatgtactccgcaagctgctgaagagggcgaactcgtatgaagatgccatgatgccttttccaggagcaaccataatttcccagctgttgaaaaataacatgaacaaaaatggtggcacggagcccagtttccaagccagcggtctctctagtacaggctccgaagtacatcaggaggatatatgcagcaactcttcaagagacagccccccagagtgtctttccccttttggcaggcctactatgagccagtttgatatggatcgcttatgtgatgagcacctgagagcaaagcgcgcccgggttgagaatataattcggggtatgagccattcccccagtgtggcattaaggggcaatgaaaatgaaagagagatggccccgcagtctgtgagtccccgagaaagttacagagaaaacaaacgcaagcaaaagcttccccagcagcagcaacagagtttccagcagctggtttcagcccgaaaagaacagaagcgagaggagcgccgacagctgaaacagcagctggaggacatgcagaaacagctgcgccagctgcaggaaaagttctaccaaatctatgacagcactgattcggaaaatgatgaagatggtaacctgtctgaagacagcatgcgctcggagatcctggatgccagggcccaggactctgtcggaaggtcagataatgagatgtgcgagctagacccaggacagtttattgaccgagctcgagccctgatcagagagcaggaaatggctgaaaacaagccgaagcgagaaggcaacaacaaagaaagagaccatgggccaaactccttacaaccggaaggcaaacatttggctgagaccttgaaacaggaactgaacactgccatgtcgcaagttgtggacactgtggtcaaagtcttttcggccaagccctcccgccaggttcctcaggtcttcccacctctccagatcccccaggccagatttgcagtcaatggggaaaaccacaatttccacaccgccaaccagcgcctgcagtgctttggcgacgtcatcattccgaaccccctggacacctttggcaatgtgcagatggccagttccactgaccagacagaagcactgcccctggttgtccgcaaaaactcctctgaccagtctgcctccggccctgccgctggcggccaccaccagcccctgcaccagtcgcctctctctgccaccacgggcttcaccacgtccaccttccgccaccccttcccccttcccttgatggcctatccatttcagagcccattaggtgctccctccggctccttctctggaaaagacagagcctctcctgaatccttagacttaactagggataccacgagtctgaggaccaagatgtcatctcaccacctgagccaccacccttgttcaccagcacacccgcccagcaccgccgaagggctctccttgtcgctcataaagtccgagtgcggcgatcttcaagatatgtctgaaatatcaccttattcgggaagtgcaatgcaggaaggattgtcacccaatcacttgaaaaaagcaaagctcatgtttttttatacccgttatcccagctccaatatgctgaagacctacttctccgacgtaaagttcaacagatgcattacctctcagctcatcaagtggtttagcaatttccgtgagttttactacattcagatggagaagtacgcacgtcaagccatcaacgatggggtcaccagtactgaagagctgtctataaccagagactgtgagctgtacagggctctgaacatgcactacaataaagcaaatgactttgaggttccagagagattcctggaagttgctcagatcacattacgggagtttttcaatgccattatcgcaggcaaagatgttgatccttcctggaagaaggccatatacaaggtcatctgcaagctggatagtgaagtccctgagattttcaaatccccgaactgcctacaagagctgcttcatgagtagaaatttcaacaactctttttgaatgtatgaagagtagcagtcccctttggatgtccaagttatatgtgtctagattttgatttcatatatatgtgtatgggaggcatggatatgttatgaaatcagctggtaattcctcctcatcacgtttctctcattttcttttgttttccattgcaaggggatggttgttttctttctgcctttagtttgcttttgcccaaggcccttaacatttggacacttaaaatagggttaattttcagggaaaaagaatgttggcgtgtgtaaagtctctattagcaatgaagggaatttgttaacgatgcatccacttgattgatgacttattgcaaatggcggttggctgaggaaaacccatgacacagcacaactctacagacagtgatgtgtctcttgtttctactgctaagaaggtctgaaaatttaatgaaaccacttcatacatttaagtattttgtttggtttgaactcaatcagtagcttttccttacatgtttaaaaataattccaatgacagatgagcagctcacttttccaaagtaccccaaaaggccaaattaaaaaagaaaaataatcactctcaagccttgtctaagaaaagaggcaaactctgaaagtcgtaccagtttcttctggaggcaaagcaattttgcacaaaaccagctctctcaagatgagactagaaattcatacctggtcttgtagccacctctctaaacttgaaaataggttcttcttcataagtgagcttacatcattcttcataaagaaaaatcctataacttgttatcatttttgcttcagatactaaaaggcactaagtttccaatttacgctgctcaactttgtttatatgcttaaaaggattctgtttacttaacaattttttcccctaaaatactattttctgaatacttccttccagtaaggaataaaggaaagcccaacttggccataaaattcttgcctacactagaagtttgttgacagccattagctgacttgatcgtcatctcctaagaggaacacatatattttcacaagcaattccacactatcctgatgggtatgcaaagtggtgacagtctaactcagtgtttcttcattttaggtataacattttaaagcaattgataatgcctcttccaattcagaagctagtattgaccaaaatgtgagaagagtgtatagcataggaaaatttggggttaacccaaaagacacaattccagcacacataagaaagctagctgctattttatgctttcttccatggttctcctcttttttcccttttatttttccctgtttttcaatgatgtacagtgttccctacttgcattgaaaaaactcgtatggcattcacactttttttcttaggtgggtttttgtgtccagatgcagtaagaattcattgttcatcctaaaactgttttccagacccttccttccccttaggtaatttgatatacacctcctaaaatgacacagtaacaaatctggtatttagaacatatagaacataaatgccattttttaattcaactttaataagaattacatttgactttggagaatacaggtcttgacccatgtgactgactagctgacccgatcgctgtaatttaacgtcatttataaattctgctgatggacaggaatgtatgaactcaattattgtcagcacaaagccttaaaacctgctgactttaaattaaatggtgcagtcctatgatgccctgcaccatccaggggactaacagggcctcgcagtgtagacagagggtgcagccacacgggcgggggcaccagccacctcactctgcacccgcggcctcacacatctcccagctcacactctactaatgcacagagtcattagatccaatttgttatttttctcacttgctttaaaaaaaagcagtttggataatcatgacattggaataaagtgggaaggaaaaattccatcagcacaaaatagggaagtaatcccaacttgtagtcacagttttctgactggctttgttttaaaagaggatggcagtccttgttcgtgtcagtgtgccactgggtttttgctgttccgtgtaattcatatcaactttgtgttgccatttgcaaggtaaaaggcaaagctgtagtgtattcacctatgtagacagattgctagatatctttttgatctggggcgagttcaatattgattccagacttatttggatttttttagtattattttcccctccctttctaatttaaatagacaaattaagcaaaagtgtgtgttcacaaccaaatgttgatgcccttatctactgataatatcctctcaatgttcactgaggcatagaaattatttcagagtagaaattgcagcatgaggataaactcacctctttgttctgaaaatagaactttatcactatgctttccggtggttttcccttttacaatcgaaatcttgtgcctcccaagtgcattggaaaatgacaaaagcctgtctctccaaattcctatttaacagtttgattttttttttttaatcaccatctttcaaatcttagctcaactctcaccaagtgaaaattggctacttgggagaaagttaactttctatggtgggatggtgaaggatgagggacagtttacataggaaaagaaaaaaaaaagtctaaagtccatgttgaaaaaccacactaccacttattttctgctaaccctaaattatttttgcgtatacgcttgaggttatagtctgtgcctagacctaaaatgcaccagcgggggggattttaaaaaatccttcaaaataccagttttttcccaacaagtacaattgttcttgtgccttctgtggctttcgatttcatctttttgactttatttccaattactacagctgcaataaacactagattttttttctggctgtttgacataacgttgatagctatgcatattttgtgtctttttaaaacaaagcgggagaatacgtttttgaagaagagaatttttagaacagtttgataccgcaaattattttttcctcaattgtttgagcagcattcgagttttgaaaattcttgtagaagccaattttttgtaactgtggtgcaaatcttgtgttttcttagcctaatgaaaagtagtatagaagcaatatttcataccatgtgctatatatgtgtgcgcagatgtgtgaacataaaatcacatacacacatatacacacatgtaaaaatatacatatatatatatgcgtgtgaagtggaaagcttaccttttcctatctagatttaagaacctattttagacatttgttatgttttgtgaaaagaatgttctatttgcaacaaaacatttaattcttactgtatctctggctgtttaatgaggacgtttcacattaaatggtaaaacacatggaagatgttagaatgtagtaattatttaagtaaacgttcacccacatattcctgaagtttgctttgtgcctccgagtattatttaattaaagaagtgttttatgtttgcagaatctttgtcactgtactagggatgtgggtgaatatcatttaaaaaaatttaaaacaacaaaaaaaaagcaaaacagaaacactaaagcaagaggggaacttttataaagcaatgtaaatatttaacctcatggctgtcattatgtaagacatgagattttaataaataactacattctcacgacatctgttgaatttactaggaacactacagtgactgtatagacagttgaaagcattcttgaaaatcctgctctctccttttaaaagttaacaatctcttttatcagatgtcaagggcaagggtaatgcagtttctgtaaatttatgaaatttctttttctatgtacatgaagacatttagtaagtaacacccccccttcccatgcgcacatgtgcgcatacacacacacacacacacacacacacacacaaacacacacactgtcataaagctaatgatttggggactttaaaaaataggatgtcctccaggaacaatcataaatttatgaaagaaagagtagtttacagactcccctgaaagaagcagtgtatatgtgaagacagtgcaaaaatctctttgccatgtatattatagcgtattcattggtgtgaatagtacaaatgtttccttctggtacaaactctgtgtttgcaaatttacaagaagcattgttttcaaaaagctccccttaaaaaatgtaactggtttatatgagtaagcagttaccgtattgcacttaaatgttatgttgaaggaaatgcagttttgttttctgtagatctgttggttgtaaaccatctataaaactaaagctaaaatgctcatattcagagctgggatcaaaactggtatttaacctttgcatcttcttataattatccttctaagaatataacagaatgtggaagtgtctggactttgagtcttttcaactgagccttctctcaaatctgacaccccctcagaatgcacaaacataagcagaaaaggcaaacaagcttaccttcttttgtgaaaacgtattcattctgtatttttttaaatattcaattcccctaaaaatggggagaaaatattttaaaattgtatattacgacttcaaatttagaactaagaaaaaaatgtatttgggattggtctcagcgctacctagaagaatcaaaggtcatggcttccctcaatattgtcccagccatttctcatatgtatatagtataaaccgtgacaaaacactgcctttatattatttagcaatatgttgtaaatagcattattaagctcttttttgtaataaagaccctttgatttgaatatagtacaataactgaactgataaagtcaatttttgatttttgtttgttttttttagctagaggcaatttcaattgtgaatttttgttgttgtctattgttctgaagactttgcataatttattggtttaatttatcctaatttatttgatgaaggtgtacaattttgtattaccaaggatgtactgtaatattaattgatatgataaacacaatgagactccctgtccatattaaaaagaaaataaaaaggtgcagtagacaattgattttaaaggaaaagttaaaaaaattagtttggcagctactaaattttaaaacaggaaaaaaaaaagttgttgtggggagggtgggaaaggggttttactttgtgtgttttaagcttttgtatactctccaaacttttaccttttgctttgtaccacttaaaggatacagtagtccaattgccttgtgtgccttccatctcctcttaaactgaatgtatgtgcagtatatatgcaagcttgtgcaaaataaaatatacattacaagctc

SEQ ID NO: 16672 - DNA, 562 bp, Homo sapiens
  ENST00000607726
gttgtggagcggagccctcagctgagggagcgctctgaaataatacaccattgcagccggggaaagcagagcggcgcaaaagagctctcgccgggtccgcctgctccctctccgcttcgctcctcttctcttctttacccttctcctctctcctcctctgctgctctctcctctcctcccgctcttctctctcctcctctcctgctctctcctcttcccttagctcctcttcttttcttctcctcttcttccctctcctcgcctctcccctgctcctcttctctcgtctcccctcccctcccgcctctctctcccctctccctctcccactcgccccgctcgctcgctcgctgtcgcacagactcaccgtcccttgtccaattatcatattcatcacccgcaagatatcaccgtgtgtgcactcgcgtgttttcctctctctgccgggggaaaaaaaagagagagagagagatagagagagagagagagagagagagagagaggctcggtcccactgctccctgcaccgcgagaaaatggtgttattcaaatgaatcataat

SEQ ID NO: 16673 - DNA, 3075 bp, Homo sapiens
  ENST00000435016
ccccttttccagaatcacttgcactgtcttgttcttgaatgagaaaggaagaaaagagcctcccattactcagacccgtgtaaacattattccccccaggagaaaatggtgttattcaaatgaatcataataaaatagcctctaaacagtttctaagcgggagcctccgtggaactcagcgctccgctcctcccagttcctaagaggtcccgggattcttgagctgtgcccagctgacgagcttttgaagatggcacaataaccgtccagtgatgcctgaccatgacagcacagccctcttaagccggcaaaccaagaggagaagagttgacattggagtgaaaaggacggtagggacagcatctgcattttttgctaaggcaagagcaacgttttttagtgccatgaatccccaaggttctgagcaggatgttgagtattcagtggtgcagcatgcagatggggaaaagtcaaatgtactccgcaagctgctgaagagggcgaactcgtatgaagatgccatgatgccttttccaggagcaaccataatttcccagctgttgaaaaataacatgaacaaaaatggtggcacggagcccagtttccaagccagcggtctctctagtacaggctccgaagtacatcaggaggatatatgcagcaactcttcaagagacagccccccagagtgtctttccccttttggcaggcctactatgagccagtttgatatggatcgcttatgtgatgagcacctgagagcaaagcgcgcccgggttgagaatataattcggggtatgagccattcccccagtgtggcattaaggggcaatgaaaatgaaagagagatggccccgcagtctgtgagtccccgagaaagttacagagaaaacaaacgcaagcaaaagcttccccagcagcagcaacagagtttccagcagctggtttcagcccgaaaagaacagaagcgagaggagcgccgacagctgaaacagcagctggaggacatgcagaaacagctgcgccagctgcaggaaaagttctaccaaatctatgacagcactgattcggaaaatgatgaagatggtaacctgtctgaagacagcatgcgctcggagatcctggatgccagggcccaggactctgtcggaaggtcagataatgagatgtgcgagctagacccaggacagtttattgaccgagctcgagccctgatcagagagcaggaaatggctgaaaacaagccgaagcgagaaggcaacaacaaagaaagagaccatgggccaaactccttacaaccggaaggcaaacatttggctgagaccttgaaacaggaactgaacactgccatgtcgcaagttgtggacactgtggtcaaagtcttttcggccaagccctcccgccaggttcctcaggtcttcccacctctccagatcccccaggccagatttgcagtcaatggggaaaaccacaatttccacaccgccaaccagcgcctgcagtgctttggcgacgtcatcattccgaaccccctggacacctttggcaatgtgcagatggccagttccactgaccagacagaagcactgcccctggttgtccgcaaaaactcctctgaccagtctgcctccggccctgccgctggcggccaccaccagcccctgcaccagtcgcctctctctgccaccacgggcttcaccacgtccaccttccgccaccccttcccccttcccttgatggcctatccatttcagagcccattaggtgctccctccggctccttctctggaaaagacagagcctctcctgaatccttagacttaactagggataccacgagtctgaggaccaagatgtcatctcaccacctgagccaccacccttgttcaccagcacacccgcccagcaccgccgaagggctctccttgtcgctcataaagtccgagtgcggcgatcttcaagatatgtctgaaatatcaccttattcgggaagtgcaatgcaggaaggattgtcacccaatcacttgaaaaaagcaaagctcatgtttttttatacccgttatcccagctccaatatgctgaagacctacttctccgacgtaaagttcaacagatgcattacctctcagctcatcaagtggtttagcaatttccgtgagttttactacattcagatggagaagtacgcacgtcaagccatcaacgatggggtcaccagtactgaagagctgtctataaccagagactgtgagctgtacagggctctgaacatgcactacaataaagcaaatgactttgaggttccagagagattcctggaagttgctcagatcacattacgggagtttttcaatgccattatcgcaggcaaagatgttgatccttcctggaagaaggccatatacaaggtcatctgcaagctggatagtgaagtccctgagattttcaaatccccgaactgcctacaagagctgcttcatgagtagaaatttcaacaactctttttgaatgtatgaagagtagcagtcccctttggatgtccaagttatatgtgtctagattttgatttcatatatatgtgtatgggaggcatggatatgttatgaaatcagctggtaattcctcctcatcacgtttctctcattttcttttgttttccattgcaaggggatggttgttttctttctgcctttagtttgcttttgcccaaggcccttaacatttggacacttaaaatagggttaattttcagggaaaaagaatgttggcgtgtgtaaagtctctattagcaatgaagggaatttgttaacgatgcatccacttgattgatgacttattgcaaatggcggttggctgaggaaaacccatgacacagcacaactctacagacagtgatgtgtctcttgtttctactgctaagaaggtctgaaaatttaatgaaaccacttcatacatttaagtattttgtttggtttgaactcaatcagtagcttttccttacatgtttaaaaataattccaatgacagatgagcagctcacttttccaaagtaccccaaaaggccaaattaaaaaa

SEQ ID NO: 16674 - DNA, 560 bp, Homo sapiens
  ENST00000607425
gttactccccctgctgaagctgaaggttggtggagtgatggagcgtggggatggtaaaggaggaggtcccgggattcttgagctgtgcccagctgacgagcttttgaagatggcacaataaccgtccagtgatgcctgaccatgacagcacagccctcttaagccggcaaaccaagaggagaagagttgacattggagtgaaaaggacggtagggacagcatctgcattttttgctaaggcaagagcaacgttttttagtgccatgaatccccaaggttctgagcaggatgttgagtattcagtggtgcagcatgcagatggggaaaagtcaaatgtactccgcaagctgctgaagagggcgaactcgtatgaagatgccatgatgccttttccaggagcaaccataatttcccagctgttgaaaaataacatgaacaaaaatggtggcacggagcccagtttccaagccagcggtctctctagtacaggctccgaagtacatcaggaggatatatgcagcaactcttcaagagacagccccccagagtgtctttcccct

SEQ ID NO: 16675 - DNA, 8498 bp, Homo sapiens
  ENST00000498508
gtgtcttaaagtaaatcttgttgtggagcggagccctcagctgagggagcgctctgaaataatacaccattgcagccggggaaagcagagcggcgcaaaagagctctcgccgggtccgcctgctccctctccgcttcgctcctcttctcttctttacccttctcctctctcctcctctgctgctctctcctctcctcccgctcttctctctcctcctctcctgctctctcctcttcccttagctcctcttcttttcttctcctcttcttccctctcctcgcctctcccctgctcctcttctctcgtctcccctcccctcccgcctctctctcccctctccctctcccactcgccccgctcgctcgctcgctgtcgcacagactcaccgtcccttgtccaattatcatattcatcacccgcaagatatcaccgtgtgtgcactcgcgtgttttcctctctctgccgggggaaaaaaaagagagagagagagatagagagagagagagagagagagagagagaggctcggtcccactgctccctgcaccgcggtcccgggattcttgagctgtgcccagctgacgagcttttgaagatggcacaataaccgtccagtgatgcctgaccatgacagcacagccctcttaagccggcaaaccaagaggagaagagttgacattggagtgaaaaggacggtagggacagcatctgcattttttgctaaggcaagagcaacgttttttagtgccatgaatccccaaggttctgagcaggatgttgagtattcagtggtgcagcatgcagatggggaaaagtcaaatgtactccgcaagctgctgaagagggcgaactcgtatgaagatgccatgatgccttttccaggagcaaccataatttcccagctgttgaaaaataacatgaacaaaaatggtggcacggagcccagtttccaagccagcggtctctctagtacaggctccgaagtacatcaggaggatatatgcagcaactcttcaagagacagccccccagagtgtctttccccttttggcaggcctactatgagccagtttgatatggatcgcttatgtgatgagcacctgagagcaaagcgcgcccgggttgagaatataattcggggtatgagccattcccccagtgtggcattaaggggcaatgaaaatgaaagagagatggccccgcagtctgtgagtccccgagaaagttacagagaaaacaaacgcaagcaaaagcttccccagcagcagcaacagagtttccagcagctggtttcagcccgaaaagaacagaagcgagaggagcgccgacagctgaaacagcagctggaggacatgcagaaacagctgcgccagctgcaggaaaagttctaccaaatctatgacagcactgattcggaaaatgatgaagatggtaacctgtctgaagacagcatgcgctcggagatcctggatgccagggcccaggactctgtcggaaggtcagataatgagatgtgcgagctagacccaggacagtttattgaccgagctcgagccctgatcagagagcaggaaatggctgaaaacaagccgaagcgagaaggcaacaacaaagaaagagaccatgggccaaactccttacaaccggaaggcaaacatttggctgagaccttgaaacaggaactgaacactgccatgtcgcaagttgtggacactgtggtcaaagtcttttcggccaagccctcccgccaggttcctcaggtcttcccacctctccagatcccccaggccagatttgcagtcaatggggaaaaccacaatttccacaccgccaaccagcgcctgcagtgctttggcgacgtcatcattccgaaccccctggacacctttggcaatgtgcagatggccagttccactgaccagacagaagcactgcccctggttgtccgcaaaaactcctctgaccagtctgcctccggccctgccgctggcggccaccaccagcccctgcaccagtcgcctctctctgccaccacgggcttcaccacgtccaccttccgccaccccttcccccttcccttgatggcctatccatttcagagcccattaggtgctccctccggctccttctctggaaaagacagagcctctcctgaatccttagacttaactagggataccacgagtctgaggaccaagatgtcatctcaccacctgagccaccacccttgttcaccagcacacccgcccagcaccgccgaagggctctccttgtcgctcataaagtccgagtgcggcgatcttcaagatatgtctgaaatatcaccttattcgggaagtgcaatgcaggaaggattgtcacccaatcacttgaaaaaagcaaagctcatgtttttttatacccgttatcccagctccaatatgctgaagacctacttctccgacgtaaagttcaacagatgcattacctctcagctcatcaagtggtttagcaatttccgtgagttttactacattcagatggagaagtacgcacgtcaagccatcaacgatggggtcaccagtactgaagagctgtctataaccagagactgtgagctgtacagggctctgaacatgcactacaataaagcaaatgactttgaggttccagagagattcctggaagttgctcagatcacattacgggagtttttcaatgccattatcgcaggcaaagatgttgatccttcctggaagaaggccatatacaaggtcatctgcaagctggatagtgaagtccctgagattttcaaatccccgaactgcctacaagagctgcttcatgagtagaaatttcaacaactctttttgaatgtatgaagagtagcagtcccctttggatgtccaagttatatgtgtctagattttgatttcatatatatgtgtatgggaggcatggatatgttatgaaatcagctggtaattcctcctcatcacgtttctctcattttcttttgttttccattgcaaggggatggttgttttctttctgcctttagtttgcttttgcccaaggcccttaacatttggacacttaaaatagggttaattttcagggaaaaagaatgttggcgtgtgtaaagtctctattagcaatgaagggaatttgttaacgatgcatccacttgattgatgacttattgcaaatggcggttggctgaggaaaacccatgacacagcacaactctacagacagtgatgtgtctcttgtttctactgctaagaaggtctgaaaatttaatgaaaccacttcatacatttaagtattttgtttggtttgaactcaatcagtagcttttccttacatgtttaaaaataattccaatgacagatgagcagctcacttttccaaagtaccccaaaaggccaaattaaaaaagaaaaataatcactctcaagccttgtctaagaaaagaggcaaactctgaaagtcgtaccagtttcttctggaggcaaagcaattttgcacaaaaccagctctctcaagatgagactagaaattcatacctggtcttgtagccacctctctaaacttgaaaataggttcttcttcataagtgagcttacatcattcttcataaagaaaaatcctataacttgttatcatttttgcttcagatactaaaaggcactaagtttccaatttacgctgctcaactttgtttatatgcttaaaaggattctgtttacttaacaattttttcccctaaaatactattttctgaatacttccttccagtaaggaataaaggaaagcccaacttggccataaaattcttgcctacactagaagtttgttgacagccattagctgacttgatcgtcatctcctaagaggaacacatatattttcacaagcaattccacactatcctgatgggtatgcaaagtggtgacagtctaactcagtgtttcttcattttaggtataacattttaaagcaattgataatgcctcttccaattcagaagctagtattgaccaaaatgtgagaagagtgtatagcataggaaaatttggggttaacccaaaagacacaattccagcacacataagaaagctagctgctattttatgctttcttccatggttctcctcttttttcccttttatttttccctgtttttcaatgatgtacagtgttccctacttgcattgaaaaaactcgtatggcattcacactttttttcttaggtgggtttttgtgtccagatgcagtaagaattcattgttcatcctaaaactgttttccagacccttccttccccttaggtaatttgatatacacctcctaaaatgacacagtaacaaatctggtatttagaacatatagaacataaatgccattttttaattcaactttaataagaattacatttgactttggagaatacaggtcttgacccatgtgactgactagctgacccgatcgctgtaatttaacgtcatttataaattctgctgatggacaggaatgtatgaactcaattattgtcagcacaaagccttaaaacctgctgactttaaattaaatggtgcagtcctatgatgccctgcaccatccaggggactaacagggcctcgcagtgtagacagagggtgcagccacacgggcgggggcaccagccacctcactctgcacccgcggcctcacacatctcccagctcacactctactaatgcacagagtcattagatccaatttgttatttttctcacttgctttaaaaaaaagcagtttggataatcatgacattggaataaagtgggaaggaaaaattccatcagcacaaaatagggaagtaatcccaacttgtagtcacagttttctgactggctttgttttaaaagaggatggcagtccttgttcgtgtcagtgtgccactgggtttttgctgttccgtgtaattcatatcaactttgtgttgccatttgcaaggtaaaaggcaaagctgtagtgtattcacctatgtagacagattgctagatatctttttgatctggggcgagttcaatattgattccagacttatttggatttttttagtattattttcccctccctttctaatttaaatagacaaattaagcaaaagtgtgtgttcacaaccaaatgttgatgcccttatctactgataatatcctctcaatgttcactgaggcatagaaattatttcagagtagaaattgcagcatgaggataaactcacctctttgttctgaaaatagaactttatcactatgctttccggtggttttcccttttacaatcgaaatcttgtgcctcccaagtgcattggaaaatgacaaaagcctgtctctccaaattcctatttaacagtttgattttttttttttaatcaccatctttcaaatcttagctcaactctcaccaagtgaaaattggctacttgggagaaagttaactttctatggtgggatggtgaaggatgagggacagtttacataggaaaagaaaaaaaaaagtctaaagtccatgttgaaaaaccacactaccacttattttctgctaaccctaaattatttttgcgtatacgcttgaggttatagtctgtgcctagacctaaaatgcaccagcgggggggattttaaaaaatccttcaaaataccagttttttcccaacaagtacaattgttcttgtgccttctgtggctttcgatttcatctttttgactttatttccaattactacagctgcaataaacactagattttttttctggctgtttgacataacgttgatagctatgcatattttgtgtctttttaaaacaaagcgggagaatacgtttttgaagaagagaatttttagaacagtttgataccgcaaattattttttcctcaattgtttgagcagcattcgagttttgaaaattcttgtagaagccaattttttgtaactgtggtgcaaatcttgtgttttcttagcctaatgaaaagtagtatagaagcaatatttcataccatgtgctatatatgtgtgcgcagatgtgtgaacataaaatcacatacacacatatacacacatgtaaaaatatacatatatatatatgcgtgtgaagtggaaagcttaccttttcctatctagatttaagaacctattttagacatttgttatgttttgtgaaaagaatgttctatttgcaacaaaacatttaattcttactgtatctctggctgtttaatgaggacgtttcacattaaatggtaaaacacatggaagatgttagaatgtagtaattatttaagtaaacgttcacccacatattcctgaagtttgctttgtgcctccgagtattatttaattaaagaagtgttttatgtttgcagaatctttgtcactgtactagggatgtgggtgaatatcatttaaaaaaatttaaaacaacaaaaaaaaagcaaaacagaaacactaaagcaagaggggaacttttataaagcaatgtaaatatttaacctcatggctgtcattatgtaagacatgagattttaataaataactacattctcacgacatctgttgaatttactaggaacactacagtgactgtatagacagttgaaagcattcttgaaaatcctgctctctccttttaaaagttaacaatctcttttatcagatgtcaagggcaagggtaatgcagtttctgtaaatttatgaaatttctttttctatgtacatgaagacatttagtaagtaacacccccccttcccatgcgcacatgtgcgcatacacacacacacacacacacacacacacacaaacacacacactgtcataaagctaatgatttggggactttaaaaaataggatgtcctccaggaacaatcataaatttatgaaagaaagagtagtttacagactcccctgaaagaagcagtgtatatgtgaagacagtgcaaaaatctctttgccatgtatattatagcgtattcattggtgtgaatagtacaaatgtttccttctggtacaaactctgtgtttgcaaatttacaagaagcattgttttcaaaaagctccccttaaaaaatgtaactggtttatatgagtaagcagttaccgtattgcacttaaatgttatgttgaaggaaatgcagttttgttttctgtagatctgttggttgtaaaccatctataaaactaaagctaaaatgctcatattcagagctgggatcaaaactggtatttaacctttgcatcttcttataattatccttctaagaatataacagaatgtggaagtgtctggactttgagtcttttcaactgagccttctctcaaatctgacaccccctcagaatgcacaaacataagcagaaaaggcaaacaagcttaccttcttttgtgaaaacgtattcattctgtatttttttaaatattcaattcccctaaaaatggggagaaaatattttaaaattgtatattacgacttcaaatttagaactaagaaaaaaatgtatttgggattggtctcagcgctacctagaagaatcaaaggtcatggcttccctcaatattgtcccagccatttctcatatgtatatagtataaaccgtgacaaaacactgcctttatattatttagcaatatgttgtaaatagcattattaagctcttttttgtaataaagaccctttgatttgaatatagtacaataactgaactgataaagtcaatttttgatttttgtttgttttttttagctagaggcaatttcaattgtgaatttttgttgttgtctattgttctgaagactttgcataatttattggtttaatttatcctaatttatttgatgaaggtgtacaattttgtattaccaaggatgtactgtaatattaattgatatgataaacacaatgagactccctgtccatattaaaaagaaaataaaaaggtgcagtagacaattgattttaaaggaaaagttaaaaaaattagtttggcagctactaaattttaaaacaggaaaaaaaaaagttgttgtggggagggtgggaaaggggttttactttgtgtgttttaagcttttgtatactctccaaacttttaccttttgctttgtaccacttaaaggatacagtagtccaattgccttgtgtgccttccatctcctcttaaactgaatgtatgtgcagtatatatgcaagcttgtgcaaaataaaatatacattacaagctcagtgccgtttgattttcttaaagaaagagtgacttttaatttttggacctgtatccaattgtaggacagtaggctagttgtgccagtaatgtcaagtatggagattttctttcactacaattcttcattctgttagcctaacgtgcagctcctagaaacaacctcttttactttagatgcttggaataattgcttggatttctctctctgaaacatctttcaggcttaactttatttagccctgaaactt

SEQ ID NO: 16676 - DNA, 8170 bp, Homo sapiens
  ENST00000261454
cccctcgtgagtccctccccttttccagaatcacttgcactgtcttgttcttgaatgagaaaggaagaaaagagcctcccattactcagacccgtgtaaacattattccccccaggagaaaatggtgttattcaaatgaatcataataaaatagcctctaaacagtttctaagcgggagcctccgtggaactcagcgctccgctcctcccagttcctaagaggtcccgggattcttgagctgtgcccagctgacgagcttttgaagatggcacaataaccgtccagtgatgcctgaccatgacagcacagccctcttaagccggcaaaccaagaggagaagagttgacattggagtgaaaaggacggtagggacagcatctgcattttttgctaaggcaagagcaacgttttttagtgccatgaatccccaaggttctgagcaggatgttgagtattcagtggtgcagcatgcagatggggaaaagtcaaatgtactccgcaagctgctgaagagggcgaactcgtatgaagatgccatgatgccttttccaggagcaaccataatttcccagctgttgaaaaataacatgaacaaaaatggtggcacggagcccagtttccaagccagcggtctctctagtacaggctccgaagtacatcaggaggatatatgcagcaactcttcaagagacagccccccagagtgtctttccccttttggcaggcctactatgagccagtttgatatggatcgcttatgtgatgagcacctgagagcaaagcgcgcccgggttgagaatataattcggggtatgagccattcccccagtgtggcattaaggggcaatgaaaatgaaagagagatggccccgcagtctgtgagtccccgagaaagttacagagaaaacaaacgcaagcaaaagcttccccagcagcagcaacagagtttccagcagctggtttcagcccgaaaagaacagaagcgagaggagcgccgacagctgaaacagcagctggaggacatgcagaaacagctgcgccagctgcaggaaaagttctaccaaatctatgacagcactgattcggaaaatgatgaagatggtaacctgtctgaagacagcatgcgctcggagatcctggatgccagggcccaggactctgtcggaaggtcagataatgagatgtgcgagctagacccaggacagtttattgaccgagctcgagccctgatcagagagcaggaaatggctgaaaacaagccgaagcgagaaggcaacaacaaagaaagagaccatgggccaaactccttacaaccggaaggcaaacatttggctgagaccttgaaacaggaactgaacactgccatgtcgcaagttgtggacactgtggtcaaagtcttttcggccaagccctcccgccaggttcctcaggtcttcccacctctccagatcccccaggccagatttgcagtcaatggggaaaaccacaatttccacaccgccaaccagcgcctgcagtgctttggcgacgtcatcattccgaaccccctggacacctttggcaatgtgcagatggccagttccactgaccagacagaagcactgcccctggttgtccgcaaaaactcctctgaccagtctgcctccggccctgccgctggcggccaccaccagcccctgcaccagtcgcctctctctgccaccacgggcttcaccacgtccaccttccgccaccccttcccccttcccttgatggcctatccatttcagagcccattaggtgctccctccggctccttctctggaaaagacagagcctctcctgaatccttagacttaactagggataccacgagtctgaggaccaagatgtcatctcaccacctgagccaccacccttgttcaccagcacacccgcccagcaccgccgaagggctctccttgtcgctcataaagtccgagtgcggcgatcttcaagatatgtctgaaatatcaccttattcgggaagtgcaatgcaggaaggattgtcacccaatcacttgaaaaaagcaaagctcatgtttttttatacccgttatcccagctccaatatgctgaagacctacttctccgacgtaaagttcaacagatgcattacctctcagctcatcaagtggtttagcaatttccgtgagttttactacattcagatggagaagtacgcacgtcaagccatcaacgatggggtcaccagtactgaagagctgtctataaccagagactgtgagctgtacagggctctgaacatgcactacaataaagcaaatgactttgaggttccagagagattcctggaagttgctcagatcacattacgggagtttttcaatgccattatcgcaggcaaagatgttgatccttcctggaagaaggccatatacaaggtcatctgcaagctggatagtgaagtccctgagattttcaaatccccgaactgcctacaagagctgcttcatgagtagaaatttcaacaactctttttgaatgtatgaagagtagcagtcccctttggatgtccaagttatatgtgtctagattttgatttcatatatatgtgtatgggaggcatggatatgttatgaaatcagctggtaattcctcctcatcacgtttctctcattttcttttgttttccattgcaaggggatggttgttttctttctgcctttagtttgcttttgcccaaggcccttaacatttggacacttaaaatagggttaattttcagggaaaaagaatgttggcgtgtgtaaagtctctattagcaatgaagggaatttgttaacgatgcatccacttgattgatgacttattgcaaatggcggttggctgaggaaaacccatgacacagcacaactctacagacagtgatgtgtctcttgtttctactgctaagaaggtctgaaaatttaatgaaaccacttcatacatttaagtattttgtttggtttgaactcaatcagtagcttttccttacatgtttaaaaataattccaatgacagatgagcagctcacttttccaaagtaccccaaaaggccaaattaaaaaagaaaaataatcactctcaagccttgtctaagaaaagaggcaaactctgaaagtcgtaccagtttcttctggaggcaaagcaattttgcacaaaaccagctctctcaagatgagactagaaattcatacctggtcttgtagccacctctctaaacttgaaaataggttcttcttcataagtgagcttacatcattcttcataaagaaaaatcctataacttgttatcatttttgcttcagatactaaaaggcactaagtttccaatttacgctgctcaactttgtttatatgcttaaaaggattctgtttacttaacaattttttcccctaaaatactattttctgaatacttccttccagtaaggaataaaggaaagcccaacttggccataaaattcttgcctacactagaagtttgttgacagccattagctgacttgatcgtcatctcctaagaggaacacatatattttcacaagcaattccacactatcctgatgggtatgcaaagtggtgacagtctaactcagtgtttcttcattttaggtataacattttaaagcaattgataatgcctcttccaattcagaagctagtattgaccaaaatgtgagaagagtgtatagcataggaaaatttggggttaacccaaaagacacaattccagcacacataagaaagctagctgctattttatgctttcttccatggttctcctcttttttcccttttatttttccctgtttttcaatgatgtacagtgttccctacttgcattgaaaaaactcgtatggcattcacactttttttcttaggtgggtttttgtgtccagatgcagtaagaattcattgttcatcctaaaactgttttccagacccttccttccccttaggtaatttgatatacacctcctaaaatgacacagtaacaaatctggtatttagaacatatagaacataaatgccattttttaattcaactttaataagaattacatttgactttggagaatacaggtcttgacccatgtgactgactagctgacccgatcgctgtaatttaacgtcatttataaattctgctgatggacaggaatgtatgaactcaattattgtcagcacaaagccttaaaacctgctgactttaaattaaatggtgcagtcctatgatgccctgcaccatccaggggactaacagggcctcgcagtgtagacagagggtgcagccacacgggcgggggcaccagccacctcactctgcacccgcggcctcacacatctcccagctcacactctactaatgcacagagtcattagatccaatttgttatttttctcacttgctttaaaaaaaagcagtttggataatcatgacattggaataaagtgggaaggaaaaattccatcagcacaaaatagggaagtaatcccaacttgtagtcacagttttctgactggctttgttttaaaagaggatggcagtccttgttcgtgtcagtgtgccactgggtttttgctgttccgtgtaattcatatcaactttgtgttgccatttgcaaggtaaaaggcaaagctgtagtgtattcacctatgtagacagattgctagatatctttttgatctggggcgagttcaatattgattccagacttatttggatttttttagtattattttcccctccctttctaatttaaatagacaaattaagcaaaagtgtgtgttcacaaccaaatgttgatgcccttatctactgataatatcctctcaatgttcactgaggcatagaaattatttcagagtagaaattgcagcatgaggataaactcacctctttgttctgaaaatagaactttatcactatgctttccggtggttttcccttttacaatcgaaatcttgtgcctcccaagtgcattggaaaatgacaaaagcctgtctctccaaattcctatttaacagtttgattttttttttttaatcaccatctttcaaatcttagctcaactctcaccaagtgaaaattggctacttgggagaaagttaactttctatggtgggatggtgaaggatgagggacagtttacataggaaaagaaaaaaaaaagtctaaagtccatgttgaaaaaccacactaccacttattttctgctaaccctaaattatttttgcgtatacgcttgaggttatagtctgtgcctagacctaaaatgcaccagcgggggggattttaaaaaatccttcaaaataccagttttttcccaacaagtacaattgttcttgtgccttctgtggctttcgatttcatctttttgactttatttccaattactacagctgcaataaacactagattttttttctggctgtttgacataacgttgatagctatgcatattttgtgtctttttaaaacaaagcgggagaatacgtttttgaagaagagaatttttagaacagtttgataccgcaaattattttttcctcaattgtttgagcagcattcgagttttgaaaattcttgtagaagccaattttttgtaactgtggtgcaaatcttgtgttttcttagcctaatgaaaagtagtatagaagcaatatttcataccatgtgctatatatgtgtgcgcagatgtgtgaacataaaatcacatacacacatatacacacatgtaaaaatatacatatatatatatgcgtgtgaagtggaaagcttaccttttcctatctagatttaagaacctattttagacatttgttatgttttgtgaaaagaatgttctatttgcaacaaaacatttaattcttactgtatctctggctgtttaatgaggacgtttcacattaaatggtaaaacacatggaagatgttagaatgtagtaattatttaagtaaacgttcacccacatattcctgaagtttgctttgtgcctccgagtattatttaattaaagaagtgttttatgtttgcagaatctttgtcactgtactagggatgtgggtgaatatcatttaaaaaaatttaaaacaacaaaaaaaaagcaaaacagaaacactaaagcaagaggggaacttttataaagcaatgtaaatatttaacctcatggctgtcattatgtaagacatgagattttaataaataactacattctcacgacatctgttgaatttactaggaacactacagtgactgtatagacagttgaaagcattcttgaaaatcctgctctctccttttaaaagttaacaatctcttttatcagatgtcaagggcaagggtaatgcagtttctgtaaatttatgaaatttctttttctatgtacatgaagacatttagtaagtaacacccccccttcccatgcgcacatgtgcgcatacacacacacacacacacacacacacacacaaacacacacactgtcataaagctaatgatttggggactttaaaaaataggatgtcctccaggaacaatcataaatttatgaaagaaagagtagtttacagactcccctgaaagaagcagtgtatatgtgaagacagtgcaaaaatctctttgccatgtatattatagcgtattcattggtgtgaatagtacaaatgtttccttctggtacaaactctgtgtttgcaaatttacaagaagcattgttttcaaaaagctccccttaaaaaatgtaactggtttatatgagtaagcagttaccgtattgcacttaaatgttatgttgaaggaaatgcagttttgttttctgtagatctgttggttgtaaaccatctataaaactaaagctaaaatgctcatattcagagctgggatcaaaactggtatttaacctttgcatcttcttataattatccttctaagaatataacagaatgtggaagtgtctggactttgagtcttttcaactgagccttctctcaaatctgacaccccctcagaatgcacaaacataagcagaaaaggcaaacaagcttaccttcttttgtgaaaacgtattcattctgtatttttttaaatattcaattcccctaaaaatggggagaaaatattttaaaattgtatattacgacttcaaatttagaactaagaaaaaaatgtatttgggattggtctcagcgctacctagaagaatcaaaggtcatggcttccctcaatattgtcccagccatttctcatatgtatatagtataaaccgtgacaaaacactgcctttatattatttagcaatatgttgtaaatagcattattaagctcttttttgtaataaagaccctttgatttgaatatagtacaataactgaactgataaagtcaatttttgatttttgtttgttttttttagctagaggcaatttcaattgtgaatttttgttgttgtctattgttctgaagactttgcataatttattggtttaatttatcctaatttatttgatgaaggtgtacaattttgtattaccaaggatgtactgtaatattaattgatatgataaacacaatgagactccctgtccatattaaaaagaaaataaaaaggtgcagtagacaattgattttaaaggaaaagttaaaaaaattagtttggcagctactaaattttaaaacaggaaaaaaaaaagttgttgtggggagggtgggaaaggggttttactttgtgtgttttaagcttttgtatactctccaaacttttaccttttgctttgtaccacttaaaggatacagtagtccaattgccttgtgtgccttccatctcctcttaaactgaatgtatgtgcagtatatatgcaagcttgtgcaaaataaaatatacattacaagctcagtgccgtttgattttcttaaagaaagagtgacttttaatttttggacctgtatccaattgtaggacagtaggctagttgtgccagtaatgtcaagtatggagattttctttcactacaattcttcattctgttagcctaacgtgcagctcctagaaacaacctcttttactttagatgcttggaataattgcttggatttctctctctgaaacatctttcaggcttaactttatttagccctgaaactt

SEQ ID NO: 16677 - DNA, 905 bp, Homo sapiens
  ENST00000432186
ctccgcggccccctcccccggccccgggctccggctccggctccggctctggctctgcgcggtggcagcggcggcggcggcgcggggaccgaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtacca

SEQ ID NO: 16678 - DNA, 920 bp, Homo sapiens
  ENST00000492475
cagtgagccgcctgccctcaagctcctgggccccctctgccctttggccatgtgaacgcctcctaatgtgtaagccattcggctgcccccaaggccaggcatccagtgtgcttagtgctgagcagggtttcagagctcacccccaggagggtgcagacctcagccaaggtcgcagagcagaggagacccgtgggctgggattccacctgtgcccaccctggcagcatcccacctcctgagtcctctcggcacccagcaagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcagga

SEQ ID NO: 16679 - DNA, 1767 bp, Homo sapiens
  ENST00000006251
attcggctgcccccaaggccaggcatccagtgtgcttagtgctgagcagggtttcagagctcacccccaggagggtgcagacctcagccaaggtcgcagagcagaggagacccgtgggctgggattccacctgtgcccaccctggcagcatcccacctcctgagtcctctcggcacccagcaaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtctgtttcaggcatctgagtcggcgtttacccaggggccgggccagagacgggggtcggccgctcgctcccacgctcctcctgccccagccctctggtgtccacacctgcccacagagaatgtaaacccagtgggctctgcccacgccgggccccaaagtgaccagactccagcacacctgtctcctcctgcctggggtggccatggggatggaagggggtggaataaaacctgtcaacctg

SEQ ID NO: 16680 - DNA, 560 bp, Homo sapiens
  ENST00000459857
agtgtgcttagtgctgagcagggtttcagagctcacccccaggagggtgcagacctcagccaaggtcgcagagcagaggagacccgtgggctgggattccacctgtgcccaccctggcagcatcccacctcctgagtcctctcggcacccagcaaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcaggtagaaccagctgctgacaaaaggcatggtgatccttcgggacaagattcgcttctatgaggggcctgcacagggccctcagcactcggataaagaaaggaaagacggacaccagcctgcgcccacagcgagaaccccagagtgggagccagcacgg

SEQ ID NO: 16681 - DNA, 2279 bp, Homo sapiens
  ENST00000403581
agtgtgcttagtgctgagcagggtttcagagctcacccccaggagggtgcagacctcagccaaggtcgcagagcagaggagacccgtgggctgggattccacctgtgcccaccctggcagcatcccacctcctgagtcctctcggcacccagcaagagtcccttcagtgacttcgagcgtgcattgagagcccagtaacactggggggcaactgccacaaagacacagcctcagccaggcgcagtgactcatgcctgtaatcccagcaccttgggaggccaaggcttgtggatcacctgaggtcaggagtttgagaccagccggaccaacatggagaaaccccatctctactaaaaatacaaaaaaattagctaggcattgtggcgcatgcctgtaatcccggctactcgggaggctgagggaggagaagcacttgaacccaggaggcgcggttgcagtgagccgagatcgccccattgcactccagcctgggcaacaagagcgaaactccatctcaaaataataataataacaataatagtaagactcagcctccccgctctgggacactcagtctgatggggcaggctggtcagaagacatagagccatggtgtgtttggaactttcacagagggaagcctggggctcgggaagcccggaaaagatgccggcgcagcctgagggcttgtacaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtctgtttcaggcatctgagtcggcgtttacccaggggccgggccagagacgggggtcggccgctcgctcccacgctcctcctgccccagccctctggtgtccacacctgcccacagagaatgtaaacccagtgggctctgcccacgccgggccccaaagtgaccagactccagcacacctgtctcctcctgcctggggtggccatggggatggaagggggtggaataaaacctgtcaacctgg

SEQ ID NO: 16682 - DNA, 735 bp, Homo sapiens
  ENST00000492289
cagacctcagccaaggtcgcagagcagaggagacccgtgggctgggattccacctgtgcccaccctggcagcatcccacctcctgagtcctctcggcacccagcaaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgaggagactcacctgtcaagatgtgtccccataccactacgtctggcaagcccagctcctatagccagcttggatgctcttcctccaggaagccctccctgcctgaccctctgcaccctcttcttccttcgacgtggtgctgctattggaaggggtctccgtggatccccagacctgaccacaggcagagctggcctggccctgggtcctctgggccactgactgtggtgcaccctttcctcggaggctcagcctctgtctgcttggtggggggtcgatcacccctggctactgcccttatgatcctgctcagtgtcccacttccct

SEQ ID NO: 16683 - DNA, 1878 bp, Homo sapiens
  ENST00000336985
gcccccggcctccgtttgcgccgggtctgtgctggccgcgcgcctggcgctccacgctgagcctctccgtgcaatgattaacccggcggggcggccggcgcgggacccgagacggaggcgcggggccggggcgggaccccgcaggaccgctcggcttcctgctctcgccggagtttccgcgtagagggcgcatcgccggcccggggcccttggtgcggcgtggcgcagggcgcggcgtggggcgcgcgtgggcgcggcgcaggcggcccgggtcaccatgaggactctccgcaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtctgtttcaggcatctgagtcggcgtttacccaggggccgggccagagacgggggtcggccgctcgctcccacgctcctcctgccccagccctctggtgtccacacctgcccacagagaatgtaaacccagtgggctctgcccacgccgggccccaaagtgaccagactccagcacacctgtctcctcctgcctggggtggccatggggatggaagggggtggaataaaacctgtcaacctgg

SEQ ID NO: 16684 - DNA, 789 bp, Homo sapiens
  ENST00000403696
ccgggtctgtgctggccgcgcgcctggcgctccacgctgagcctctccgtgcaatgattaacccggcggggcggccggcgcgggacccgagacggaggcgcggggccggggcgggaccccgcaggaccgctcggcttcctgctctcgccggagtttccgcgtagagggcgcatcgccggcccggggcccttggtgcggcgtggcgcagggcgcggcgtggggcgcgcgtgggcgcggcgcaggcggcccgggtcaccatgaggactctccgcaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggcatctgcccgcgccagtcaggcccagtggtgatggcccccatgcccacaggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtga

SEQ ID NO: 16685 - DNA, 881 bp, Homo sapiens
  ENST00000457960
ccgggtctgtgctggccgcgcgcctggcgctccacgctgagcctctccgtgcaatgattaacccggcggggcggccggcgcgggacccgagacggaggcgcggggccggggcgggaccccgcaggaccgctcggcttcctgctctcgccggagtttccgcgtagagggcgcatcgccggcccggggcccttggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctcc

SEQ ID NO: 16686 - DNA, 1612 bp, Homo sapiens
  ENST00000431834
cgggtctgtgctggccgcgcgcctggcgctccacgctgagcctctccgtgcaatgattaacccggcggggcggccggcgcgggacccgagacggaggcgcggggccggggcgggaccccgcaggaccgctcggcttcctgctctcgccggagtttccgcgtagagggcgcatcgccggcccggggcccttggtgcggcgtggcgcagggcgcggcgtggggcgcgcgtgggcgcggcgcaggcggcccgggtcaccatgaggactctccgcaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgaggaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtct

SEQ ID NO: 16687 - DNA, 1430 bp, Homo sapiens
  ENST00000432916
ccgcaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgaggaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtctgtttcaggcatctgagtcggcgtttacccaggggccgggccagagacgggggtcggccgctcgctcccacgctcctcctgccccagccctctggtgtccacacctgcccacagagaatgtaaacccagtgggctctgcccacgccgggccccaaagtgaccagactccagcacacctgtctcctcctgcctggggtggccatggggatggaagggggtgga

SEQ ID NO: 16688 - DNA, 1041 bp, Homo sapiens
  ENST00000477331
agtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccgaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttgg

SEQ ID NO: 16689 - DNA, 1431 bp, Homo sapiens
  ENST00000455389
gccctgggtcctctgggccactgactgtggtgcaccctttcctcggaggctcagcctctgtctgcttggtggggggtcgatcacccctggctactgcccttatgatcctgctcagtgtcccacttccctgtcatgtgatggatgggcagctgtttggggctcagctgggtccccagtgcccagcatcagcgccagcacacagacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtctgtttcaggcatctgagtcggcgtttacccaggggccgggccagagacgggggtcggccgctcgctcccacgctcctcctgccccagccctctggtgtccacacctgcccacagagaatgtaaacccagtgggctctgcccacgccgggccccaaagtgaccagactccagcacacctgtctcctcctgcct

SEQ ID NO: 16690 - DNA, 2125 bp, Homo sapiens
  ENST00000495017
tcacccctggctactgcccttatgatcctgctcagtgtcccacttccctgtcatgtgatggatgggcagctgtttggggctcagctgggtccccagtgcccagcatcagcgccagcacacagtaggtgttctgtgtttgttggaggggcagatagtgtgggggaaggagggaggaggtcggtgggtagaagaaatcaactgcttagccgggttgttaggaggatctgatgagactaggatgtgagttgaaactgctgtgccaggcacacctgtgtgggtctcacttgtgccaggcatacctgcgtgggtctcacctgtgtaggtctcacctgtgccaggtgtacctgtgtgggtcttacctgtgcaggtctcctgatgcaggtctcacctgtgccgagtgtacctacctgtgcgggtctcacctgtgtcaggcgtacgtgtaggggtctcacctgtgaacgtctcacctgtgccaggtgtatacctgtgtggctctcacttgtgtgggtctggtatgtgacaaaggcctgggaattggcagctgtcatctgccaggagcagaccctgagccaagttccctgtgccttaggctcatttcatgccctcagctctgggaggccaatccctttactgccacattttataaatggaagactgaggttaagcagtgggcccagggccatagaacagctgagctgtggagctggacatcgaccttgggcaggtgctgccaggggcctgagcccaggccctccactcccgcatcctctgatgacccatcctgggtgagtggaggcatctgcccgcgccagtcaggcccagtggtgatggcccccatgcccacaggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtctgtttcaggcatctgagtcggcgtttacccaggggccgggccagagacgggggtcggccgctcgctcccacgctcctcctgccccagccctctggtgtccacacctgcccacagagaatgtaaacccagtgggctctgcccacgccgggccccaaagtgaccagactccagcacacctgtctcctcctgcctggggtggccatggggatggaagggggtggaataaaacctgtcaacctgg

SEQ ID NO: 16691 - DNA, 1965 bp, Homo sapiens
  ENST00000475850
ctaaaaatacaaaaattagccgggcatggtgatgcatgcctgtagtcccagctactcgggaggctgaggcaggagaatcacttgaacctgggaggcggaggttgcagtgagccaagatcgcaccactgcactccagcctggtgacagagcgaaactctgtctcaaaaaaaaaaattctacccccgtgtatcttgtccctgaaccccctgacagccccttgaggcctgctgtcttccattcattcacttatttaatgagtgcaagcactcgttataagtcagctttctcccagccctctttgctgggtgctgaggtcccagagcttttgtcccagctcagcgcacagctgggtgagcagcctcatctcccgggccttggctcaaatacacctggaggtagcggtgagcccttcagagctccggatgaggggagatgatggcgtgagccagtgatgggaagaagagagtggggcttgtgaggtggtccctgatggatgtggactgcacctggccccatggggcagggagccccaggtgagcagcttggccctccctgcgtggggtcagccagtgtctctggagagactgtccaaagcctctaggactcttgagtacagggcccctccgaggggtggaaggtgcagaacacccatctcatctggccacagggcctttttccagggcacaccatggtctcccagatcccgacgctgctgtgagcagcagagtgactcaggccacatgctctgagaggggctgggaggccaccgtgggccctgccatggggacagagagcctgtgggaatggggaggcgggaggcagaggacaggctgtctggtgggtgggacatatggttgagagcctggagccaccaagctcgggtgcatgaccccctaccccctgccccactctcctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtctgtttcaggcatctgagtcggcgtttacccaggggccgggccagagacgggggtcggccgctcgctcccacgctcctcctgccccagccctctggtgtccacacctgcccacagagaatgtaaacccagtgggctctgcccacgccgggccccaaagtgaccagactccagcacacctgtctcctcctgcctggggtggccatggggatggaagggggtggaataaaacctgtcaacctgg

SEQ ID NO: 16692 - DNA, 1843 bp, Homo sapiens
  ENST00000611394
agccccccagctccggcggacccgggtgggcgtgcccgcggacccgcttgccgcacttaggcgagtctcccctgcagcgccccgagtccctgggggctgcggcggctgcgggcgcccccgcgcgggcccgaggggcgggacgcggcggagcggggcggggcggggcctccgcggccccctcccccggccccgggctccggctccggctccggctctggctctgcgcggtggcagcggcggcggcggcgcggggaccgaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtctgtttcaggcatctgagtcggcgtttacccaggggccgggccagagacgggggtcggccgctcgctcccacgctcctcctgccccagccctctggtgtccacacctgcccacagagaatgtaaacccagtgggctctgcccacgccgggccccaaagtgaccagactccagcacacctgtctcctcctgcctggggtggccatggggatggaagggggtggaataaaacctgtcaacctgg

SEQ ID NO: 16693 - DNA, 1900 bp, Homo sapiens
  ENST00000624862
caggaaggggtgctctgtgggcttggaggatgcaggcgccttcctggggactgctctgtgagcagtgataaaatatttatcagccagcagctgggcttccctgcatagggtgcagtcgggggcagctcccacccgagcctgcagcctgagttctgctgagtcatgggggagcccagtgagccgcctgccctcaagctcctgggccccctctgccctttggccatgtgaacgcctcctaatgtgtaagccattcggctgcccccaaggccaggcatccagtgtgcttagtgctgagcagggtttcagagctcacccccaggagggtgcagacctcagccaaggtcgcagagcagaggagacccgtgggctgggattccacctgtgcccaccctggcagcatcccacctcctgagtcctctcggcacccagcaagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtctgtttcaggcatctgagtcggcgtttacccaggggccgggccagagacgggggtcggccgctcgctcccacgctcctcctgccccagccctctggtgtccacacctgcccacagagaatgtaaacccagtgggctctgcccacgccgggccccaaagtgaccagactccagcacacctgtctcctcctgcctggggtggccatggggatggaagggggtggaataaaacctgtcaacctgg

SEQ ID NO: 16694 - DNA, 1726 bp, Homo sapiens
  ENST00000617066
agccccccagctccggcggacccgggtgggcgtgcccgcggacccgcttgccgcacttaggcgagtctcccctgcagcgccccgagtccctgggggctgcggcggctgcgggcgcccccgcgcgggcccgaggggcgggacgcggcggagcggggcggggcggggcctccgcggccccctcccccggccccgggctccggctccggctccggctctggctctgcgcggtggcagcggcggcggcggcgcggggaccgagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtctgtttcaggcatctgagtcggcgtttacccaggggccgggccagagacgggggtcggccgctcgctcccacgctcctcctgccccagccctctggtgtccacacctgcccacagagaatgtaaacccagtgggctctgcccacgccgggccccaaagtgaccagactccagcacacctgtctcctcctgcctggggtggccatggggatggaagggggtggaataaaacctgtcaacctgg

SEQ ID NO: 16695 - DNA, 436 bp, Homo sapiens
  ENST00000531269
agtcttcaggccccaggtcagtgagtggcaagccaggcccagagatctctgcgcccgttggaacatccccttctcgggaggctggaaggccatggtcattcacctctccccagcaaggtgggacctgccctggaagaagaaaccagaccagcttttgtcttgcttgaagaagatggaattgctcaatgacgacagtgaaggaatttgaaaggtctagagtgcagccagtcaagaagatttctagaaattgggcccaaagtgtctttggatgatgaaatgaggatgacagtggcaatgttatcgtcatggttatttccttgagcatggcatggaagatgaggtgttctagtgaactttctcactggaccaaactgttgtgataaatcctttgaagttatatcaatccatccagtttcaacttccagagcttcgggaa

SEQ ID NO: 16696 - DNA, 562 bp, Homo sapiens
  ENST00000529034
agtcttcaggccccaggtcagtgagtggcaagccaggcccagagatctctgcgcccgttggaacatccccttctcgggaggctggaaggccatggtcattcacctctccccagcaaggtgggacctgccctggaagaagaaaccagaccaggtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgagctccagctcagcctggaacagcgttcagactgctgtgatcaacgttttcaaagggggtggcttgcaaagcaacgagctctatgccctgaacgaaaacatcagaaccagcttcttgcaaaaggactgttctttgtggaggagaa

SEQ ID NO: 16697 - DNA, 2291 bp, Homo sapiens
  ENST00000530639
agtcttcaggccccaggtcagtgagtggcaagccaggcccagagatctctgcgcccgttggaacatccccttctcgggaggctggaaggccatggtcattcacctctccccagcaaggtgggacctgccctggaagaagaaaccagaccaggtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgagctccagctcagcctggaacagcgttcagactgctgtgatcaacgttttcaaagggggtggcttgcaaagcaacgagctctatgccctgaacgaaaacatcaggcggctgttgaagagtgaacttggatcattcattacagactattttcagaaccagcttcttgcaaaaggactgttctttgtggaggagaagatcaagctgtgtgaaggtgaaaatcgcattgaggttctggctgaagtctgggaccacttcttcactgagactctccctaccctgcaggcaatattttatccagttcagggccaggagctgactatccgccagatctccctgctgggcttccgagacctagtcttgctgaaggtgaagctgggtgacctgctgctgctggcccagtccaagctgccctcgtccattgtccagatgttgctcatcctgcagagtgttcacgagcccacaggcccaagtgagagttatttgcaactggaggagctggtgaagcaagtggtttctcctttcctcggcatcagcggggaccgtagcttctcaggccccacgtacacgctggccaggcggcactccagggtccggcccaaggtgactgtcctgaactatgcctccccgataaccgcagtcagccggccactgaatgagatggtcttgaccccactgacagagcaggagggggaagcctacctggagaagtgtggcagcgtgcggcggcacacggtggccaatgcccactcggacatccagctgctggccatggccaccatgatgcactcgggcctgggggaggaggccagcagtgagaacaagtgcctgctcctgccacccagcttccccccgccccaccggcagtgctccagtgagcccaacatcactgacaaccctgacggactggaggagggggccaggggcagccaggagggctcggagctgaactgtgcttccctcagctgagtcgccacccctgggcctttccatctcctgttttgcaaccaggatgaggacccctccatctccgtggattactgaggggggctcttgctttatgcgatgctgccttatttcctttagggtactgtcctggtcaaaatgacctaaggggaaaccgttgttgtaaacctctttattttggtgactgtgaccacttctttgtagccaccaattgtagtgaccagttgcctaatggtcactttctgactccagccttgccagcctgactcagatcctcatctctgggcctttctccctccgatgttggactgcctgatgctcccaatgacatatccaatgctcctggcatttctggagcaggaggttgtcaggacaacacatataaccaccaaggatgtgttggcctttggagttcccctttaggttcctagtgatgtggaggtttatgggtgaaaaattagtggagagggaactcctctcccccattttgtgtagagtgaaaatagcctgaagcccctactcagcagggctctgggaatgtgccttccttattttagtttcagaattgctgggaaagttaccccactggtgggtgaggatctatcctcaacctacatccagatcctatgtgctgcttgcacagaggcctttggcttttgacccaggagggccgcgaggctggagctgccctgtctttcattgagccttagcatttccctctcaggcttcctctcaagctcaaggaactcacccccagataagaagctggtgcctcttgtctctctcatttcagaaacggactttctcatcatgctttcctatggtgggtatgaggggccagctgataccaaccaactggcctgtatctatctatctggatttgacttgaatttttaaaatgtgtatcgttt

SEQ ID NO: 16698 - DNA, 544 bp, Homo sapiens
  ENST00000527172
acatttattgtgcccaagacttttgtgggctctctgccaggaaagggcaggtcattgaatgggccctgggaaaaatgatgtctgagcttctctccagttctcagagaaagaagaggcaattcggacataaagagaaacatcaagggcatgagtgcacagaggaaagaccatgtgacggcatggctacaaggcagccatctgtaaaccaaggagagagaccccaaaggaaatcaaccctgctgacaccttgatcgtggacttctagcctccagaactgtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgag

SEQ ID NO: 16699 - DNA, 572 bp, Homo sapiens
  ENST00000532121
ggaacctggcactagaatgtgagcaaaaaagaggcaattctgctgacttcagagaagcttccttgcagaaggaatctgaaacacgagcaactctctggggaggatgagaagctcttctacaaggaggaggaaaacataccttaggctatatggctgctgggaatccaggttaaaatgtttaaccctggagaaaaagaggtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgagctccagctcagcctggaacagcgttcagactgctgtgatcaacgttttcaaagggggtggcttgcaaagcaacgagctctatgccctgaacgaaaacatcaggcgg

SEQ ID NO: 16700 - DNA, 592 bp, Homo sapiens
  ENST00000526728
accagagactcctgccttccattggcgaaccggtcaccggctccgtcctgaaaacagaacttgctccgagtgataagaggcaattcggacataaagagaaacatcaagggcatgagtgcacagaggaaagaccatgtgacggcatggctacaaggcagccatctgtaaaccaaggagagagaccccaaaggaaatcaaccctgctgacaccttgatcgtggacttctagcctccagaactgtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgagctccagctcagcctggaacagcgttcagactgctgtgatcaacgttttcaaagggggtggcttgcaaagcaacgagctctatgc

SEQ ID NO: 16701 - DNA, 3930 bp, Homo sapiens
  ENST00000378867
ggggcagctgggccgggggcgggggtcggctgcagatctcccgttgtgtgagagaaacgcaagcacggagctcccttgacctgctgcatcctcctcggcaattttttttttttaagtcaaaaagcttggatttcctgaaattgttgaactggatgcgcgcggagtctggggcggaggcgagcggcgggtgtgcgcgactcggggtgattcacgccggggaccccaaggaggtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgagctccagctcagcctggaacagcgttcagactgctgtgatcaacgttttcaaagggggtggcttgcaaagcaacgagctctatgccctgaacgaaaacatcaggcggctgttgaagagtgaacttggatcattcattacagactattttcagaaccagcttcttgcaaaaggactgttctttgtggaggagaagatcaagctgtgtgaaggtgaaaatcgcattgaggttctggctgaagtctgggaccacttcttcactgagactctccctaccctgcaggcaatattttatccagttcagggccaggagctgactatccgccagatctccctgctgggcttccgagacctagtcttgctgaaggtgaagctgggtgacctgctgctgctggcccagtccaagctgccctcgtccattgtccagatgttgctcatcctgcagagtgttcacgagcccacaggcccaagtgagagttatttgcaactggaggagctggtgaagcaagtggtttctcctttcctcggcatcagcggggaccgtagcttctcaggccccacgtacacgctggccaggcggcactccagggtccggcccaaggtgactgtcctgaactatgcctccccgataaccgcagtcagccggccactgaatgagatggtcttgaccccactgacagagcaggagggggaagcctacctggagaagtgtggcagcgtgcggcggcacacggtggccaatgcccactcggacatccagctgctggccatggccaccatgatgcactcgggcctgggggaggaggccagcagtgagaacaagtgcctgctcctgccacccagcttccccccgccccaccggcagtgctccagtgagcccaacatcactgacaaccctgacggactggaggagggggccaggggcagccaggagggctcggagctgaactgtgcttccctcagctgagtcgccacccctgggcctttccatctcctgttttgcaaccaggatgaggacccctccatctccgtggattactgaggggggctcttgctttatgcgatgctgccttatttcctttagggtactgtcctggtcaaaatgacctaaggggaaaccgttgttgtaaacctctttattttggtgactgtgaccacttctttgtagccaccaattgtagtgaccagttgcctaatggtcactttctgactccagccttgccagcctgactcagatcctcatctctgggcctttctccctccgatgttggactgcctgatgctcccaatgacatatccaatgctcctggcatttctggagcaggaggttgtcaggacaacacatataaccaccaaggatgtgttggcctttggagttcccctttaggttcctagtgatgtggaggtttatgggtgaaaaattagtggagagggaactcctctcccccattttgtgtagagtgaaaatagcctgaagcccctactcagcagggctctgggaatgtgccttccttattttagtttcagaattgctgggaaagttaccccactggtgggtgaggatctatcctcaacctacatccagatcctatgtgctgcttgcacagaggcctttggcttttgacccaggagggccgcgaggctggagctgccctgtctttcattgagccttagcatttccctctcaggcttcctctcaagctcaaggaactcacccccagataagaagctggtgcctcttgtctctctcatttcagaaacggactttctcatcatgctttcctatggtgggtatgaggggccagctgataccaaccaactggcctgtatctatctatctggatttgacttgaatttttaaaatgtgtatcgtttaaaaaaaaaaatgtttgcaaattttgcacataggatcttgcactgttcattttcagtggggtgagtcttcacactaaaaacacaagcagagctcctgggaaaagagactggaagtggttcaggataaagagatccatggtgggcagggctgttaggtcacagagctctagaagcagctggacttgaacccacaatggcttgtgtaaattcgtaaatttcatggtttctaggaaaagctgcattggggtggggagacccagtttgcctcataggcagaggattctccaggaagcatggaaaatggaatgtttccatgctttacagtgctgggagagaggggagatgtgggcaggaccttttggaaggatgtttattctctgtggttaaagaaatgctgagaatttctagcatgtgaagcacttgggggcagcaggccttggcacggtgctgcatccttctactgctccctccaggtctgggggcttttatccaccttgaatccctatcctcctctttgtagttgtcggtctcactgataacagctccagaaaaaaagacaaggctccccctctgacccttcctgttggtatttatgaaatctcaaagagatgagccaccttggcttccaatatggcaagagggtgctgggagaaggtgaagatcagtctaagctgccacggtgatgagaccttctcattatgtaactcttgatggcatttcccttctgagtgaagatttgaaatatgattgattagaattgtgctcttgatggctgggaatttagaaattttattttaagagttatttcattttcatcctaagagtgatgggagagaaatgtccaaaagagatctgctgatctgctgagagtttcaaacaaacaaaaaaataatctctatgtatgtgttggataaagtctacagactgactaacatgcattagcaaatggagcatcagtaggtagcaacatgataatttatgtaactgatagcttctgtccttattagtacacttaacatttgagactagtatttattgatccaggcaaagtaattaattaatcatgcttgggcttactttttcagtttgtaaggttaagcatatgtgcatgcgtgcgtgtgtatataaatgccttttccatatcttaaatgtccctgatgaggagagcagtcatcaattaaatatataagctcttaaaatgagaatggaagtgtcagtatagacccagtgtacttaagtgctgatgactgttagccagtttacaactttttaccatcgatgtacacatttgatatttgtgcagtaaatagactgtacctataaaaaattttattgatgtttatggtcatgttagctatcagagagctattggagtgagagctgaggtgtccttaaccactttttctctcctagattcattttcattatttatgctaggattttcttatggttgacatttgatgacaggaagcaatcatgactcttcaagtgagctcacagaaacctttcatgttgtctgtttccaaaatggattcaataaacaacattttgtccatgtta

SEQ ID NO: 16702 - DNA, 3071 bp, Homo sapiens
  ENST00000389693
agatctcccgttgtgtgagagaaacgcaagcacggagctcccttgacctgctgcatcctcctcggcaattttttttttttaagtcaaaaagcttggatttcctgaaattgttgaactggatgcggctgttgaagagtgaacttggatcattcattacagactattttcagaaccagcttcttgcaaaaggactgttctttgtggaggagaagatcaagctgtgtgaaggtgaaaatcgcattgaggttctggctgaagtctgggaccacttcttcactgagactctccctaccctgcaggcaatattttatccagttcagagtgttcacgagcccacaggcccaagtgagagttatttgcaactggaggagctggtgaagcaagtggtttctcctttcctcggcatcagcggggaccgtagcttctcaggccccacgtacacgctggccaggcggcactccagggtccggcccaaggtgactgtcctgaactatgcctccccgataaccgcagtcagccggccactgaatgagatggtcttgaccccactgacagagcaggagggggaagcctacctggagaagtgtggcagcgtgcggcggcacacggtggccaatgcccactcggacatccagctgctggccatggccaccatgatgcactcgggcctgggggaggaggccagcagtgagaacaagtgcctgctcctgccacccagcttccccccgccccaccggcagtgctccagtgagcccaacatcactgacaaccctgacggactggaggagggggccaggggcagccaggagggctcggagctgaactgtgcttccctcagctgagtcgccacccctgggcctttccatctcctgttttgcaaccaggatgaggacccctccatctccgtggattactgaggggggctcttgctttatgcgatgctgccttatttcctttagggtactgtcctggtcaaaatgacctaaggggaaaccgttgttgtaaacctctttattttggtgactgtgaccacttctttgtagccaccaattgtagtgaccagttgcctaatggtcactttctgactccagccttgccagcctgactcagatcctcatctctgggcctttctccctccgatgttggactgcctgatgctcccaatgacatatccaatgctcctggcatttctggagcaggaggttgtcaggacaacacatataaccaccaaggatgtgttggcctttggagttcccctttaggttcctagtgatgtggaggtttatgggtgaaaaattagtggagagggaactcctctcccccattttgtgtagagtgaaaatagcctgaagcccctactcagcagggctctgggaatgtgccttccttattttagtttcagaattgctgggaaagttaccccactggtgggtgaggatctatcctcaacctacatccagatcctatgtgctgcttgcacagaggcctttggcttttgacccaggagggccgcgaggctggagctgccctgtctttcattgagccttagcatttccctctcaggcttcctctcaagctcaaggaactcacccccagataagaagctggtgcctcttgtctctctcatttcagaaacggactttctcatcatgctttcctatggtgggtatgaggggccagctgataccaaccaactggcctgtatctatctatctggatttgacttgaatttttaaaatgtgtatcgtttaaaaaaaaaaatgtttgcaaattttgcacataggatcttgcactgttcattttcagtggggtgagtcttcacactaaaaacacaagcagagctcctgggaaaagagactggaagtggttcaggataaagagatccatggtgggcagggctgttaggtcacagagctctagaagcagctggacttgaacccacaatggcttgtgtaaattcgtaaatttcatggtttctaggaaaagctgcattggggtggggagacccagtttgcctcataggcagaggattctccaggaagcatggaaaatggaatgtttccatgctttacagtgctgggagagaggggagatgtgggcaggaccttttggaaggatgtttattctctgtggttaaagaaatgctgagaatttctagcatgtgaagcacttgggggcagcaggccttggcacggtgctgcatccttctactgctccctccaggtctgggggcttttatccaccttgaatccctatcctcctctttgtagttgtcggtctcactgataacagctccagaaaaaaagacaaggctccccctctgacccttcctgttggtatttatgaaatctcaaagagatgagccaccttggcttccaatatggcaagagggtgctgggagaaggtgaagatcagtctaagctgccacggtgatgagaccttctcattatgtaactcttgatggcatttcccttctgagtgaagatttgaaatatgattgattagaattgtgctcttgatggctgggaatttagaaattttattttaagagttatttcattttcatcctaagagtgatgggagagaaatgtccaaaagagatctgctgatctgctgagagtttcaaacaaacaaaaaaataatctctatgtatgtgttggataaagtctacagactgactaacatgcattagcaaatggagcatcagtaggtagcaacatgataatttatgtaactgatagcttctgtccttattagtacacttaacatttgagactagtatttattgatccaggcaaagtaattaattaatcatgcttgggcttactttttcagtttgtaaggttaagcatatgtgcatgcgtgcgtgtgtatataaatgccttttccatatcttaaatgtccctgatgaggagagcagtcatcaattaaatatataagctcttaaaatgagaatggaagtgtcagtatagacccagtgtacttaagtgctgatgactgttagccagtttacaactttttaccatcgatgtacacatttgatatttgtgcagtaaatagactgtacctat

SEQ ID NO: 16703 - DNA, 548 bp, Homo sapiens
  ENST00000524380
agttgctgaaggggaggaggagtgagatggggtgaagcgcgcggagtctggggcggaggcgagcggcgggtgtgcgcgactcggggtgattcacgccggggaccccaaggagaagaggcaattcggacataaagagaaacatcaagggcatgagtgcacagaggaaagaccatgtgacggcatggctacaaggcagccatctgtaaaccaaggagagagaccccaaaggaaatcaaccctgctgacaccttgatcgtggacttctagcctccagaactgtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgagct

SEQ ID NO: 16704 - DNA, 805 bp, Homo sapiens
  ENST00000526682
cgtaagatgagagaggagggaaacgtgtcaccagcccggctgtgggagctccgcggccgaagcgtttgttgactcgcgctggagaggaaccgaggctggacgggaccccatctgagggcagagctgggggaggagggagggacggagggagggagagctgggcagagcgcgacggggagaaccatccaggtcgctcatttctctccggtgagaaaacttcctcgggaagaccggaaactttttcctaggcgcgcggagtctggggcggaggcgagcggcgggtgtgcgcgactcggggtgattcacgccggggaccccaaggagaagaggcaattcggacataaagagaaacatcaagggcatgagtgcacagaggaaagaccatgtgacggcatggctacaaggcagccatctgtaaaccaaggagagagaccccaaaggaaatcaaccctgctgacaccttgatcgtggacttctagcctccagaactgtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgagctccagctcagcctggaacagcgttcagactgctgtgatcaacgttt

SEQ ID NO: 16705 - DNA, 535 bp, Homo sapiens
  ENST00000532843
gtaagatgagagaggagggaaacgtgtcaccagcccggctgtgggagctccgcggccgaagcgtttgttgactcgcgctggagaggaaccgaggctggacgggaccccatctgagggcagagctgggggaggagggagggacggagggagggagagctgggcagagcgcgacggggagaaccatccaggtcgctcatttctctccggtgagaaaacttcctcgggaagaccggaaactttttcctaggcgcgcggagtctggggcggaggcgagcggcgggtgtgcgcgactcggggtgattcacgccggggaccccaaggagagctagacccaatacagaattgatttgaaaaacagtgtgtgagttcctctgaaagatccttacaatgtctaatgttcatcattaaagtttatggcctttgtagattaatcctcggatttcatgtacgggagagagaaagagagaaaaaaagcaaagatgtctttgaggagaccacatcgactgctgccatcattttggagaactgtttcatc

SEQ ID NO: 16706 - DNA, 553 bp, Homo sapiens
  ENST00000527751
aaacgtgtcaccagcccggctgtgggagctccgcggccgaagcgtttgttgactcgcgctggagaggaaccgaggctggacgggaccccatctgagggcagagctgggggaggagggagggacggagggagggagagctgggcagagcgcgacggggagaaccatccaggtcgctcatttctctccggtgagaaaacttcctcgggaagaccggaaactttttcctaggcgcgcggagtctggggcggaggcgagcggcgggtgtgcgcgactcggggtgattcacgccggggaccccaaggagaagaggcaattcggacataaagagaaacatcaagggcatgagtgcacagaggaaagaccatgtgacggcatggctacaaggcagccatctgtaaaccaaggagagagaccccaaaggaaatcaaccctgctgacaccttgatcgtggacttctagcctccagaactgaaaaaagaaaaaaggaatctcctggcaggctcaacagtgagccaggcgtgagtctgggacacttccggccggggctgaagcc

SEQ ID NO: 16707 - DNA, 577 bp, Homo sapiens
  ENST00000530252
aacgtgtcaccagcccggctgtgggagctccgcggccgaagcgtttgttgactcgcgctggagaggaaccgaggctggacgggaccccatctgagggcagagctgggggaggagggagggacggagggagggagagctgggcagagcgcgacggggagaaccatccaggtcgctcatttctctccggtgagaaaacttcctcgggaagaccggaaactttttcctaggcgcgcggagtctggggcggaggcgagcggcgggtgtgcgcgactcggggtgattcacgccggggaccccaaggaggtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgagctccag

SEQ ID NO: 16708 - DNA, 366 bp, Homo sapiens
  ENST00000532578
agagcgcgacggggagaaccatccaggtcgctcatttctctccggtgagaaaacttcctcgggaagaccggaaactttttcctaggcgcgcggagtctggggcggaggcgagcggcgggtgtgcgcgactcggggtgattcacgccggggaccccaaggagaagaggcaattcggacataaagagaaacatcaagggcatgagtgcacagaggaaagaccatgtgacggcatggctacaaggcagccatctgtaaaccaaggagagagaccccaaaggaaatcaaccctgctgacaccttgatcgtggacttctagcctccagaactatgtagaaactgcagctcagagatgtccaaggtcacact

SEQ ID NO: 16709 - DNA, 554 bp, Homo sapiens
  ENST00000530050
attttccttgaggccgccgcccggggtgggaccaggctgtgtgcttgctaactgtgcttcaggaatccgctctgggatgccttcctgtctggcaaaaggggttacccccagttctacccagtccctgtcctcggtcacatgctgccgccgcctcttcccccgcggtgccgggagcccgcgttttgtttgtcagcagttaggcggtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgagctccagctcagcctggaacagcgttcagactgctgtgatcaacgttttcaaagggggtggcttgcaaagcaacgagctctatg

SEQ ID NO: 16710 - DNA, 783 bp, Homo sapiens
  ENST00000526679
tttccctttaggccactcttgtcaatgctcccaacggcctcctccttcctccctgtgctgctctggggaggtctcttggctctgcccggcagtaggaacagtggagacaaagacagcttcacattctcttcagctgtcaggattgagagtggcggattcgggaggagaaaaatgagtcagtggcaactcgttgtgtgtgactgtgcagtttatctgagtccgcgggagccatagtcgtaggctgaaaatgacccttatttaagagaggctgagtgcgtggttgtggctgcccaggcgctttgctggactaggcagcctgggaacactaactgagaagtggacggggacaggagccagcctgcggtcctcagtgtcttacagtttcctggagaagtggatgtttcggcaggaagatggtgttggctacgtttgtggttttaagaaagcctgagggcctgaaggcagcccctggagaagccctttccgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgagctccagctcagcctggaacagcgttcagactgctgtgatcaacgttttcaaagggggtggcttgcaaagcaacgagctctatgccctgaacgaaaacat

SEQ ID NO: 16711 - DNA, 740 bp, Homo sapiens
  ENST00000527487
cgagggcattcggaaccttctggtcctagaggtgaagctgaactgtcaccaggacttatgacccgcggcttcgctcccattctgcccgtcgagttccacaagatgggctccttccgcaggcctagaccgcgcttcatgagctcccccgtgctcagcgaccttccccgattccaagcagctcggcaggctctgcagctgagctccagctcagcctggaacagcgttcagactgctgtgatcaacgttttcaaagggggtggcttgcaaagcaacgagctctatgccctgaacgaaaacatcaggcggctgttgaagagtgaacttggatcattcattacagactattttcagaaccagcttcttgcaaaaggactgttctttgtggaggagaagatcaagctgtgtgaaggtgaaaatcgcattgaggttctggctgaagtctgggaccacttcttcactgagactctccctaccctgcaggcaatattttatccagttcagggccaggagctgactatccgccagatctccctgctgggcttccgagacctagtcttgctgaaggtgaagctgggtgacctgctgctgctggcccagtccaagctgccctcgtccattgtccagatgttgctcatcctgcagccaggcggcactccagggtccggcccaaggtgactgtcctgaactatgcctccccgataaccgcagtcagccggccactgaatgagatggtcttgacc

SEQ ID NO: 16712 - DNA, 597 bp, Homo sapiens
  ENST00000525672
gaactgaaagggcttcagagttgcaaggaagctgatggcaaggggagctactggacacagacctcgtcctgggtatggtgctgggggtgctggatgctggaccatggagcagacactgctgttcccaggtttacaggggaagcaagtgaggattaagccaggcggcactccagggtccggcccaaggtgactgtcctgaactatgcctccccgataaccgcagtcagccggccactgaatgagatggtcttgaccccactgacagagcaggagggggaagcctacctggagaagtgtggcagcgtgcggcggcacacggtggccaatgcccactcggacatccagctgctggccatggccaccatgatgcactcgggcctgggggaggaggccagcagtgagaacaagtgcctgctcctgccacccagcttccccccgccccaccggcagtgctccagtgagcccaacatcactgacaaccctgacggactggaggagggggccaggggcagccaggagggctcggagctgaactgtgcttccctcagctgagtcgccacccctgggcctttccatctcctgttttgcaaccaggat

SEQ ID NO: 16713 - DNA, 485 bp, Homo sapiens
  ENST00000529020
gggcttcagagttgcaaggaagctgatggcaaggggagctactggacacagacctcgtcctggtctccaggtcacccgcagggtaggtgaccagagccagagaagcggtttattcccggggctccgcactgcacccacgcgcccgcgcctgtgtttgactgcacgaggattctccggaggtgtcccttcctgccagccaggcctcacccctggccaggcggcactccagggtccggcccaaggtgactgtcctgaactatgcctccccgataaccgcagtcagccggccactgaatgagatggtcttgaccccactgacagagcaggagggggaagcctacctggagaagtgtggcagcgtgcggcggcacacggtggccaatgcccactcggacatccagctgctggccatggccaccatgatgcactcgggcctgggggaggaggccagcagtgagaacaagtgcctgctcctgccacccagc

SEQ ID NO: 16714 - DNA, 1493 bp, Homo sapiens
  ENST00000530627
gggagatcaaaagcctgggaaccaagtccccaacaaaggacccgaggacggccttatccaggctttgcatctctctgggggtttgaaaggagctgctcttgctggctccggtgcaggggatgaatgccagtgaatgccagtgttcagcagggctcctgccaggcggcactccagggtccggcccaaggtgactgtcctgaactatgcctccccgataaccgcagtcagccggccactgaatgagatggtcttgaccccactgacagagcaggagggggaagcctacctggagaagtgtggcagcgtgcggcggcacacggtggccaatgcccactcggacatccagctgctggccatggccaccatgatgcactcgggcctgggggaggaggccagcagtgagaacaagtgcctgctcctgccacccagcttccccccgccccaccggcagtgctccagtgagcccaacatcactgacaaccctgacggactggaggagggggccaggggcagccaggagggctcggagctgaactgtgcttccctcagctgagtcgccacccctgggcctttccatctcctgttttgcaaccaggatgaggacccctccatctccgtggattactgaggggggctcttgctttatgcgatgctgccttatttcctttagggtactgtcctggtcaaaatgacctaaggggaaaccgttgttgtaaacctctttattttggtgactgtgaccacttctttgtagccaccaattgtagtgaccagttgcctaatggtcactttctgactccagccttgccagcctgactcagatcctcatctctgggcctttctccctccgatgttggactgcctgatgctcccaatgacatatccaatgctcctggcatttctggagcaggaggttgtcaggacaacacatataaccaccaaggatgtgttggcctttggagttcccctttaggttcctagtgatgtggaggtttatgggtgaaaaattagtggagagggaactcctctcccccattttgtgtagagtgaaaatagcctgaagcccctactcagcagggctctgggaatgtgccttccttattttagtttcagaattgctgggaaagttaccccactggtgggtgaggatctatcctcaacctacatccagatcctatgtgctgcttgcacagaggcctttggcttttgacccaggagggccgcgaggctggagctgccctgtctttcattgagccttagcatttccctctcaggcttcctctcaagctcaaggaactcacccccagataagaagctggtgcctcttgtctctctcatttcagaaacggactttctcatcatgctttcctatggtgggtatgaggggccagctgataccaaccaactggcctgtatctatctatctggatttgacttgaatttttaaaatgtgtatcgtttaaaaaaaaaaatgtttgcaaattttgcacata

SEQ ID NO: 16715 - DNA, 4699 bp, Homo sapiens
  ENST00000296666
gcagccgcaggagcatgcgccgcccgtggccatcttgtaggcggggacacgccgaggtaacttccagggtgcgccttcgttgtcttctccaagctgtagttctacgtcccgacctccctatcataccacactcttcagcgaccacgcaggcactttcccggtccccagtataccataattgaagaaaaatgatggaagagagtggaatagagacaacaccacctgggactcctccaccaaatcctgcagggctggctgctactgctatgtcttctacccctgttccattagcggcaaccagttctttttcttctccaaatgtatcctccatggagtccttcccaccactcgcatactctactcctcagccgccccttcctcctgtgaggccttcagcaccattaccttttgtgcctcctcctgcagttccttctgtcccaccacttgttacttctatgccacctcctgtttctccatcaactgctgctgccttcggtaatcctcctgtatctcacttcccaccttcaacttctgccccaaacactcttttacctgcacccccttcgggtcctcctatatcaggattttctgttggttcaacttatgacattacaaggggacatgctgggagagctccccagacacccctgatgccatcattttctgcaccttcaggaacaggtcttttgccaactcctattactcagcaagccagtttgacatctctggcacagggaactggaaccacatcagccattactttcccagaggagcaagaagaccctagaattactagaggtcaggatgaagcatctgctggtggaatctggggttttattaagggtgtggctgggaatcctatggtgaagtctgtgcttgataagacaaaacattcagtagaaagcatgattacaacgctggaccctggcatggctccctatatcaaatctggaggtgaactggatattgtagtgacctcaaataaagaagtaaaagttgctgctgtccgagatgccttccaggaggtctttggcttagctgtggttgtaggggaagctggacagtccaatattgccccacaaccagtgggctatgcagctggattaaaaggtgctcaggaacggatagatagcttgcgtcgaactggggtgatccatgaaaaacagacagctgtgtcagtagaaaacttcattgcagaattgctgcctgacaaatggtttgacattggttgtttggtggttgaagatcctgtccatggcattcatctagaaacatttacacaagccacaccagtgcctttggaatttgtacagcaggctcaaagtctaactccccaggactataatctgaggtggtcaggccttttggtgacagtgggtgaagtcctggaaaagagtttactgaatgtcagccggactgattggcacatggcatttactgggatgtcccgtcggcagatgatctacagtgcagccagagcgatagcgggcatgtataaacagcgcctgccacccaggacagtgtgagaggagacctacctgggagactgagactttcccccacttttagcttgatgttaaagaagtggttgtaccttcctaaatcgaatagtctaaatgaatccagtagtttttatcattttcctgtagcctgcaatttttctttctctagaaaggcatcatgtcattccaggagacaaaaagaaacaaatcctttttatagtcataccatttcacctatcatagtactcaaaaaagaaaatatacaaatctatttacagcacaatttaatataccagatttataaggtggaaattcatgtgcagagacatttaacttaatgccatgtacttgattattttgttctttaaagaagacattattaaagaacatgttggttgaatgtttataaaagcatgatttgctttggcttcatctcttttctgtcagtctttgactacttttgtatgtgcacacgatctcagggctggtgctgagcagcctgctcaacagtcactataagacacctacttgtcgggagatgttccacatttctgtgcatgttttcagtaatatgggccaaaataatggaattgattattttcctttttggccatcacgtacacatgtaatctggaaaatcatacctttgtcaattttaaacataacttttggcatttcccagatttatactatgaacattggggtaatacattttattttttcattgctatatgacagctaaggggcaaatgattcaagtatattttaaatcagaagtattcaaattatttttgtataatactgttcagtacttccaagaataagctctgacaacagccattgtttctgcttccactcatattctctacacattttaatacagaaatttttgagagggggttactttattgcttgtgggttagtatgtctcttacttcaattaaggttacttatttggtttgccttaagcattacttttttaactttgtgccatttggtctttactttttatggatgttttcaaagaaactattttatattcaatctagtttatttagtctactgtatttctatttcgtggaagccttttcccctcaaataatatattatatcatttttggacttatataaatgataattaaataaatttttttcttaatactgttggactttgtatatacaagttcaaataactttttcgaagatagtttcttatataaatgtaatttaatttttttactcttctatacagttctttagatgtaaaagaattagcacaatctctggcagttttataaaagctgttgaagctcttgtcctgcactgtctttaggtatcataggtatcaggtttgctttgtgttaatgccacttcaagtcattatttggtttctgctatttttttacctgaggataagaagaatgaatattaaatttgaatattaaatatatgttactttccaagcactgtataatgactgttcagtgaatatcagacttccgtgtcattaaaagtcatgagagacagcacagagaggttataggttgccttggtgtacttttgtccaggagtaacagggacagaatactttctttctttccttcaagtacaagaaggctttctctaccatttgcgtctacactttattttaaaagctatccttttctagtagtattttatcatggcaatggcatgatgacaacaacagtctttcattacagactgaagggaagcatgtccttacttaaaatagttctgctactttccctcctattataaggaaatcttacagattctaaaaataccttaatttttctttgatttttattttaccaagtcacaaatgtctttttgatgttttgagaattgttctcatagaatcacaaatactgacatttcattagatgattattttcctagaatccccaaagagcagtggcagtccatggcttggttgaagctagaaattttcctgcccctggtgacctggtaagcctcctgctcggaaccgtgtgagtgggtgaggaagatgagagatggtcagatggaagagagaaatacatgaactgctctggcctctctggttctgttcttggcccagagtttttgaaaagcagcggagcatgactgacttcacatgctcagctttctcagccttttgtttattttgttgtccttagatttccctgttgtaaaaggggcaagaaaagtaactcatcatctctaacacaccatggcagcttagccaggtagtcttagtggtggtgtttaggcataagatatgctgatcatcagtctcaggccacagtttccttcactaatcgtccagcttgagtgttctgttctcttcctgcccatttccttgaacctcctgctctagccttggcggagggagagtgctatttgcttttgttctccctctgtcttaggaaaagccatctttaatatagttcttcaccactgttggggttgttttgtgattttttttttcttccgaagaactcctggttgttattggattttgtattttaatacaaattattgaattttataagcttgtacacaatatttaattagtgtgaaaggaaacaaagaatgcaggaaaaataatttaatatcaacctcagttgacaaggtgctcagattattcaattcgggatcctccttttgttaggtttttgagacaaccctagacctaaactgtgtcacagacttctgaatgtttaggcagtgctagtaatttcctcgtaatgattctgttattactttcctattctttattcctctttcttctgaagattaatgaagttgaaaattgaggtggataaatacaaaaaggtagtgtgatagtataagtatctaagtgcagatgaaagtgtgttatatacatccattcaaaattatgcaagttagtaattactcagggttaactaaattactttaatatgctgttgaatctactctgttccttggctagaaaaaattataaacaggactttgtagtttgggaagccaaattgataatattctatgttctaaaagttgggctatacataaattattaagaaatatggatttttattcccaggatatggtgttcattttatgatattacgcaggatgatgtattgagtaaaatcagttttgtaaatatgtaaatatgtcataaataaacaatgctttgacttatttccaaa

SEQ ID NO: 16716 - DNA, 703 bp, Homo sapiens
  ENST00000512871
atcttgtaggcggggacacgccgaggtaacttccagggtgcgccttcgttgtcttctccaagctgtagttctacgtcccgacctccctatcataccacactcttcagcgaccacgcaggcactttcccggtccccagtataccataattgaagaaaaatgatggaagagagtggaatagagacaacaccacctgggactcctccaccaaatcctgcagggctggctgctactgctatgtcttctacccctgttccattaggtacatgtagttgtctaacatctcgtgtgttttgagaatagtgaagatactatcatcttttctcagagtcaattaagaaaagaatgcatatattaaaacttctctattatttttcaggatgaaaggaaatagcctttttaatttaaagaatagaaagaaagtcttgtgtatttaaagtaagaaaacatcagtgttttgctttaggtggacttttgttctttatgttcataattttaccatcatttatattatggcagaaatatcctaaaaagcatgtgttagctttgtcttctgttctttttcttttttttgagacggagtttcacttgtcacccaggctggagtgcagtggtgcgatctcatctcactgcaacctccgcctcccaggttcaagtgattctcctgcctcagcctcccaagtagctgcaattacagcactcacc

SEQ ID NO: 16717 - DNA, 5504 bp, Homo sapiens
  ENST00000442138
ggggacacgccgaggtaacttccagggtgcgccttcgttgtcttctccaagctgtagttctacgtcccgacctccctatcataccacactcttcagcgaccacgcaggcactttcccggtccccagtataccataattgaagaaaaatgatggaagagagtggaatagagacaacaccacctgggactcctccaccaaatcctgcagggctggctgctactgctatgtcttctacccctgttccattagcggcaaccagttctttttcttctccaaatgtatcctccatggagtccttcccaccactcgcatactctactcctcagccgccccttcctcctgtgaggccttcagcaccattaccttttgtgcctcctcctgcagttccttctgtcccaccacttgttacttctatgccacctcctgtttctccatcaactgctgctgccttcggtaatcctcctgtatctcacttcccaccttcaacttctgccccaaacactcttttacctgcacccccttcgggtcctcctatatcaggattttctgttggttcaacttatgacattacaaggggacatgctgggagagctccccagacacccctgatgccatcattttctgcaccttcaggaacaggtcttttgccaactcctattactcagcaagccagtttgacatctctggcacagggaactggaaccacatcagccattactttcccagaggagcaagaagaccctagaattactagaggtcaggatgaagcatctgctggtggaatctggggttttattaagggtgtggctgggaatcctatggtgaagtctgtgcttgataagacaaaacattcagtagaaagcatgattacaacgctggaccctggcatggctccctatatcaaatctggaggtgaactggatattgtagtgacctcaaataaagaagtaaaagttgctgctgtccgagatgccttccaggaggtctttggcttagctgtggttgtaggggaagctggacagtccaatattgccccacaaccagtgggctatgcagctggattaaaaggtgctcaggaacggatagatagcttgcgtcgaactggggtgatccatgaaaaacagacagctgtgtcagtagaaaacttcattgcagaattgctgcctgacaaatggtttgacattggttgtttggtggttgaagatcctgtccatggcattcatctagaaacatttacacaagccacaccagtgcctttggaatttgtacagcaggttggttttctcctttgctttttcattatgctccagagaaacttacactattgttttcagaataaaaatttgttcggtttttttgttagaaatatgttcttgattttgtttcagtcatttttcttttagtatttttctttgctttttaatttcctgatccttccatgttgttttagtaccttcctccttttgttttccaggtgtctttgaaaggtaatacattacatggttaatcattatttctctcatttttttctttgtttttactctgagttctggaaaagatttaccttttctagttgttttatgtccgcctttcgtttgctttcccttttatctcacatttcatttccactgttatctccatttcccttttccttgattgattgtcctcctgttcatctttagtgaaatcaacattagaaaccttataggcacgtgtctttaggtttttggctgaaaaatggacctaatagtgtacctatccacacagtttccaggagaatgtaagtataaatgataatccttattcctctttttttttttttttggtgtgttttctctaatcctttcatgaacaaaatggaatataaatatatacttgcattggaatctctgtgctcttaagtggtattctattgacttttttctgtcaatttcataaaatttttgttacagttgtagtttgtacattgttaaatatcatttcaaaactgcctttcaaacttatttgggacatgaagacatttgagaatctaagaaaactattgggctgtctcccaagaaaaatgcgtgtatgtgtactttcatagaactttggcatatgtgttcacataatccctaaaagtaacctctggcctacttattacagtttagaaagggggctaagaattgatgcttggaatttgaaattttactgaaacttttatttataccgtaatttcttttcataagttcaagaaaacctttttatagatattaacattacactcatttcaatatgaaggtgattaaaagactgtaagtgaatactatgcatactgttatgccaataaattagaaaaattaggtgaaagagtggattttctaggaaaatagaagttttgccatagttaagagtattaggttgaaccaaatgacgttgttgcctttgatggtcagaaatagttatatattgtcagtttcatatgattcagcttaattgaagcattaaaatggaagaactttatgtaactaaaaaaaaaaaaatcactgagtaccaatggtgttacaagtgagttctacaaaatgttcagagatgatttgctgtatgaggtatcaaaaatagaggtagagagttttccagttcattctgtgagactagcctcttttaactttaaatgaaattatagtccaaagaactaaatgtcaaaaccattggtaaaattaataaataaaattcagaaatgtattagatgaacattgtatcctgaccatgaaaaatttgtcccaagaacagcagaatggttcaacaatagtaaatttatgtaattcagtacatgaacatctgcattgaaaggagaaaaaagattttgataagagttgaaggtatttgctagaaataatcatactaatagctcttagtattagacgggtatgtgtgtactacaaaatcaaagcaaacttcagatctaataaataaaacactgaaaacgttataattatgaggatgctcctgtcactgccactgttaacattgctgtagatctggggtcagcaaacagtggctcacagccaaatctggcctgtcatctttttgtaattaagtttattggaacacacccatgccagtttgcttacttattgtttatagctgcttttgtactatagcagcagaaatgaatagttgcaacagagaatgtctggcccacaaagcctaaaatatttaccatctggctcttttcagaaaaagtttgctgacccctgtgttagatatctgaccattgcaaaggacaatttttatgttgtttttaggaatatatactggaaagaagtagacatgaaagaatgaagtggactcgtgtgtaccagtaccaaaagatagctattacatattgctgagtaaaagtcaaaaacagcacatctagtatgatcccatttactagcaggcgtgtgtatgtgtgtgctttaaaattttaataagaatagggaaaaaggcctggaaagataacacagcaaactgttaatagtggttaattctgaataatggtatttaaagggtgttatttgctttttactttgctttttattctgtttgttttattttgtgtcatttggttttaaaatttagaagatacaaaactgtgtgcattgaaatgtcttctttttatcctcagctattcagctctcctccctgtttctttttattcattctaaaatgttttatgcttttttattgttggaattttttaatttaaggtaatggaaatcagcccttcaggtaattagaattatcagtatatattagtaaaaatctggaaataaatttcatacaatttgtacttgttaaacttaaatataaatgattcctcacccccataaaaaaccccagctgttctggatttttgccaataatatagaataccttgtttctaaaaagtgtggtccttggcttaacatcataagcagcacctagaaatttgttaaaatgcagattctcgggtcctaacacaggactagtgaatcaggagctgcattttaacaagatattcaggggattcataggcatgccataatttgagaagcacagtgttactggtgtctctgaggacgttagtagtatatctgctgtttctctttgaaatatagtgaaatactgatactgtagtatacacattggaagagagtacttagagcaggggttcccaagtgctggactgtttgcatcagattgacttggaagctattttacgtacgtaatactgtactgtttctcttggaaccagctgtagagtttccaattcagttatcttggtgtctcagttatcttagtgggatgtgagaaactggatatcgttaaaaaagaaaaaagaaacaagagctcctcaggtgattgtaatacatggcacatttggtagtcatgtataactgtatagatccgttctagatgtggctatacttctctggactatacctaacaccctaaaacagaaaaaccacatcagtcttggatatcaagcaatgagtttattcttctgtcattcctttgtagatgaataaatgatttgaataggagcaaatatgagttgggtcaattaggaatgttgcatcagtggttgatgttgtccaggactggatattacttgatacatattaacatgtgaatcacatttccagagagaatttccataattgagcaattcttttctgaatggatttaagccttaattttcagttttcctctttctggttgaaattttactactataaaagataactttagcactgattttagtaccaatcttattattaacctgaagtgacacttaatttagaactagaactcaaaccttccgactgttagcctcgttaatggggatattttttaaaaaatagatgtgtgtaatgttacattgattgtgttctagccttgtaagttgatatagttggcagcctagctgtatttctcagagtttgtcataatctatatttaaaataacatgaaacactttgaaatgtcacttatagctagttccaatgatatttttaaatgtattataagtaatatcaatttcatctttccacaggctcaaagtctaactccccaggactataatctgaggtggtcaggccttttggtgacagtgggtgaagtcctggaaaagagtttactgaatgtcagccggactgattggcacatggcatttactgggatgtcccgtcggcagatgatctacagtgcagccagagcgatagcgggcatgtataaacagcgcctgccacccaggacagtgtgagaggagacctacctgggagactgagactttcccccacttttagcttgatgttaaagaagtggttgtaccttcctaaatcgaatagtctaaatgaatccagtagtttttatcattttcctgtagcctgcaatttttctttctctagaaaggcatcatgtcattccaggagacaaaaagaaacaaatcctttttatagtcataccatttcacctatcatagtactcaaaaaagaaaa

SEQ ID NO: 16718 - DNA, 2726 bp, Homo sapiens
  ENST00000512635
cacgccgaggtaacttccagggtgcgccttcgttgtcttctccaagctgtagttctacgtcccgacctccctatcataccacactcttcagcgaccacgcaggcactttcccggtccccagtataccataattgaagaaaaatgatggaagagagtggaatagagacaacaccacctgggactcctccaccaaatcctgcagggctggctgctactgctatgtcttctacccctgttccattagcggcaaccagttctttttcttctccaaatgtatcctccatggagtccttcccaccactcgcatactctactcctcagccgccccttcctcctgtgaggccttcagcaccattaccttttgtgcctcctcctgcagttccttctgtcccaccacttgttacttctatgccacctcctgtttctccatcaactgctgctgccttcggtaatcctcctgtatctcacttcccaccttcaacttctgccccaaacactcttttacctgcacccccttcgggtcctcctatatcaggattttctgttggttcaacttatgacattacaaggggacatgctgggagagctccccagacacccctgatgccatcattttctgcaccttcaggaacaggtcttttgccaactcctattactcagcaagccagtttgacatctctggcacagggaactggaaccacatcagccattactttcccagaggagcaagaagaccctagaattactagaggtcaggatgaagcatctgctggtggaatctggggttttattaagggtgtggctgggaatcctatggtgaagtctgtgcttgataagacaaaacattcagtagaaagcatgattacaacgctggaccctggcatggctccctatatcaaatctggaggtgaactggatattgtagtgacctcaaataaagaagtaaaagttgctgctgtccgagatgccttccaggaggtctttggcttagctgtggttgtaggggaagctggacagtccaatattgccccacaaccagtgggctatgcagctggattaaaaggtgctcaggaacggatagatagcttgcgtcgaactggggtgatccatgaaaaacagacagctgtgtcagtagaaaacttcattgcagaattgctgcctgacaaatggtttgacattggttgtttggtggttgaagatcctgtccatggcattcatctagaaacatttacacaagccacaccagtgcctttggaatttgtacagcaggctcaaagtctaactccccaggactataatctgaggtggtcaggccttttggtgacagtgggtgaagtcctggaaaagagtttactgaatgtcagccggactgattggcacatggcatttactgggatgtcccgtcggcagatgatctacagtgcagccagagcgatagcggatgattattttcctagaatccccaaagagcagtggcagtccatggcttggttgaagctagaaattttcctgcccctggtgacctggtaagcctcctgctcggaaccgtgtgagtgggtgaggaagatgagagatggtcagatggaagagagaaatacatgaactgctctggcctctctggttctgttcttggcccagagtttttgaaaagcagcggagcatgactgacttcacatgctcagctttctcagccttttgtttattttgttgtccttagatttccctgttgtaaaaggggcaagaaaagtaactcatcatctctaacacaccatggcagcttagccaggtagtcttagtggtggtgtttaggcataagatatgctgatcatcagtctcaggccacagtttccttcactaatcgtccagcttgagtgttctgttctcttcctgcccatttccttgaacctcctgctctagccttggcggagggagagtgctatttgcttttgttctccctctgtcttaggaaaagccatctttaatatagttcttcaccactgttggggttgttttgtgattttttttttcttccgaagaactcctggttgttattggattttgtattttaatacaaattattgaattttataagcttgtacacaatatttaattagtgtgaaaggaaacaaagaatgcaggaaaaataatttaatatcaacctcagttgacaaggtgctcagattattcaattcgggatcctccttttgttaggtttttgagacaaccctagacctaaactgtgtcacagacttctgaatgtttaggcagtgctagtaatttcctcgtaatgattctgttattactttcctattctttattcctctttcttctgaagattaatgaagttgaaaattgaggtggataaatacaaaaaggtagtgtgatagtataagtatctaagtgcagatgaaagtgtgttatatacatccattcaaaattatgcaagttagtaattactcagggttaactaaattactttaatatgctgttgaatctactctgttccttggctagaaaaaattataaacaggactttgtagtttgggaagccaaattgataatattctatgttctaaaagttgggctatacataaattattaagaaatatggatttttattcccaggatatggtgttcattttatgatattacgcaggatgatgtattgagtaaaatcagttttgtaaatatgtaaatatgtcataaataaacaatgctttgactta

SEQ ID NO: 16719 - DNA, 703 bp, Homo sapiens
  ENST00000507774
aggctcagctgtggcggcgtgcggggtgcagcaggcaggagtgcacatcgcaagtataccataattgaagaaaaatgatggaagagagtggaatagagacaacaccacctgggactcctccaccaaatcctgcagggctggctgctactgctatgtcttctacccctgttccattaggtacatgtagttgtctaacatctcgtgtgttttgagaatagtgaagatactatcatcttttctcagagtcaattaagaaaagaatgcatatattaaaacttctctattatttttcaggatgaaaggaaatagcctttttaatttaaagaatagaaagaaagtcttgtgtatttaaagtaagaaaacatcagtgttttgctttaggtggacttttgttctttatgttcataattttaccatcatttatattatggcagaaatatcctaaaaagcatgtgttagctttgtcttctgttctttttcttttttttgagacggagtttcacttgtcacccaggctggagtgcagtggtgcgatctcatctcactgcaacctccgcctcccaggttcaagtgattctcctgcctcagcctcccaagtagctgcaattacagcactcaccaccatgctcagctaatttttgtatttttagtagaaatgggatttcacaattttggccaggctggtctcaaactcctgacctca

SEQ ID NO: 16720 - DNA, 837 bp, Homo sapiens
  ENST00000513427
tgtttggtggttgaagatcctgtccatggcattcatctagaaacatttacacaagccacaccagtgcctttggaatttgtacagcaggctcaaagtctaactccccaggactataatctgaggtggtcaggccttttggtgacagtgggtgaagtcctggaaaagagtttactgaatgtcagccggactgattggcacatggcatttactgggatgtcccgtcggcagatgatctacagtgcagccagagcgatagcgggcatgtataaacagcgcctgccacccaggacagtgtgagaggagacctacctgggagactgagactttcccccacttttagcttgatgttaaagaagtggttgtaccttcctaaatcgaatagtctaaatgaatccagtagtttttatcattttcctgtagcctgcaatttttctttctctagaaaggcatcatgtcattccaggagacaaaaagaaacaaatcctttttatagtcataccatttcacctatcatagtactcaaaaaagaaaatatacaaatctatttacagcacaatttaatataccagatttataaggtggaaattcatgtgcagagacatttaacttaatgccatgtacttgattattttgttctttaaagaagacattattaaagaacatgttggttgaatgtttataaaagcatgatttgctttggcttcatctcttttctgtcagtctttgactacttttgtatgtgcacacgatctcagggctggtgctgagcagcctgctcaacagtcactataagacacctacttgtcgggagatgttccacatttctgtgcatgtttt

SEQ ID NO: 16721 - DNA, 339 bp, Homo sapiens
  ENST00000448726
gcagcgcgacgattgcggcctggcgatcggggcactgcggtcgtggcgcgcgaggcgcggggcgcgaggccagccctggaacggcggggtgtggggggcgggcagctgcggagcccccagaggaaagcaggggcaggcaggggggtgccgagagaagtgagaccctgcagctgagggagcatcatggcagtgtttctggaggccaaggatgcccattcggtcctgaaacgattccctcgtgccaatgagttcctggaggagctgcgccagggcaccatcgagcgagagtgcatggaggagatctgcagctacgaggaggtcaaggaagtgtttgagaac

SEQ ID NO: 16722 - DNA, 650 bp, Homo sapiens
  ENST00000370354
ggcgcagcagcgaggtggcgggctgcgtgcgcaaacagggcggccgccttctgggcccggagaacgagaagtgagaccctgcagctgagggagcatcatggcaggcctcagtagggctctctcctcagtgtttctggaggccaaggatgcccattcggtcctgaaacgattccctcgtgccaatgagttcctggaggagctgcgccagggcaccatcgagcgagagtgcatggaggagatctgcagctacgaggaggtcaaggaagtgtttgagaacaaagagaaaacggcatgtaccaccctggggctggttctgggagtaggagtagcctcaggaatagcaagaacaggccctggtaatgcagaccaatcagaagcaaggaaagacacccagcctaaggcatagccactagggccatcacggagcagataaaatggagttctggaaagggtacccaaatgcagtctactctgtccgagacccctcgcagagctcagatgccatgtatgtggtggtaccccttctgggggtggcactgctgattgtcatcgccttgttcatcatctggaggtgccagctgcagaaagcgacccgtcaccacccctcctatgctcagaaccggtacctagccagtcgcgccgggcacacc

SEQ ID NO: 16723 - DNA, 5977 bp, Homo sapiens
  ENST00000370353
tagttgtgaattctggtcctgccactgtcactgttgatttgcttaaccttgtctgagcccgtctctctgggctgtatctcctcatctatctctgaggtcctttccaattggaagttgcaaagattcattgaggggagcaaggaaggaggagcctcagcctttaggagctttcctttttaaaagaaaaaggtcaacccttggttcttatagatgctcagaacatgttcttgggggaaaacgctgaaaggtttgctttgggccctactgggcctggggaggtctctggagaagagcttggggcagaatgagaagcagcggaagccatgggtggctgcatggaggacgacgcaccccacaagagaagtgagaccctgcagctgagggagcatcatggcagtgtttctggaggccaaggatgcccattcggtcctgaaacgattccctcgtgccaatgagttcctggaggagctgcgccagggcaccatcgagcgagagtgcatggaggagatctgcagctacgaggaggtcaaggaagtgtttgagaacaaagagaaaacgatggagttctggaaagggtacccaaatgcagtctactctgtccgagacccctcgcagagctcagatgccatgtatgtggtggtaccccttctgggggtggcactgctgattgtcatcgccttgttcatcatctggaggtgccagctgcagaaagcgacccgtcaccacccctcctatgctcagaaccggtacctagccagtcgcgccgggcacaccctcccccgggtcatggtgtaccggggtactgtgcatagccaaggggagccttctgggcaccgagaggcagcgaacagcccccaggtggtgctggggcccagtcgggggggcaggaccacagtccggctagagagcaccctctacctccctgagctctctctctccagactgtccagcaccacccctcccccctcctacgaggaggtgactgcgccccaagagagcagcagtgaggaggccagcgtgtcttacagtgacccacccccaaagtacgaggagatagtggccgccaaccctggcgctgacaagtagtgggacgtttgtgccctgtcctggatgaacgcctctttccgaggtctcctattttctttttaactttttaaagactgtgccaccacaaaacagccttagcctccttgttgccaaataattccctaactgtggagttttaggaagtcagttgtcagagacaggtggggagggtgggggtagggaccacgcatgagtcgaagcccccgggaagagccaaaggccaaagtgcccaactctttgggatgacccccaagcctccaacatcctgtctttccatcaggaactggcttctcttatgccaaaggaataaccccattgagttgattgtggccagaatgtccacaggcctggcctgggggctgtgggactggctggaggcctgcctgtgtctagagctctgggcctcaggggtaagggaaggaagccagcctttcagcaccccttaccctccacagttctgtgatttctgtccttgcttacatttggaggacagggacaaggactgagcaaaaacaaaatgaaaaaatcatgacaaataaataattaacacaatagaacaaaactctagcacccgggccgttcataggaggccaagggaaatttatcacatggatctgtgatgtccgcctcccctaaaacctgtccccacactcctggaaggaggacagggtgtgtgaaggatgagggccagagggctgggtggcagagtttcctcttccacattgaccaaggggcccacgtggactctgccattcagtttctagtgtgcttgtctctccagacatgtggaccagctgtgttcaaaccactacccactggcatgagcctactttttgcgaatggtgcattgaaattgaacttcagattgaggatttctccttaacgatggtgcgcatctcaggagaagatcctaaagtgtcccttttaaaacatttatttgtggagaagcccgtggcctggggttgaaggcccatatggggtttgctctgctgttgccaggtgccagtctgttttcagtgaggctttggacagcagtggggcagaaggcacctgccctttaactgtcagtgaccatgctagacactgttgataccacctccccctacttccgtctccatcctcctgacctcaacaccaaaccatttctcctctgtggtgctttaaaaattgtagcaaatttttgtgtggtgcaagaatgcatggcctgcgtctattggcaaccacagcaatttaaaatccactgagctgacaagcttttttctgtcaaaatatctctctaaggcagacattgggactcatttccttgaatgcagccctgccttcaggccacagaggacttctggaggctgctctagccctgaggacttgccctgggacgtgcttccagttagaaggcttgtgtccctaccccagtgaggccaccagcttggaccactccaccctgtggctggggttttccatccttccccctacctcacaggcccgttggaggctgactgagcaaatgcctgcgaagtgcttgaattgccggggagccagcgaggtttgccttaggaagagtcttctagaaaggtgtaggttataagggagcagtcttagctgaggccctcatatgcctctgatgttgagtctccacttggagagtcaatctcccgtcagttgaccctttccatcctctcgtcctccctttccagagctccctgatgccagagatgctggtgaatgcaggtgacattctacctttcgtttccttgtctttccctcccctgggccttcagcattgcactcctgcccttcatcacaaaggggtttttggcttaagaggcccctgctttttccatgttgggggacctggggaagcctgaagctcggggctagccctggctctcccagtatttcttcaagtaggtgccagagtgtgacctgggagcaggtgagaagaaacttatcccaatatgtctactcagttagcacagagccaggcatgagctccactgatcagagccaaagggagtttgccaagaaatgcccgctgcctttggcatctgagttgcagctgggtggtaatgggagagagcaggaagaggcccaaggcctggcccatggagggcaacatgtgtccttcaggggctgaggacaggccgtgggaagagtcacaggaggttgcttaaggcctgtgatgttcggttcagatgcttcatggtgttctgccaggtggggttgcaccacggtctctgggatggtttctgcagcacattgtagaaaaaagactgtacagcacacagcaggcatcactccttgcgatgcacacttggattttatgaatgccctgtacatatcttttcaaactctgtgtttgtatggaggtggatttgatacaatgctgactctttcgtggctacatttttgctgtttttggacttctatgtgtgtgtgtgtgtgtgtgtgtgtgtgtatctatgtgtgcacgttgccttttctcattgcttatctgaaacaatagccggtgtgcagctatatttgtaccaggagggatccggtctgaaaagaggaatgtcacctcccctcgcagggctgagtagcctgatgacagggccctgagcaaggaaacgtggcattaactatattggacacccaacccccaaagttgtcactgtttgcctccttgaaaaaggctttggaagaagacaaagcagctccattctgcaggtctccaccctatgcaacccccgctcacacgcccttttggcatggtgcccctggcccaggcttctgttctgtgggtgtcagcagctgaaagaaatctgagtactcctgggcatggttttttttttttttttttttttttttttttttttttttttttttttttttttttttgtgtgtgtgtgtgtgtgtgtgtgtgtgtgtgtgtgtgtgtatggaaagatgtgtgactattgactttgggtatcgcgggactagttaattagatgtttttcatttttcaaaaagaaaaggttttaaaaattttcttgaaatgtgactgtcacttgttttcaaccaaaaactttttaagattttttaaaagaaaaatcgaaatcctgtccctcccccgcttcccatcgcctccggttttcaaaatgaaagcacaagtgcaagagtggggtgcacaggtgcctggcgtgtacacaccacccacacagctgcgtccagccctggctgagggagacgcagtgctgagcagtcagccccgggaggcctctttttcaacttccaatcccactgccatgaatgtgaattccttagggtgcttccaaaaacaggagtctgcctgatctgttggacattgcctttttggtagcccgaatatgaggaattcaggacaggaaagtgtctttttgtcaagtagtcagagccggatgcttcccctctcccagtgggtggagcatcgcaacccccagccagagttgatcttttgacaacccagtgacatcccatgagaaggaagaaaaaaaattcaacactgcctctagattgttattttgtccaagagagagatcatggagagagtctctctcgctcacggaggctctgtctttctaggagtatgtgtgtgtgctgtctcatgtgtggacactcacagttgaggctgagatggatatcttggcagcagagctgctggtctaggtggcttttcagcttgacaagtaatgaagctccatttcaggacttcatcgattccgaaacaagcacagccccccaccccccgccacggaactctactaatactaatcactataattagctaatttaaaagtacggtaatcagactgcttgcaactattttaaaagcccattaatttgaagcccactacttcagaacttcgagaaaatcacaacttaagacaattcacagtagctgtgattctggctacataaaaatatttgaaatattcttccctttagtcaatgttcagggtcttttgtgtaagagaaatccagtttaaaatgagtacccttttcaaagaaaaggctcaagatattaaggatcccttcaccgtgccttcagctttgcagttcagcacttctcgtatgtacagggtgatctcttgttctctctccatcacagggatgttggatattgcagcctttcactctactccgttatttatcctgtgaataacatagtttgtgaactagactgcaatttaaactaatacacatgatgtatctttctaaatattctgtaaagcagatgcttcgctgtcagactggccgctccatcattcgcctccaaatattcaaacgtgggagcttttcctttcagactgtgggcagcgagtctctctctagcaagaatttatctgacaaacatacccaaatagcacaccctctcaagctcaatgcctcaacagttgtttcactgtactgatatctgactgctgaacagtgcctgcccttcacccacccccagcccgagcattaacacagatcttcaggattgggacaaatcccccagctgcttttgcctctcaatccatctcccctcatcgataccaatttcccaggcctgaacacatctgttattttgctctgacattgtgaatttgtgacagtggaaaccctgatatgtgcaactgagcttatagaaataattactgtgaaatggattaattttgataccactttaaactgtgcttgtattcatgtgttgacccttgtcagctgggaaatctgtacattcagtatatgtcagcatttcattggagcctgggggcaacagacaaacttgcttctgatttctctctctctctctttctttttataattgttgaatttggctgttacattttgtctccttctttacaagaaaacaataataataaagagcaaatggcatccacttgaa

SEQ ID NO: 16724 - DNA, 379 bp, Homo sapiens
  ENST00000448324
gacccctcgcagagctcagatgccatgtatgtggtggtaccccttctgggggtggcactgctgattgtcatcgccttgttcatcatctggaggtgccagctgcagaaagcgacccgtcaccacccctcctatgctcagaaccgcagatgcttcgctgtcagactggccgctccatcattcgcctccaaatattcaaacgtgggagcttttcctttcagactgtgggcagcgagtctctctctagcaagaatttatctgacaaacatacccaaatagcacaccctctcaagctcaatgcctcaacagttgtttcactgtactgatatctgactgctgaacagtgcctgcccttcacccacccccagcccgagcattaaca

SEQ ID NO: 16725 - DNA, 1303 bp, Homo sapiens
  ENST00000538575
aggcaggggggtgccgagagaagtgagaccctgcagctgagggagcatcatggcagtgtttctggaggccaaggatgcccattcggtcctgaaacgattccctcgtgccaatgagttcctggaggagctgcgccagggcaccatcgagcgagagtgcatggaggagatctgcagctacgaggaggtcaaggaagtgtttgagaacaaagagaaaacgatggagttctggaaagggtacccaaatgcagtctactctgtccgagacccctcgcagagctcagatgccatgtatgtggtggtaccccttctgggggtggcactgctgattgtcatcgccttgttcatcatctggaggtgccagctgcagaaagcgacccgtcaccacccctcctatgctcagaaccggtacctagccagtcgcgccgggcacaccctcccccgggtcatggtgtaccggggtactgtgcatagccaaggggagccttctgggcaccgagaggcagcgaacagcccccaggtggtgctggggcccagtcgggggggcaggaccacagtccggctagagagcaccctctacctccctgagctctctctctccagactgtccagcaccacccctcccccctcctacgaggaggtgactgcgccccaagagagcagcagtgaggaggccagcgtgtcttacagtgacccacccccaaagtacgaggagatagtggccgccaaccctggcgctgacaagtagtgggacgtttgtgccctgtcctggatgaacgcctctttccgaggtctcctattttctttttaactttttaaagactgtgccaccacaaaacagccttagcctccttgttgccaaataattccctaactgtggagttttaggaagtcagttgtcagagacaggtggggagggtgggggtagggaccacgcatgagtcgaagcccccgggaagagccaaaggccaaagtgcccaactctttgggatgacccccaagcctccaacatcctgtctttccatcaggaactggcttctcttatgccaaaggaataaccccattgagttgattgtggccagaatgtccacaggcctggcctgggggctgtgggactggctggaggcctgcctgtgtctagagctctgggcctcaggggtaagggaaggaagccagcctttcagcaccccttaccctccacagttctgtgatttctgtccttgcttacatttggaggacagggacaaggactgagcaaaaacaaaatgaaaaaatcatgacaaataaataattaacacaatagaac

SEQ ID NO: 16726 - DNA, 534 bp, Homo sapiens
  ENST00000568516
ggaattcccaactcggacaggcccagaatagcccctggaggtttgaagaggccccgtcagaaacccaaacagagctgccagacgggaatgccgccctcccccgtccacactcatggccgctgctcagcccccagccgcatccctccccacgcgcgtcacggccctgaggccatggaatcccggtgaccgttggcgggaggggccggggacttaagaaggaggcgtctctcctggaggcgcgcgtgagaaggggcagggagggggcgcgagtggtccccgggccggttgcctgggtaacgcgtggctcccttgggctggcgggaggggccggaggctcgcgaggggcgggggcggcgacggcggcggagcgtaggggaggggaccggagaggaggggatgagcacacgggagaggagaagagggagacccgccgcctccctccctccctagctgacttgctccctcccgggctgcggctgctgcaaaagccagcagcggcagcgggagctgtccggaggccggcgtcgaggtgag

SEQ ID NO: 16727 - DNA, 520 bp, Homo sapiens
  ENST00000637596
gaggccatggtgggtggatgcggctgcggaaaggctggggagtccgagccctaggactgggagcagcgagggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaagaaacagtgtccaaaccagaagtgagcaaagaggccactgcagaccaggggtccaggctggagtctg

SEQ ID NO: 16728 - DNA, 564 bp, Homo sapiens
  ENST00000562148
atcttccttgccctcctgctcgtagagacgcctccacccggtcctgcctgtctcactggtcccgtctcctcgcagaaccctctccgtttcccccaaatccccgtctcttccaggaatcccggtgaccgttggcgggaggggccggggacttaagaaggaggcgtctctcctggaggcgcgcggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaa

SEQ ID NO: 16729 - DNA, 100 bp, Homo sapiens
  ENST00000637542
cgcagaaccctctccgtttcccccaaatccccgtctcttccaggaatcccgggtttgccgctgtctctgctattccatcctccccataggggctctctcc

SEQ ID NO: 16730 - DNA, 100 bp, Homo sapiens
  ENST00000636001
cgcgagtggtccccgggccggttgcctggccagcagcggcagcgggagctgtccggaggccggcgtcgagggtttgccgctgtctctgctattccatcct

SEQ ID NO: 16731 - DNA, 2567 bp, Homo sapiens
  ENST00000358758
gtaacgcgtggctcccttgggctggcgggaggggccggaggctcgcgaggggcgggggcggcgacggcggcggagcgtaggggaggggaccggagaggaggggatgagcacacgggagaggagaagagggagacccgccgcctccctccctccctagctgacttgctccctcccgggctgcggctgctgcaaaagccagcagcggcagcgggagctgtccggaggccggcgtcgagggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaagaaacagtgtccaaaccagaagtgagcaaagaggccactgcagaccaggggtccaggctggagtctgcagccccacctgaaccagccccagagcctgctccccaaccagacccccggccagattcccagcctacccccaagccagcccttcaaccagagctccctacccaggaggaccccacccctgagattctgtctgagagtgtaggggaaaagcaagagaatggggcagtggtgcccctgcaggctggtgatggggaagagggcccagcccctgagcctcactcaccaccctcaaaaaaatcccccccagccaatggggcccccccccgagtgctgcagcagctggttgaggaggatcgaatgagaagggcacacagtgggcatccaggatctccccgaggtagcctgagccgccaccccagctcccagttggcaggtcctggggtggaggggggtgaaggcacccagaaacctcgggactacatcatccttgccatcctgtcctgcttctgccccatgtggcctgtcaacatcgtggccttcgcttatgctgtcatgtcccggaacagcctgcagcagggggacgtggacggggcccagcgtctgggccgggtagccaagctcttaagcatcgtggcgctggtggggggagtcctcatcatcatcgcctcctgcgtcatcaacttaggcgtgtataagtgaggggctctgccccgcatcccaagacttttcttcctgttgggagctgccttgggcccatccctcccctggggggagcccaactgatggccctggcccccacccctaaggaccaagggagcctgagcggccttgtttacagcttctgtcctgctcctgcatcttgccaggctcctctgccaactgtaggcctgcctcatccctgcactggttccaacctccctgcactaatgcctgcatcccctccggcctcttggccccctatccctgcacttctggaaacctccctgcactctggaaacctccctgaacacctccccaactctgcgctctcagcctccctgcatctctcctggcctccctgcacttcttccagccccccaaattctctggacctccaccctggccgcctcctcccaactttcattgtcttggcatctctcaaccctcagtcctctcttccttcccttctttatcatctcccctttcctctccacgtcccgcccccttcctcttcctgcctcctcatctcccttaagcatcctcttctccaacctcccgtcaccgtttactctgcaaaattgacagcacttagacgaggcttgggggcagggagcagtgttgggagagggctccccaaccccaggctcggactgttctctgctgggaccacccagggtcggacacccaagggtgcctggcaggtcgcagagttggcaagccgggcctcgtatggggactcgggtgagggtggcgagtactggttccgaacgcacgcaggggagaagggagggacgcggcgctgacccttccaggtcagctggagttgacccgcccacctgggcttttcaaccccagtccgcgagtttctttcttgaaggtgtgggggctagattcattcacgtgcttcgtaatgaaataatccaaaaaataggaccaaagcgcccactggcaggagcgagggcggggcgccgcgctctataattattttctaagatgatgggggaggtttgttgcacgcgacagcccgctgaggaggcggggaccgagctacaacgcggttcggatttggcgggggtttttttccttaaaaaaaaaaaaaaaaaaaaaaaaaaagtctgggggaagaaaaaaactaaaattcttaaaaaaaaaaaaaaaaggctattatcaaactgatttctccctttttgtatgccggatgctgcatgagtctgaaacaccaataaacggagactgcatgaga

SEQ ID NO: 16732 - DNA, 2365 bp, Homo sapiens
  ENST00000636131
ggagaggaggggatgagcacacgggagaggagaagagggagacccgccgcctccctccctccctagctgacttgctccctcccgggctgcggctgctgcaaaagccagcagcggcagcgggagctgtccggaggccggcgtcgagggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaagaaacagtgtccaaaccagaagtgagcaaagaggccactgcagaccaggggtccaggctggagtctgcagccccacctgaaccagccccagagcctgctccccaaccagacccccggccagattcccagcctacccccaagccagcccttcaaccagagctccctacccaggaggaccccacccctgagattctgtctgagagtgtaggggaaaagcaagagaatggggcagtggtgcccctgcaggctggtgatggggaagagggcccagcccctgagcctcactcaccaccctcaaaaaaatcccccccagccaatggggcccccccccgagtgctgcagcagctggttgaggaggatcgaatgagaagggcacacagtgggcatccaggatctccccgaggtagcctgagccgccaccccagctcccagttggcaggtcctggggtggaggggggtgaaggcacccagaaacctcgggactacatcatccttgccatcctgtcctgcttctgccccatgtggcctgtcaacatcgtggccttcgcttatgctgtcatggtgagccccatgggaccctagcccaggcctgctgtggctcccagcttcccgccagcgctgcaatagagcctctggatcccggaacagcctgcagcagggggacgtggacggggcccagcgtctgggccgggtagccaagctcttaagcatcgtggcgctggtggggggagtcctcatcatcatcgcctcctgcgtcatcaacttaggcgtgtataagtgaggggctctgccccgcatcccaagacttttcttcctgttgggagctgccttgggcccatccctcccctggggggagcccaactgatggccctggcccccacccctaaggaccaagggagcctgagcggccttgtttacagcttctgtcctgctcctgcatcttgccaggctcctctgccaactgtaggcctgcctcatccctgcactggttccaacctccctgcactaatgcctgcatcccctccggcctcttggccccctatccctgcacttctggaaacctccctgcactctggaaacctccctgaacacctccccaactctgcgctctcagcctccctgcatctctcctggcctccctgcacttcttccagccccccaaattctctggacctccaccctggccgcctcctcccaactttcattgtcttggcatctctcaaccctcagtcctctcttccttcccttctttatcatctcccctttcctctccacgtcccgcccccttcctcttcctgcctcctcatctcccttaagcatcctcttctccaacctcccgtcaccgtttactctgcaaaattgacagcacttagacgaggcttgggggcagggagcagtgttgggagagggctccccaaccccaggctcggactgttctctgctgggaccacccagggtcggacacccaagggtgcctggcaggtcgcagagttggcaagccgggcctcgtatggggactcgggtgagggtggcgagtactggttccgaacgcacgcaggggagaagggagggacgcggcgctgacccttccaggtcagctggagttgacccgcccacctgggcttttcaaccccagtccgcgagtttctttcttgaaggtgtgggggctagattcattcacgtgcttcgtaatgaaataatccaaaaaataggaccaaagcgcccactggcaggagcgagggcggggcgccgcgctctataattattttctaagatgatgggggaggtttgttgcacgcgacagcccgctgaggaggcggggaccgagctacaacgc

SEQ ID NO: 16733 - DNA, 644 bp, Homo sapiens
  ENST00000567551
agaggaggggatgagcacacgggagaggagaagagggagacccgccgcctccctccctccctagctgacttgctccctcccgggctgcggctgctgcaaaagccagcagcggcagcgggagctgtccggaggccggcgtcgagggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaagaaacagtgtccaaaccagaatcccggaacagcctgcagcagggggacgtggacggggcccagcgtctgggccgggtagccaagctcttaagcatcgtggcgctggtggggggagtcc

SEQ ID NO: 16734 - DNA, 2009 bp, Homo sapiens
  ENST00000637290
ggaggggatgagcacacgggagaggagaagagggagacccgccgcctccctccctccctagctgacttgctccctcccgggctgcggctgctgcaaaagccagcagcggcagcgggagctgtccggaggccggcgtcgagggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaagaaacagtgtccaaaccagaaccaatggggcccccccccgagtgctgcagcagctggttgaggaggatcgaatgagaagggcacacagtgggcatccaggatctccccgaggtagcctgagccgccaccccagctcccagttggcaggtcctggggtggaggggggtgaaggcacccagaaacctcgggactacatcatccttgccatcctgtcctgcttctgccccatgtggcctgtcaacatcgtggccttcgcttatgctgtcatgtcccggaacagcctgcagcagggggacgtggacggggcccagcgtctgggccgggtagccaagctcttaagcatcgtggcgctggtggggggagtcctcatcatcatcgcctcctgcgtcatcaacttaggcgtgtataagtgaggggctctgccccgcatcccaagacttttcttcctgttgggagctgccttgggcccatccctcccctggggggagcccaactgatggccctggcccccacccctaaggaccaagggagcctgagcggccttgtttacagcttctgtcctgctcctgcatcttgccaggctcctctgccaactgtaggcctgcctcatccctgcactggttccaacctccctgcactaatgcctgcatcccctccggcctcttggccccctatccctgcacttctggaaacctccctgcactctggaaacctccctgaacacctccccaactctgcgctctcagcctccctgcatctctcctggcctccctgcacttcttccagccccccaaattctctggacctccaccctggccgcctcctcccaactttcattgtcttggcatctctcaaccctcagtcctctcttccttcccttctttatcatctcccctttcctctccacgtcccgcccccttcctcttcctgcctcctcatctcccttaagcatcctcttctccaacctcccgtcaccgtttactctgcaaaattgacagcacttagacgaggcttgggggcagggagcagtgttgggagagggctccccaaccccaggctcggactgttctctgctgggaccacccagggtcggacacccaagggtgcctggcaggtcgcagagttggcaagccgggcctcgtatggggactcgggtgagggtggcgagtactggttccgaacgcacgcaggggagaagggagggacgcggcgctgacccttccaggtcagctggagttgacccgcccacctgggcttttcaaccccagtccgcgagtttctttcttgaaggtgtgggggctagattcattcacgtgcttcgtaatgaaataatccaaaaaataggaccaaagcgcccactggcaggagcgagggcggggcgccgcgctctataattattttctaagatgatgggggaggtttgttgcacgcgacagcccgctgaggaggcggggaccgagctacaacgcggttcggatttggcggg

SEQ ID NO: 16735 - DNA, 1470 bp, Homo sapiens
  ENST00000567659
atgagcacacgggagaggagaagagggagacccgccgcctccctccctccctagctgacttgctccctcccgggctgcggctgctgcaaaagccagcagcggcagcgggagctgtccggaggccggcgtcgagggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaagaaacagtgtccaaaccagaagtgagcaaagaggccactgcagaccaggggtccaggctggagtctgcagccccacctgaaccagccccagagcctgctccccaaccagacccccggccagattcccagcctacccccaagccagcccttcaaccagagctccctacccaggaggaccccacccctgagattctgtctgagagtgtaggggaaaagcaagagaatggggcagtggtgcccctgcaggctggtgatggggaagagggcccagcccctgagcctcactcaccaccctcaaaaaaatcccccccagccaatggggcccccccccgagtgctgcagcagctggttgaggaggatcgaatgagaagggcacacagtgggcatccaggatctccccgaggtagcctgagccgccaccccagctcccagttggcaggtcctggggtggaggggggtgaaggcacccagaaacctcgggactacatcatccttgccatcctgtcctgcttctgccccatgtggcctgtcaacatcgtggccttcgcttatgctgtcatgtcccggaacagcctgcagcagggggacgtggacggggcccagcgtctgggccgggtagccaagctcttaagcatcgtggcgctggtggggggagtcctcatcatcatcgcctcctgcgtcatcaacttaggcggtgagtgggggcttgggacaggcaggggaggaatggaagggttggcaagggcagctttactaacccctgcccctgctctctcctgtctgtcctccttacctctcctttgtctctccttgtctccccctccccccgtctgtccttccctctcctctcccacagtgtataagtgaggggctctgccccgcatcccaagacttttcttcctgttgggagctgccttgggcccatccctcccctggggggagcccaactgatgg

SEQ ID NO: 16736 - DNA, 1733 bp, Homo sapiens
  ENST00000637565
gagcacacgggagaggagaagagggagacccgccgcctccctccctccctagctgacttgctccctcccgggctgcggctgctgcaaaagccagcagcggcagcgggagctgtccggaggccggcgtcgagggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaagaaacagtgtccaaaccagaacctgcagcagggggacgtggacggggcccagcgtctgggccgggtagccaagctcttaagcatcgtggcgctggtggggggagtcctcatcatcatcgcctcctgcgtcatcaacttaggcgtgtataagtgaggggctctgccccgcatcccaagacttttcttcctgttgggagctgccttgggcccatccctcccctggggggagcccaactgatggccctggcccccacccctaaggaccaagggagcctgagcggccttgtttacagcttctgtcctgctcctgcatcttgccaggctcctctgccaactgtaggcctgcctcatccctgcactggttccaacctccctgcactaatgcctgcatcccctccggcctcttggccccctatccctgcacttctggaaacctccctgcactctggaaacctccctgaacacctccccaactctgcgctctcagcctccctgcatctctcctggcctccctgcacttcttccagccccccaaattctctggacctccaccctggccgcctcctcccaactttcattgtcttggcatctctcaaccctcagtcctctcttccttcccttctttatcatctcccctttcctctccacgtcccgcccccttcctcttcctgcctcctcatctcccttaagcatcctcttctccaacctcccgtcaccgtttactctgcaaaattgacagcacttagacgaggcttgggggcagggagcagtgttgggagagggctccccaaccccaggctcggactgttctctgctgggaccacccagggtcggacacccaagggtgcctggcaggtcgcagagttggcaagccgggcctcgtatggggactcgggtgagggtggcgagtactggttccgaacgcacgcaggggagaagggagggacgcggcgctgacccttccaggtcagctggagttgacccgcccacctgggcttttcaaccccagtccgcgagtttctttcttgaaggtgtgggggctagattcattcacgtgcttcgtaatgaaataatccaaaaaataggaccaaagcgcccactggcaggagcgagggcggggcgccgcgctctataattattttctaagatgatgggggaggtttgttgcacgcgacagcccgctgaggaggcggggaccgagctacaacgcggttcggat

SEQ ID NO: 16737 - DNA, 2065 bp, Homo sapiens
  ENST00000636619
acacgggagaggagaagagggagacccgccgcctccctccctccctagctgacttgctccctcccgggctgcggctgctgcaaaagccagcagcggcagcgggagctgtccggaggccggcgtcgagggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaagaaacagtgtccaaaccagaagtgagcaaagaggccactgcagaccaggggtccaggctggagtctgcagccccacctgaaccagccccagagcctgctccccaaccagacccccggccagattcccagcctacccccaagccagcccttcaaccagagctccctacccaggaggaccccacccctgagattctgtctgagagtgtaggggaaaagcaagagaatggggcagtggtgcccctgcaggctggtgatggggaagagggcccagcccctgagcctcactcaccaccctcaaaaaaatcccccccagccaatggggcccccccccgagtgctgcagcagctggttgaggaggatcgaatgagaagggcacacagtgggcatccaggatctccccgaggtatcccggaacagcctgcagcagggggacgtggacggggcccagcgtctgggccgggtagccaagctcttaagcatcgtggcgctggtggggggagtcctcatcatcatcgcctcctgcgtcatcaacttaggcgtgtataagtgaggggctctgccccgcatcccaagacttttcttcctgttgggagctgccttgggcccatccctcccctggggggagcccaactgatggccctggcccccacccctaaggaccaagggagcctgagcggccttgtttacagcttctgtcctgctcctgcatcttgccaggctcctctgccaactgtaggcctgcctcatccctgcactggttccaacctccctgcactaatgcctgcatcccctccggcctcttggccccctatccctgcacttctggaaacctccctgcactctggaaacctccctgaacacctccccaactctgcgctctcagcctccctgcatctctcctggcctccctgcacttcttccagccccccaaattctctggacctccaccctggccgcctcctcccaactttcattgtcttggcatctctcaaccctcagtcctctcttccttcccttctttatcatctcccctttcctctccacgtcccgcccccttcctcttcctgcctcctcatctcccttaagcatcctcttctccaacctcccgtcaccgtttactctgcaaaattgacagcacttagacgaggcttgggggcagggagcagtgttgggagagggctccccaaccccaggctcggactgttctctgctgggaccacccagggtcggacacccaagggtgcctggcaggtcgcagagttggcaagccgggcctcgtatggggactcgggtgagggtggcgagtactggttccgaacgcacgcaggggagaagggagggacgcggcgctgacccttccaggtcagctggagttgacccgcccacctgggcttttcaaccccagtccgcgagtttctttcttgaaggtgtgggggctagattcattcacgtgcttcgtaatgaaataatccaaaaaataggaccaaagcgcccactggcaggagcgagggcggggcgccgcgctctataattattttctaagatgatgggggag

SEQ ID NO: 16738 - DNA, 131 bp, Homo sapiens
  ENST00000636019
ctccctagctgacttgctccctcccgggctgcggctgctgcaaaagccagcagcggcagcgggagctgtccggaggccggcgtcgagccaatggggcccccccccgagtgctgcagcagctggttgaggag

SEQ ID NO: 16739 - DNA, 3002 bp, Homo sapiens
  ENST00000300797
ctagctgacttgctccctcccgggctgcggctgctgcaaaagccagcagcggcagcgggagctgtccggaggccggcgtcgaggtgagacccgggcagactgaggctgcggggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaagaaacagtgtccaaaccagaagtgagcaaagaggccactgcagaccaggggtccaggctggagtctgcagccccacctgaaccagccccagagcctgctccccaaccagacccccggccagattcccagcctacccccaagccagcccttcaaccagagctccctacccaggaggaccccacccctgagattctgtctgagagtgtaggggaaaagcaagagaatggggcagtggtgcccctgcaggctggtgatggggaagagggcccagcccctgagcctcactcaccaccctcaaaaaaatcccccccagccaatggggcccccccccgagtgctgcagcagctggttgaggaggatcgaatgagaagggcacacagtgggcatccaggatctccccgaggtagcctgagccgccaccccagctcccagttggcaggtcctggggtggaggggggtgaaggcacccagaaacctcgggactacatcatccttgccatcctgtcctgcttctgccccatgtggcctgtcaacatcgtggccttcgcttatgctgtcatggtgagccccatgggaccctagcccaggcctgctgtggctcccagcttcccgccagcgctgcaatagagcctctggagtaatcatgccttccttcccctctcctctctgcatggatcccacctccccaattccagggcctttgtttgcctctccctaggacctaaccctctgagccaccactgccctgcccctttgggtgggagggatatggaaacacgtgtcacacagcctcgctgacctgtgccctcctccccctgccccttcactcctccttcctcccttacccgccatctatggggctggcctctctctcttctggatgacttttccacctgatcccttctgggctggcttctcctgaccccggctatgtgcctccacccctcgccctaaccccagtcccggaacagcctgcagcagggggacgtggacggggcccagcgtctgggccgggtagccaagctcttaagcatcgtggcgctggtggggggagtcctcatcatcatcgcctcctgcgtcatcaacttaggcggtgagtgggggcttgggacaggcaggggaggaatggaagggttggcaagggcagctttactaacccctgcccctgctctctcctgtctgtcctccttacctctcctttgtctctccttgtctccccctccccccgtctgtccttccctctcctctcccacagtgtataagtgaggggctctgccccgcatcccaagacttttcttcctgttgggagctgccttgggcccatccctcccctggggggagcccaactgatggccctggcccccacccctaaggaccaagggagcctgagcggccttgtttacagcttctgtcctgctcctgcatcttgccaggctcctctgccaactgtaggcctgcctcatccctgcactggttccaacctccctgcactaatgcctgcatcccctccggcctcttggccccctatccctgcacttctggaaacctccctgcactctggaaacctccctgaacacctccccaactctgcgctctcagcctccctgcatctctcctggcctccctgcacttcttccagccccccaaattctctggacctccaccctggccgcctcctcccaactttcattgtcttggcatctctcaaccctcagtcctctcttccttcccttctttatcatctcccctttcctctccacgtcccgcccccttcctcttcctgcctcctcatctcccttaagcatcctcttctccaacctcccgtcaccgtttactctgcaaaattgacagcacttagacgaggcttgggggcagggagcagtgttgggagagggctccccaaccccaggctcggactgttctctgctgggaccacccagggtcggacacccaagggtgcctggcaggtcgcagagttggcaagccgggcctcgtatggggactcgggtgagggtggcgagtactggttccgaacgcacgcaggggagaagggagggacgcggcgctgacccttccaggtcagctggagttgacccgcccacctgggcttttcaaccccagtccgcgagtttctttcttgaaggtgtgggggctagattcattcacgtgcttcgtaatgaaataatccaaaaaataggaccaaagcgcccactggcaggagcgagggcggggcgccgcgctctataattattttctaagatgatgggggaggtttgttgcacgcgacagcccgctgaggaggcggggaccgagctacaacgcggttcggatttggcgggggtttttttccttaaaaaaaaaaaaaaaaaaaaaaaaaaagtctgggggaagaaaaaaactaaaattcttaaaaaaaaaaaaaaaaggctattatcaaactgatttctccctttttgtatgccggatgctgcatgagtctgaaacaccaataaacggagactgcatgag

SEQ ID NO: 16740 - DNA, 2033 bp, Homo sapiens
  ENST00000637403
gggctgcggctgctgcaaaagccagcagcggcagcgggagctgtccggaggccggcgtcgagggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaagaaacagtgtccaaaccagaagtgagcaaagaggccactgcagaccaggggtccaggctggagtctgcagccccacctgaaccagccccagagcctgctccccaaccagacccccggccagattcccagcctacccccaagccagcccttcaaccagagctccctacccaggaggaccccacccctgagattctgtctgagagtgtaggggaaaagcaagagaatggggcagtggtgcccctgcaggctggtgatggggaagagggcccagcccctgagcctcactcaccaccctcaaaaaaatcccccccagccaatggggcccccccccgagtgctgcagcagctggttgaggaggatcgaatgagaagggcacacagtgggcatccaggatctccccgagtcccggaacagcctgcagcagggggacgtggacggggcccagcgtctgggccgggtagccaagctcttaagcatcgtggcgctggtggggggagtcctcatcatcatcgcctcctgcgtcatcaacttaggcgtgtataagtgaggggctctgccccgcatcccaagacttttcttcctgttgggagctgccttgggcccatccctcccctggggggagcccaactgatggccctggcccccacccctaaggaccaagggagcctgagcggccttgtttacagcttctgtcctgctcctgcatcttgccaggctcctctgccaactgtaggcctgcctcatccctgcactggttccaacctccctgcactaatgcctgcatcccctccggcctcttggccccctatccctgcacttctggaaacctccctgcactctggaaacctccctgaacacctccccaactctgcgctctcagcctccctgcatctctcctggcctccctgcacttcttccagccccccaaattctctggacctccaccctggccgcctcctcccaactttcattgtcttggcatctctcaaccctcagtcctctcttccttcccttctttatcatctcccctttcctctccacgtcccgcccccttcctcttcctgcctcctcatctcccttaagcatcctcttctccaacctcccgtcaccgtttactctgcaaaattgacagcacttagacgaggcttgggggcagggagcagtgttgggagagggctccccaaccccaggctcggactgttctctgctgggaccacccagggtcggacacccaagggtgcctggcaggtcgcagagttggcaagccgggcctcgtatggggactcgggtgagggtggcgagtactggttccgaacgcacgcaggggagaagggagggacgcggcgctgacccttccaggtcagctggagttgacccgcccacctgggcttttcaaccccagtccgcgagtttctttcttgaaggtgtgggggctagattcattcacgtgcttcgtaatgaaataatccaaaaaataggaccaaagcgcccactggcaggagcgagggcggggcgccgcgctctataattattttctaagatgatgggggaggtttgttgcacgcgacagcccgctgaggaggcgggg

SEQ ID NO: 16741 - DNA, 2403 bp, Homo sapiens
  ENST00000572820
ggcagcgggagctgtccggaggccggcgtcgaggtgagacccgggcagactgaggctgcggggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaagaaacagtgtccaaaccagaagtgagcaaagaggccactgcagaccaggggtccaggctggagtctgcagccccacctgaaccagccccagagcctgctccccaaccagacccccggccagattcccagcctacccccaagccagcccttcaaccagagctccctacccaggaggaccccacccctgagattctgtctgagagtgtaggggaaaagcaagagaatggggcagtggtgcccctgcaggctggtgatggggaagagggcccagcccctgagcctcactcaccaccctcaaaaaaatcccccccagccaatggggcccccccccgagtgctgcagcagctggttgaggaggatcgaatgagaagggcacacagtgggcatccaggatctccccgaggtagcctgagccgccaccccagctcccagttggcaggtcctggggtggaggggggtgaaggcacccagaaacctcgggactacatcatccttgccatcctgtcctgcttctgccccatgtggcctgtcaacatcgtggccttcgcttatgctgtcatgtcccggaacagcctgcagcagggggacgtggacggggcccagcgtctgggccgggtagccaagctcttaagcatcgtggcgctggtggggggagtcctcatcatcatcgcctcctgcgtcatcaacttaggcgtgtataagtgaggggctctgccccgcatcccaagacttttcttcctgttgggagctgccttgggcccatccctcccctggggggagcccaactgatggccctggcccccacccctaaggaccaagggagcctgagcggccttgtttacagcttctgtcctgctcctgcatcttgccaggctcctctgccaactgtaggcctgcctcatccctgcactggttccaacctccctgcactaatgcctgcatcccctccggcctcttggccccctatccctgcacttctggaaacctccctgcactctggaaacctccctgaacacctccccaactctgcgctctcagcctccctgcatctctcctggcctccctgcacttcttccagccccccaaattctctggacctccaccctggccgcctcctcccaactttcattgtcttggcatctctcaaccctcagtcctctcttccttcccttctttatcatctcccctttcctctccacgtcccgcccccttcctcttcctgcctcctcatctcccttaagcatcctcttctccaacctcccgtcaccgtttactctgcaaaattgacagcacttagacgaggcttgggggcagggagcagtgttgggagagggctccccaaccccaggctcggactgttctctgctgggaccacccagggtcggacacccaagggtgcctggcaggtcgcagagttggcaagccgggcctcgtatggggactcgggtgagggtggcgagtactggttccgaacgcacgcaggggagaagggagggacgcggcgctgacccttccaggtcagctggagttgacccgcccacctgggcttttcaaccccagtccgcgagtttctttcttgaaggtgtgggggctagattcattcacgtgcttcgtaatgaaataatccaaaaaataggaccaaagcgcccactggcaggagcgagggcggggcgccgcgctctataattattttctaagatgatgggggaggtttgttgcacgcgacagcccgctgaggaggcggggaccgagctacaacgcggttcggatttggcgggggtttttttccttaaaaaaaaaaaaaaaaaaaaaaaaaaagtctgggggaagaaaaaaactaaaattcttaaaaaaaaaaaaaaaaggctattatcaaactgatttctccctttttgtatgccggatgctgcatgagtctgaaacaccaataaacggagactgcatgagactcgcctccaa

SEQ ID NO: 16742 - DNA, 2153 bp, Homo sapiens
  ENST00000637064
gctgcgggtaggagtggaccgaccgacggctgacgccgggcggactgcacgggaatgcggggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaagaaacagtgtccaaaccagaagtgagcaaagaggccactgcagaccaggggtccaggctggagtctgcagccccacctgaaccagccccagagcctgctccccaaccagacccccggccagattcccagcctacccccaagccagcccttcaaccagagctccctacccaggaggaccccacccctgagattctgtctgagagtgtaggggaaaagcaagagaatggggcagtggtgcccctgcaggctggtgatggggaagagggcccagcccctgagcctcactcaccaccctcaaaaaaatcccccccagccaatggggcccccccccgagtgctgcagcagctggttgaggaggatcgaatgagaagggcacacagtgggcatccaggatctccccgaggtagcctgagccgccaccccagctcccagttggcaggtcctggggtggaggggggtgaaggcacccagaaacctcgggactacatcatccttgccatcctgtcctgcttctgccccatgtggcctgtcaacatcgtggccttcgcttatgctgtcatgtcccggaacagcctgcagcagggggacgtggacggggcccagcgtctgggccgggtagccaagctcttaagcatcgtggcgctggtggggggagtcctcatcatcatcgcctcctgcgtcatcaacttaggcgtgtataagtgaggggctctgccccgcatcccaagacttttcttcctgttgggagctgccttgggcccatccctcccctggggggagcccaactgatggccctggcccccacccctaaggaccaagggagcctgagcggccttgtttacagcttctgtcctgctcctgcatcttgccaggctcctctgccaactgtaggcctgcctcatccctgcactggttccaacctccctgcactaatgcctgcatcccctccggcctcttggccccctatccctgcacttctggaaacctccctgcactctggaaacctccctgaacacctccccaactctgcgctctcagcctccctgcatctctcctggcctccctgcacttcttccagccccccaaattctctggacctccaccctggccgcctcctcccaactttcattgtcttggcatctctcaaccctcagtcctctcttccttcccttctttatcatctcccctttcctctccacgtcccgcccccttcctcttcctgcctcctcatctcccttaagcatcctcttctccaacctcccgtcaccgtttactctgcaaaattgacagcacttagacgaggcttgggggcagggagcagtgttgggagagggctccccaaccccaggctcggactgttctctgctgggaccacccagggtcggacacccaagggtgcctggcaggtcgcagagttggcaagccgggcctcgtatggggactcgggtgagggtggcgagtactggttccgaacgcacgcaggggagaagggagggacgcggcgctgacccttccaggtcagctggagttgacccgcccacctgggcttttcaaccccagtccgcgagtttctttcttgaaggtgtgggggctagattcattcacgtgcttcgtaatgaaataatccaaaaaataggaccaaagcgcccactggcaggagcgagggcggggcgccgcgctctataattattttctaagatgatgggggag

SEQ ID NO: 16743 - DNA, 517 bp, Homo sapiens
  ENST00000636246
tgacgccgggcggactgcacgggaatgcgggtgtctggagggctggtggtggtgctgggcgggctgaaccatcgggaggaggcgccagcccaccgaagggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaagaaacagtgtccaaaccagaagtgagcaaagaggcc

SEQ ID NO: 16744 - DNA, 100 bp, Homo sapiens
  ENST00000636902
atcatcgcctcctgcgtcatcaacttaggcgacttttcttcctgttgggagctgccttgggcccatccctcccctggggggagcccaactgatggccctg

SEQ ID NO: 16745 - DNA, 100 bp, Homo sapiens
  ENST00000637425
ttctgtcctgctcctgcatcttgccagtccgcgagtttctttcttgaaggtgtgggggctagattcattcacgtgcttcgtaatgaaataatccaaaaaa

SEQ ID NO: 16746 - DNA, 2313 bp, Homo sapiens
  ENST00000489835
cgcggagtgcggagtgcggagcgcggggcctggccgcccgcctggaccttcctcctcaaaagctgctgaacaactgagtccctgcccaccaaggccacccgaagccaggtggggccatggccaggcatggctgtctagggctgggactgttctgctgcgtcctgtttgctgctactgtgggcccccagcccaccccctccatcccaggtgcccctgccaccactttgacccccgtacctcaaagtgaggcctctatgctgtctctcaacctgggacttaacttcaaattccatcttcggggacctgctgctgtctgggggagcccagtcacagagacccagccactctctcttgggccaggccaggagccaggggaagaggtggccagtgggctgaggactgaccccctttgggaattgctggtgggctcctcagggaactctctcactgagtggggctccaccgaaggtggctcaaagccccgggcctcctccctgcttccggagtccacatcccggcgctctgggcccagcgatgggcccactgccccctatcagcccaggaggagcactgtgacctgggacactgctctgatggtgacagcacttccatccagtgctcccaggccccaccagagcgagctggagctgaagtttgacatggcactgagagcaggtgcagcccccacgcttgggcatcgaacgctgcccctgctgcccagcctgcgggccagcctggcagagattgctgggcgcctgggaccctttggattctttggcactactctgtccccactccggaacttctccggcctgagccccccaggtgaaactacatccacaagctctgcctctggagtttcgggttctctggggttccttggtaccactctgtccctgcccccatactccctggagaggaagctctccagcccaagtcctctggacccagctgcttccctaagttttgcctcgattgcaacaacatcattagaccccacagtccccatctctggcccagatgacctctctcctcccgccagcctcgggaacccttcggggcagccagagtgtgggccagggtcctgcagcgtgggagaattgcctgaacgcgaggggcagcctcccgaggcgccgaggcccctctttttcctgaccctggaggccgactgggcagaggccagggctcgctgggggctggcctgggaggcccacgtgtacgggcgattacaccgtggacttccgcccgccctccccaatcaacctgcgacgcagcatcgaggaggccctctgcagcgaggccctgcttgcgcctggcctcttccagggccctgccttcgaggacgctctgcctgggctcggactctaccgcaccgcctcgctggggaccgggggcagggccagtgagagatcaggggaggcctctggccccgctgcgcccccggagctcccctcccctggggcttggcccgcaggcagcagcgtctcatctggctcgttctgcggactctcgcgggacagctcgtccatgctgctgtgttccagccccgacaggcccccgcgctgccctctggtctgcgtcctcagtcccccgcggccctcaggaagcagccccagcctcccggcctcaggatcctaccaggccctgtccccaccctctcgcgactccccagagcctgcttctgagctgcaggccgaggaggccttgctgcaggagcagttcctggacgcctgccgacagatcgacgagctgagcgtgggcagcgacaccatagacctgtgaagaggtggccaccttgctaccctgcgatatgcccctttctggcgcctgccctgcccgagacctgcacactgtaatccttccccaatcctccctggctcagatacctctccagattccttccccatccaggggtccctgggtgggtgggtcagcagccaggctctatcgattgggaatcagtgccaccttctctggagccctgggtgctgatgccctcagctgcaaatctaggttggcaggggtcccattttccttggcattcaccagcaataaagctccaaggtgctccactcctgaccaccactccccactctggtgctgagtgagaggggctgtcctcagaggaccctgggacctgcctcaggcccccctacccacctctgccatgcctaggaatcccacccctgtgtgaatgggactccctttcctccatgtgacacccacaggggtccatgacccatctaggagactttatagcagttgggtgggaggggaatgctcttaatttatcaataaaatattttcagagga

SEQ ID NO: 16747 - DNA, 1789 bp, Homo sapiens
  ENST00000480290
ctcaaagccccgggcctcctccctgcttccggagtccacatcccggcgctctgggcccagcgatgggcccactgccccctatcagcccaggaggagcactgtgacctgggacactgctctgatggtgacagcacttccatccagtgctcccaggccccaccagagcgagctggagctgaagtttgacatggcactgagagcaggtgcagcccccacgcttgggcatcgaacgctgcccctgctgcccagcctgcgggccagcctggcagagattgctgggcgcctgggaccctttggattctttggcactactctgtccccactccggaacttctccggcctgagccccccaggtgaaactacatccacaagctctgcctctggagtttcgggttctctggggttccttggtaccactctgtccctgcccccatactccctggagaggaagctctccagcccaatcctcgcgtgccgccgcgctgctgggccaagctcttccgcttgtccccgggccacgcggctccgctgctgccgggaggctgggtcactgggcccccagacaaggagcccctggggagcgccatcgctcgcggggacgcggagctgctgcagctgtgcgcgctggcagggccaggcccagacctcctactccagggcggaggttgccggggcttcgaaggcgcggcggccaacccggccccgtccccggcttcctctccctgcagcgattacaccgtggacttccgcccgccctccccaatcaacctgcgacgcagcatcgaggaggccctctgcagcgaggccctgcttgcgcctggcctcttccagggccctgccttcgaggacgctctgcctgggctcggactctaccgcaccgcctcgctggggaccgggggcagggccagtgagagatcaggggaggcctctggccccgctgcgcccccggagctcccctcccctggggcttggcccgcaggcagcagcgtctcatctggctcgttctgcggactctcgcgggacagctcgtccatgctgctgtgttccagccccgacaggcccccgcgctgccctctggtctgcgtcctcagtcccccgcggccctcaggaagcagccccagcctcccggcctcaggatcctaccaggccctgtccccaccctctcgcgactccccagagcctgcttctgagctgcaggccgaggaggccttgctgcaggagcagttcctggacgcctgccgacagatcgacgagctgagcgtgggcagcgacaccatagacctgtgaagaggtggccaccttgctaccctgcgatatgcccctttctggcgcctgccctgcccgagacctgcacactgtaatccttccccaatcctccctggctcagatacctctccagattccttccccatccaggggtccctgggtgggtgggtcagcagccaggctctatcgattgggaatcagtgccaccttctctggagccctgggtgctgatgccctcagctgcaaatctaggttggcaggggtcccattttccttggcattcaccagcaataaagctccaaggtgctccactcctgaccaccactccccactctggtgctgagtgagaggggctgtcctcagaggaccctgggacctgcctcaggcccccctacccacctctgccatgcctaggaatcccacccctgtgtgaatgggactccctttcctccatgtgacacccacaggggtccatgacccatctaggagactttatagcagttgggtgggaggggaatgctct

SEQ ID NO: 16748 - DNA, 1887 bp, Homo sapiens
  ENST00000489517
tgccgcggagccccggcgcgggcggcttcgccggggagcgaggctcggagccaggaggcggcgccgctgggagggagcgcggagtgcggagtgcggagcgcggggcctggccgcccgcctggtgagagcgctgcgggccggggctgggccgggggcggctcaggggcagcggggcggcgaggctgcggtctctggactaggcgaggggccgccgggggctggaggtccggatcttcagtcggggcgctgggcacaacagagagaagcggtgagataccacgaagcgttgcccagctgggcgccagggccgccacgaccgccccttttcggaggctcggcgaggagacctgcctgcgggagagaccccggggagcaggaccttcctcctcaaaagctgctgaacaactgagtccctgcccaccaaggccacccgaagccaggtggggccatggccaggcatggctgtctagggctgggactgttctgctgcgtcctgtttgctgctactgtgggcccccagcccaccccctccatcccaggtgcccctgccaccactttgacccccgtacctcaaagtgaggcctctatgctgtctctcaacctgggacttaacttcaaattccatcttcggggacctgctgctgtctgggggagcccagtcacagagacccagccactctctcttgggccaggccaggagccaggggaagaggtggccagtgggctgaggactgaccccctttgggaattgctggtgggctcctcagggaactctctcactgagtggggctccaccgaaggtggctcaaagccccgggcctcctccctgcttccggagtccacatcccggcgctctgggcccagcgatgggcccactgccccctatcagcccaggaggagcactgtgacctgggacactgctctgatggtgacagcacttccatccagtgctcccaggccccaccagagcgagctggagctgaagtttgacatggcactgagagcaggtgcagcccccacgcttgggcatcgaacgctgcccctgctgcccagcctgcgggccagcctggcagagattgctgggcgcctgggaccctttggattctttggcactactctgtccccactccggaacttctccggcctgagccccccaggtgaaactacatccacaagctctgcctctggagtttcgggttctctggggttccttggtaccactctgtccctgcccccatactccctggagaggaagctctccagcccaagtcctctggacccagctgcttccctaagttttgcctcgattgcaacaacatcattagaccccacagtccccatctctggcccagatgacctctctcctcccgccagcctcgggaacccttcggggcagccagagtgtgggccagggtcctgcagcgtgggagaattgcctgaacgcgaggggcagcctcccgaggcgccgaggcccctctttttcctgaccctggaggccgactgggcagaggccagggctcgctgggggctggcctgggaggcccacgtgtacggggtaggcgcgctcttcggcctggttgccttgctggcgctgctggctctggccctcttgccctggcggtgcccgcccggcgccccctgcctggcgctgctggacctgctgctgctgtcggccgggaccacgcgggccttcccgctcttctacgacgcctatgggcacagggatcgactgcccgcgctcgcctggctgctgctgcaggaccttccgctgccctgcttggctgccggcctggggctggcctgcctgctgctggcccggccgcgcccgccgcggtgccccaccggcctggctgcgctgctgctcctggggctggggctggcggccgc

SEQ ID NO: 16749 - DNA, 883 bp, Homo sapiens
  ENST00000464607
aggaggcggcgccgctgggagggagcgcggagtgcggagtgcggagcgcggggcctggccgcccgcctgagagaagcggtgagataccacgaagcgttgcccagctgggcgccagggccgccacgaccgccccttttcggaggctcggcgaggagacctgcctgcgggagagaccccggggagcaggaccttcctcctcaaaagctgctgaacaactgagtccctgcccaccaaggccacccgaagccaggtggggccatggccaggcatggctgtctagggctgggactgttctgctgcgtcctgtttgctgctactgtgggcccccagcccaccccctccatcccaggtgcccctgccaccactttgacccccgtacctcaaagtgaggcctctatgctgtctctcaacctgggacttaacttcaaattccatcttcggggacctgctgctgtctgggggagcccagtcacagagacccagccactctctcttgggccaggccaggagccaggggaagaggtggccagtgggctgaggactgaccccctttgggaattgctggtgggctcctcagggaactctctcactgagtggggctccaccgaaggtggctcaaagccccgggcctcctccctgcttccggagtccacatcccggcgctctgggcccagcgatgggcccactgccccctatcagcccaggaggagcactgtgacctgggacactgctctgatggtgacagcacttccatccagtgctcccaggccccaccagagcgagctggagctgaagtttgacatggcactgagagcaggtgcagcccccacgcttgggcatcgaacgctgcccctgctgcccagcctgcgggccagcctggcag

SEQ ID NO: 16750 - DNA, 814 bp, Homo sapiens
  ENST00000495931
cggctgccgcggagccccggcgcgggcggcttcgccggggagcgaggctcggagccaggaggcggcgccgctgggagggagcgcggagtgcggagtgcggagcgcggggcctggccgcccgcctggaccttcctcctcaaaagctgctgaacaactgagtccctgcccaccaaggccacccgaagccaggtggggccatggccaggcatggctgtctagggctgggactgttctgctgcgtcctgtttgctgctactgtgggcccccagcccaccccctccatcccaggtgcccctgccaccactttgacccccgtacctcaaagtgaggcctctatgctgtctctcaacctgggacttaacttcaaattccatcttcggggacctgctgctgtctgggggagcccagtcacagagacccagccactctctcttgggccaggccaggagccaggggaagaggtggccagtgggctgaggactgaccccctttgggaattgctggtgggctcctcagggaactctctcactgagtggggctccaccgaaggtggctcaaagccccgggcctcctccctgcttccggagtccacatcccggcgctctgggcccagcgatgggcccactgccccctatcagcccaggaggagcactgtgacctgggacactgctctgatggtgacagcacttccatccagtgctcccaggccccaccagagcgagctggagctgaagtttgacatggcactgagagcaggtgcagcccccacgcttgggcatcgaacgctgcccctgctgcccagcctgcgggccag

SEQ ID NO: 16751 - DNA, 2897 bp, Homo sapiens
  ENST00000535159
cggctgccgcggagccccggcgcgggcggcttcgccggggagcgaggctcggagccaggaggcggcgccgctgggagggagcgcggagtgcggagtgcggagcgcggggcctggccgcccgcctggaccttcctcctcaaaagctgctgaacaactgagtccctgcccaccaaggccacccgaagccaggtggggccatggccaggcatggctgtctagggctgggactgttctgctgcgtcctgtttgctgctactgtgggcccccagcccaccccctccatcccaggtgcccctgccaccactttgacccccgtacctcaaagtgaggcctctatgctgtctctcaacctgggacttaacttcaaattccatcttcggggacctgctgctgtctgggggagcccagtcacagagacccagccactctctcttgggccaggccaggagccaggggaagaggtggccagtgggctgaggactgaccccctttgggaattgctggtgggctcctcagggaactctctcactgagtggggctccaccgaaggtggctcaaagccccgggcctcctccctgcttccggagtccacatcccggcgctctgggcccagcgatgggcccactgccccctatcagcccaggaggagcactgtgacctgggacactgctctgatggtgacagcacttccatccagtgctcccaggccccaccagagcgagctggagctgaagtttgacatggcactgagagcaggtgcagcccccacgcttgggcatcgaacgctgcccctgctgcccagcctgcgggccagcctggcagagattgctgggcgcctgggaccctttggattctttggcactactctgtccccactccggaacttctccggcctgagccccccaggtgaaactacatccacaagctctgcctctggagtttcgggttctctggggttccttggtaccactctgtccctgcccccatactccctggagaggaagctctccagcccaagtcctctggacccagctgcttccctaagttttgcctcgattgcaacaacatcattagaccccacagtccccatctctggcccagatgacctctctcctcccgccagcctcgggaacccttcggggcagccagagtgtgggccagggtcctgcagcgtgggagaattgcctgaacgcgaggggcagcctcccgaggcgccgaggcccctctttttcctgaccctggaggccgactgggcagaggccagggctcgctgggggctggcctgggaggcccacgtgtacggggtaggcgcgctcttcggcctggttgccttgctggcgctgctggctctggccctcttgccctggcggtgcccgcccggcgccccctgcctggcgctgctggacctgctgctgctgtcggccgggaccacgcgggccttcccgctcttctacgacgcctatgggcacagggatcgactgcccgcgctcgcctggctgctgctgcaggaccttccgctgccctgcttggctgccggcctggggctggcctgcctgctgctggcccggccgcgcccgccgcggtgccccaccggcctggctgcgctgctgctcctggggctggggctggcggccgccgccgccctcgggagcgccgcgcatcgcccgctgcggcccctgcggctcgcctcgcgcgggctgcacgcctttctcgccgctttcctttccgggctgctgctggcgctctcctgctggggcgggcggcggcggcgggccggggcgcccctgggagggtcgggcttcaagggcgccacacccctgccgcaggggcgcagccccttcgcccctcgggagtcctggcggcgcgcggcgcgcacggccccggtggcgggcaccttcgggctgctgagcggagccctgcagggctatgaggtgctgcacgccctgggctacggcggccaatccggcctggaagggccctggccctggtgggccttccagctaggcctgcgcctgggcgaggtgggcgtcgcgctcccgttggcgctgctgggcctctacccggcgctctgcagtcctcgcgtgccgccgcgctgctgggccaagctcttccgcttgtccccgggccacgcggctccgctgctgccgggaggctgggtcactgggcccccagacaaggagcccctggggagcgccatcgctcgcggggacgcggagctgctgcagctgtgcgcgctggcagggccaggcccagacctcctactccagggcggaggttgccggggcttcgaaggcgcggcggccaacccggccccgtccccggcttcctctccctgcagcgattacaccgtggacttccgcccgccctccccaatcaacctgcgacgcagcatcgaggaggccctctgcagcgaggccctgcttgcgcctggcctcttccagggccctgccttcgaggacgctctgcctgggctcggactctaccgcaccgcctcgctggggaccgggggcagggccagtgagagatcaggggaggcctctggccccgctgcgcccccggagctcccctcccctggggcttggcccgcaggcagcagcgtctcatctggctcgttctgcggactctcgcgggacagctcgtccatgctgctgtgttccagccccgacaggcccccgcgctgccctctggtctgcgtcctcagtcccccgcggccctcaggaagcagccccagcctcccggcctcaggatcctaccaggccctgtccccaccctctcgcgactccccagagcctgcttctgagctgcaggccgaggaggccttgctgcaggagcagttcctggacgcctgccgacagatcgacgagctgagcgtgggcagcgacaccatagacctgtga

SEQ ID NO: 16752 - DNA, 3544 bp, Homo sapiens
  ENST00000446477
cggctgccgcggagccccggcgcgggcggcttcgccggggagcgaggctcggagccaggaggcggcgccgctgggagggagcgcggagtgcggagtgcggagcgcggggcctggccgcccgcctgagagaagcggtgagataccacgaagcgttgcccagctgggcgccagggccgccacgaccgccccttttcggaggctcggcgaggagacctgcctgcgggagagaccccggggagcaggaccttcctcctcaaaagctgctgaacaactgagtccctgcccaccaaggccacccgaagccaggtggggccatggccaggcatggctgtctagggctgggactgttctgctgcgtcctgtttgctgctactgtgggcccccagcccaccccctccatcccaggtgcccctgccaccactttgacccccgtacctcaaagtgaggcctctatgctgtctctcaacctgggacttaacttcaaattccatcttcggggacctgctgctgtctgggggagcccagtcacagagacccagccactctctcttgggccaggccaggagccaggggaagaggtggccagtgggctgaggactgaccccctttgggaattgctggtgggctcctcagggaactctctcactgagtggggctccaccgaaggtggctcaaagccccgggcctcctccctgcttccggagtccacatcccggcgctctgggcccagcgatgggcccactgccccctatcagcccaggaggagcactgtgacctgggacactgctctgatggtgacagcacttccatccagtgctcccaggccccaccagagcgagctggagctgaagtttgacatggcactgagagcaggtgcagcccccacgcttgggcatcgaacgctgcccctgctgcccagcctgcgggccagcctggcagagattgctgggcgcctgggaccctttggattctttggcactactctgtccccactccggaacttctccggcctgagccccccaggtgaaactacatccacaagctctgcctctggagtttcgggttctctggggttccttggtaccactctgtccctgcccccatactccctggagaggaagctctccagcccaagtcctctggacccagctgcttccctaagttttgcctcgattgcaacaacatcattagaccccacagtccccatctctggcccagatgacctctctcctcccgccagcctcgggaacccttcggggcagccagagtgtgggccagggtcctgcagcgtgggagaattgcctgaacgcgaggggcagcctcccgaggcgccgaggcccctctttttcctgaccctggaggccgactgggcagaggccagggctcgctgggggctggcctgggaggcccacgtgtacggggtaggcgcgctcttcggcctggttgccttgctggcgctgctggctctggccctcttgccctggcggtgcccgcccggcgccccctgcctggcgctgctggacctgctgctgctgtcggccgggaccacgcgggccttcccgctcttctacgacgcctatgggcacagggatcgactgcccgcgctcgcctggctgctgctgcaggaccttccgctgccctgcttggctgccggcctggggctggcctgcctgctgctggcccggccgcgcccgccgcggtgccccaccggcctggctgcgctgctgctcctggggctggggctggcggccgccgccgccctcgggagcgccgcgcatcgcccgctgcggcccctgcggctcgcctcgcgcgggctgcacgcctttctcgccgctttcctttccgggctgctgctggcgctctcctgctggggcgggcggcggcggcgggccggggcgcccctgggagggtcgggcttcaagggcgccacacccctgccgcaggggcgcagccccttcgcccctcgggagtcctggcggcgcgcggcgcgcacggccccggtggcgggcaccttcgggctgctgagcggagccctgcagggctatgaggtgctgcacgccctgggctacggcggccaatccggcctggaagggccctggccctggtgggccttccagctaggcctgcgcctgggcgaggtgggcgtcgcgctcccgttggcgctgctgggcctctacccggcgctctgcagtcctcgcgtgccgccgcgctgctgggccaagctcttccgcttgtccccgggccacgcggctccgctgctgccgggaggctgggtcactgggcccccagacaaggagcccctggggagcgccatcgctcgcggggacgcggagctgctgcagctgtgcgcgctggcagggccaggcccagacctcctactccagggcggaggttgccggggcttcgaaggcgcggcggccaacccggccccgtccccggcttcctctccctgcagcgattacaccgtggacttccgcccgccctccccaatcaacctgcgacgcagcatcgaggaggccctctgcagcgaggccctgcttgcgcctggcctcttccagggccctgccttcgaggacgctctgcctgggctcggactctaccgcaccgcctcgctggggaccgggggcagggccagtgagagatcaggggaggcctctggccccgctgcgcccccggagctcccctcccctggggcttggcccgcaggcagcagcgtctcatctggctcgttctgcggactctcgcgggacagctcgtccatgctgctgtgttccagccccgacaggcccccgcgctgccctctggtctgcgtcctcagtcccccgcggccctcaggaagcagccccagcctcccggcctcaggatcctaccaggccctgtccccaccctctcgcgactccccagagcctgcttctgagctgcaggccgaggaggccttgctgcaggagcagttcctggacgcctgccgacagatcgacgagctgagcgtgggcagcgacaccatagacctgtgaagaggtggccaccttgctaccctgcgatatgcccctttctggcgcctgccctgcccgagacctgcacactgtaatccttccccaatcctccctggctcagatacctctccagattccttccccatccaggggtccctgggtgggtgggtcagcagccaggctctatcgattgggaatcagtgccaccttctctggagccctgggtgctgatgccctcagctgcaaatctaggttggcaggggtcccattttccttggcattcaccagcaataaagctccaaggtgctccactcctgaccaccactccccactctggtgctgagtgagaggggctgtcctcagaggaccctgggacctgcctcaggcccccctacccacctctgccatgcctaggaatcccacccctgtgtgaatgggactccctttcctccatgtgacacccacaggggtccatgacccatctaggagactttatagcagttgggtgggaggggaatgctcttaatttatcaataaaatattttcagagg

SEQ ID NO: 16753 - DNA, 529 bp, Homo sapiens
  ENST00000553786
agaaaatttttttttgggggggggcggtttgggggaaggcagaaggagaagaaaatttgattgtgatggtggtggattttttccaaatttccccacagctgttatcaaaacatgcaaatgagattttccaacaggatcttaaacaaatctggaggagttaatgccgaagcaaaataatcagcacgtttgaagtgactgcgaaaaagaacttctccgtcagtcacctgctagacctggaggaagccggggacatggtggcggcacaggcggatgagaacgtgggcgaggctggccggagcctgctggagtcgccgggactcaccagcggcagcgacaccccgcagcaggacaatgaccagctgaactcagaagaaaaaaagaagagaaagcagcgaaggaataggacaaccttcaatagcagccagctgcaggctttggagcgtgtctttgagcggacacactatcctgatgcttttgtgcgagaagaccttgcccgccgggtgaacctcaccgaggcgagagtgcaggt

SEQ ID NO: 16754 - DNA, 2217 bp, Homo sapiens
  ENST00000367760
gatgttggcaaagggggttttcttaatcagactgttttttggtcccagggaaaggaggaagaaggagattgtgatggagaaagggggtctgtgaaacgtcaggcacagcacaaaggctttgccacgtaattacaggctcctattaagtcgagatctgccctcccaggggtctccaattttcttgtattccctacaaagcctcctctgcatgccagtttgtgccttttgaagtgccagagagcttcttgatccaactgagaaggaaaaaggagcccagcaagaagagggggagagagagaaggggaaaggggggaacccaccagcaccctccgtcggactcttgaagccttttttttttaattcttaatttttttttttactctttacaaaaagtaaagtgagaatcctgctctctaatacatctgcaagacatcaccctctcctcctgaaactttagtcactcctgagaatccacaggagtgcagagaggggggaacacgttttcttgaagatgttttaaagctggaacaagccttcttctgttggtgcttgaactcttgcctgggaataacttttttaacctttaaaaaaaccattcactttgattcttctctcccaccccttcttctctcttcttctgtttgcctaactcccccgccctgctggcctccgctttcctctctcccccttgttattatttttagtctgtgcgtgtggacacttttggagagttggaagggatttttttctcctgacttgaacatagggtgactttttaatattgtattttactgtggattatctctttggaccgcgccggacttggcctcaggaaatcaaccaatgctgcggaaggcggctggtgcacaacgctctgctctacagaagggggtcccccaccctcttttccaattttttttttttggccttcctctccttccctccctcttcctccctctctctctctctctctccactacccccctctttcttccccactcggctcctctcccccctcgcgcccacagcgtttggtgttgattcgagcgggaagaggggggtgggtgggatcggtgggggagaccatgacctccagctacgggcacgttctggagcggcaaccggcgctgggcggccgcttggacagcccgggcaacctcgacaccctgcaggcgaaaaagaacttctccgtcagtcacctgctagacctggaggaagccggggacatggtggcggcacaggcggatgagaacgtgggcgaggctggccggagcctgctggagtcgccgggactcaccagcggcagcgacaccccgcagcaggacaatgaccagctgaactcagaagaaaaaaagaagagaaagcagcgaaggaataggacaaccttcaatagcagccagctgcaggctttggagcgtgtctttgagcggacacactatcctgatgcttttgtgcgagaagaccttgcccgccgggtgaacctcaccgaggcgagagtgcaggtgtggtttcagaaccgaagagccaagttccgcaggaatgagagagccatgctagccaataaaaacgcttccctcctcaaatcctactcaggagacgtgactgctgtggagcagcccatcgtacctcgtcctgctccgagacccaccgattatctctcctgggggacagcgtctccgtacagatcctcgtccctcccaagatgttgtttacacgaggggcttcataacggattctaacggaagacactgaaaagcgccatggctacttattctgccacatgtgccaacaatagccctgcacagggcatcaacatggccaacagcattgccaacctgagactgaaggccaaggaatatagtttacagaggaaccaggtgccaacagtcaactgaggaaaaaaaataattaaacaggcctaagaagaaatcaaaaaccataagacacctatcctgctctgttatttcttcatctgctggggggaaaaagtaaattacaaacaaacaaacaaagcagaactaaaatattgggaccatggcagagaaaagcaggagaggagcaaaatgaaaattagttaacaaatgttcctcctccctctgggataccaccaccacttgtttctgtgtgtgtttattttgtttttctttcattcatgctttgcttaatgtactccaggcttcttcagctaggttcagcccacccacccccatgattgta

SEQ ID NO: 16755 - DNA, 4284 bp, Homo sapiens
  ENST00000239461
tttttaatattgtattttactgtggattatctctttggaccgcgccggacttggcctcaggaaatcaaccaatgctgcggaaggcggctggtgcacaacgctctgctctacagaagggggtcccccaccctcttttccaattttttttttttggccttcctctccttccctccctcttcctccctctctctctctctctctccactacccccctctttcttccccactcggctcctctcccccctcgcgcccacagcgtttggtgttgattcgagcgggaagaggggggtgggtgggatcggtgggggagaccatgacctccagctacgggcacgttctggagcggcaaccggcgctgggcggccgcttggacagcccgggcaacctcgacaccctgcaggcgaaaaagaacttctccgtcagtcacctgctagacctggaggaagccggggacatggtggcggcacaggcggatgagaacgtgggcgaggctggccggagcctgctggagtcgccgggactcaccagcggcagcgacaccccgcagcaggacaatgaccagctgaactcagaagaaaaaaagaagagaaagcagcgaaggaataggacaaccttcaatagcagccagctgcaggctttggagcgtgtctttgagcggacacactatcctgatgcttttgtgcgagaagaccttgcccgccgggtgaacctcaccgaggcgagagtgcaggtgtggtttcagaaccgaagagccaagttccgcaggaatgagagagccatgctagccaataaaaacgcttccctcctcaaatcctactcaggagacgtgactgctgtggagcagcccatcgtacctcgtcctgctccgagacccaccgattatctctcctgggggacagcgtctccgtacagcgccatggctacttattctgccacatgtgccaacaatagccctgcacagggcatcaacatggccaacagcattgccaacctgagactgaaggccaaggaatatagtttacagaggaaccaggtgccaacagtcaactgaggaaaaaaaataattaaacaggcctaagaagaaatcaaaaaccataagacacctatcctgctctgttatttcttcatctgctggggggaaaaagtaaattacaaacaaacaaacaaagcagaactaaaatattgggaccatggcagagaaaagcaggagaggagcaaaatgaaaattagttaacaaatgttcctcctccctctgggataccaccaccacttgtttctgtgtgtgtttattttgtttttctttcattcatgctttgcttaatgtactccaggcttcttcagctaggttcagcccacccacccccatgattgtatgaagttttaaaaaaaactacagcagccaaagaaactatatatatatatatatatatatatatccagaatgattgcctctactgtcctcattgacttgtttgaaccttagtgccttaccctgtcctcttcccagttctctttatagaagctctaggagctttcgaaaagccaaagtctttctgaagaatctgtgctggacagacataattccctttctcattgtctccatctttgttggtcatggtaaggtttttccatcagcctctgaaaaaatagttgtgcacaacatctgctcactggactgtctgatccaatgtaattggctgcgtctggctaattctaagcactaaagtctacatctaagctatagatttaagcttgaagctacagattatatcactatcaccaccacccctcaccctatgcaatcaatcaatcaatcatcttaagttaaagatatttgttgtctttgaatgatttgctgtcacagactatttggtagaagaaatatttttcacctgagagaggaagagaaatttctctagtaacacaaagagtgagttctaaaaggcatgcccacatctctttcgtgccttaaggatagtgagatgcacacttatatatatactgtatatatttatatatttatatatatatttcatatatatatataatattgcaagcttaagtttgcaatttcccaaacaatacaaaaagcaaattacacaccctcaccactgttcttatctctatagtgatgaaacattaattagggatcttgctgcttttctttttctacacgaagttttcattaaagccacagaataattgatagggcagctgtttgagaacaggtcccattttcacattagggctttaaatgaattagaaactatttgaggctataaaaatgtccttgagtttggagcctgagctctggtgaaatgctgatacatctgatctatcatgggaattgcagttagagagagtaaggaataccatttagtcatctatccgttcttcacttagcaggaatatgaaagaaaggcacatgtttaagaggaatacctaaaggtttttctaaattccaacatttaaaaggcaattgtgggctatttttattttttaatattttgaaataaagtttagtgtctagggctgggagccaggactgatcttccatttctttttctttgttcccagccatgcttttgtaacttgccaggtggacttgaccaactacattaccatgctgtgcctcagtttacccatttgtaaaatgggattaataatacttacctacctcacaggggtgttgtgaggctctattcatttgctcctttattctttcctgtattctctgtatgtccagcactttgtagccatgggaggaaagggactataaaagtgtacaatgttaatggaatgatacggtacctgaaagccttgttttctagtaagaaaatgctaccttgctgtacatacttataaccttgtatttggaaatgagaaataggtttatattttcagatctctcaaaaatcacatcatttgaccaaagaataatttaagacacatagaacagatttttttaatttatattttcatcctgaccagcttagttctaataatttttagttgtgagtgattaaaaaactttggatcaattttggtcaaacatgccaactttgtagtctgagtgacaggcaaggatttttgggtttaagatgcacttttagcacacatttgtatttcccttggcatatcagattgagctaatggtgatgttatttcaatctaacagccaccaatctgaaattgtatttcaaatgttgattctgtagttctttaaataataatgaagctcatcttatacattttgctttcaccaattgattccttcttcttttagcccactattaaaacatttcttactgaatggttcatgtaggcttgctgaacagcacgcattacttgcttcctgaagagttcccccattcatccatttgtcccattagttgctgtggattatcaagttttgaaggaactgtacatcccaacagactgaaacattctaagtgaaatgagtataatccaagtaactggtgaactttggaggtttggagcttgaagagaatggctaagaagatttgaattatagggagggaacagaaatcatacatgaaaaggttttactgagaaggggaaaaccttagatagagggacatgtgaaacaaaatcatttgaaattttgattcagacatccatttccagtggcaaacagcaaagcctgaacccataaacccaaatgataggtgaagttgggtggttttatccaatgtctcaagcaagcaatgtctgggaatatcatagagtaacaagtgctggtcagccaaagaaacattcactgctggtgaaccaataccataagcatgtattatctaagcacttgatcaagaaatatacatgttgtacaagctctcaattttgttcatttattatcaaatttttaaaatacaagtttggtatgtgatttggaaaagatgccttctggatcttaagccagttgtcagtggaggtcctcagggctgcaaatgtcaagacataaccctgttcctcaccatcatgataccagatacaggtgaatacataggaactatctgcctgtgtcctcaatctcccttcaaacaagatgctgatttgtagggtacttggcaggttaaattaaaccagaagaggtgacttaataaaaaagggaatgacatttagggtataaagatctcataagaaatgtaatatgtaaattatatcttgctttatgttgtaaaatatacattgtttgcgctagaatagaaatgatttcttttcaataaaaagaaagaaggactctaccatgtcttttgttatata

SEQ ID NO: 16756 - DNA, 3501 bp, Homo sapiens
  ENST00000497230
tctttggaccgcgccggacttggcctcaggaaatcaaccaatgctgcggaaggcggctggtgcacaacgctctgctctacagaagggggtcccccaccctcttttccaattttttttttttggccttcctctccttccctccctcttcctccctctctctctctctctctccactacccccctctttcttccccactcggctcctctcccccctcgcgcccacagcgtttggtgttgattcgagcgggaagaggggggtgggtgggatcggtgggggagaccatgacctccagctacgggcacgttctggagcggcaaccggcgctgggcggccgcttggacagcccgggcaacctcgacaccctgcaggcgaaaaagaacttctccgtcagtcacctgctagacctggaggaagccggggacatggtggcggcacaggcggatgagaacgtgggcgaggctggccggagcctgctggagtcgccgggactcaccagcggcagcgacaccccgcagcaggacaatgaccagctgaactcagaagaaaaaaagaagagaaagcagcgaaggaataggacaaccttcaatagcagccagctgcaggctttggagcgtgtctttgagcggacacactatcctgatgcttttgtgcgagaagaccttgcccgccgggtgaacctcaccgaggcgagagtgcaggtgtggtttcagaaccgaagagccaagttccgcaggaatgagagagccatgctagccaataaaaacgcttccctcctcaaatcctactcaggagacgtgactgctgtggagcagcccatcgtacctcgtcctgctccgagacccaccgattatctctcctgggggacagcgtctccgtacaggtgaatgactggcccactctcccttgctccacttccacatgtttctcagcggtcggtcatgtttcaagctgcttgtgcagctcaccgacatttcttactgggttaatctcttcagagacattcaacttgctgacatccccacattttcccaggagattataagctgccccagcagcagggtttggggcagaagtgagaggggcaggctatctcaccaatctcctcttggactcaggaactcttgcaaaggtttcaaagatgaggaagaatctaaaagaaaagatcattaagctgtgcccagtgttcctcttgcaacaattctggaacaaaactttaccctgtttccaaatttaagctaaattcgttgtattatgcaaatgtagggacgtaacttgtaaaactccaagtatagggccaaaggcaaactttgcagtaaaactggctttgaattaaaaaaaggaagaaggaaggaaggaagaaagaaaggaaagaaggaaggaaggagagagacgagagggactatgacagagagaggaggaaagaaaagccaagttcattctgatcactttcatggccaaggttctttgttagtaggtgtgaatttcttataatgccaaatgccttcctaatctattgctaattcttgtctacttgtctgaagttttctctggggatcagtttgtgtgtatttgtgtgtgtgcgtgtgtgtgtgtgtctgtgtgtgtttcttttaaataaaaaaggaatgtataatttacactaaacttttatattaaaaagttgaacatttttaaagaaacaaatatcagagtactatttcaatctcataaagaggcttttaacctcccattattatgctgttcagaaaatataggctgccagaagggaagctgagacacaaattcctaacccattggattagtctagagtgactttctttgaaaatatacctgagtactctgagaaaccaggccaagcctacgtgttctccctggctgatttcagtggaggaagaactattcaaaaattcatttattatgcttttgtttacctttttattgtcaaggttaattattggtttaaggagaggttttaaatgaaatataggagattatgtctcagatgaagttgaatttctgacatgaaatgctacatttttgaaatgcaagtgtttttcaaaggttcttagctttaatcaaagcaaaaagcctcatctaaaagtttctttctgttccaaatcagttcctttagagaaacatggtaaatgcacttggaaatttgttttaatcccctgttataaaattagcctgaattctttttgtcttagcacatagagaccctacatctaggaaagtcttattctgggccctattgcactcagatgtggtgtgccttactgatcttgaaacattagttatatctgtgtgccctattttaaatttaaactcctctcctataagatttactacaaatacattttttgaagaccactgtaaaatcacatattctctaatattttaaataaatgaaaggctgctttatttctcttataaacattggtataagagaaatttggtgtgttcatgaacacgctaaatggcttggaaaatgggtgtggttcaaagcctgatgcttcaagatctctggtttgaatttggtcacaaccaggaagtattgcccctttttctgtctgggtcctccataggaacttttcataccagccataaacaatccagatggctgccacgtggtccttaccagtgagaggcgtcacacagcacacactgcatgaatggggatgaaatcattcctgaattaatatagggttatattacttggacctcagccatttgagcctcagtgtctgcatcatatgtgtttagtatatggacatctaactgaaattattaacgtggcaatttatgcgtgccttttttggaaatattctattttaatggaaagaattatgtagaaatactggatacatttttaaaaacatccataattcaccatcttgacataactagtatattcatttttgtgattagagttcaatgttttatatagatgtagctttagtgtatatattattttgtattctgctcttttcacttaaagtcatatgacctagtacattttactcatttcttggtatgcttttatatcatttctctcttagaaattggatttgtaaaaattaatttagaaaatcataaaatctgttcatattctgtatgaagaataaattaatcttcagatataagcagaaaagtgatgttaaaacaataatttaatcaataataatgttttttgatccaatgttgactgaagtgtttatattttggttgatttctaaaagtagcaaaaagctattctgttatttggagaattttctgctatgtttagaaccaaactatgttatgatttcacactttgaagcttgataggaaatattgttaaggaaataaaaaagaaaaacaagtgatccaaagcaaaggaaatgatagacttttgtgttatgaaaaattaactcactgttcttgttggtactattatgtcaagttagttatctcacatgtgacactcattaaaaggcatttctcttggttaattcttggaa

SEQ ID NO: 16757 - DNA, 586 bp, Homo sapiens
  ENST00000476867
agaatttatgtttattaggcactaattctgggccaattctcaaaactatcctgtgtggtttcagaaccgaagagccaagttccgcaggaatgagagagccatgctagccaataaaaacgcttccctcctcaaatcctactcaggagacgtgactgctgtggagcagcccatcgtacctcgtcctgctccgagacccaccgattatctctcctgggggacagcgtctccgtacagcgccatggctacttattctgccacatgtgccaacaatagccctgcacagggcatcaacatggccaacagcattgccaacctgagactgaaggccaaggaatatagtttacagaggaaccaggtgccaacagtcaactgaggaaaaaaaataattaaacaggcctaagaagaaatcaaaaaccataagacacctatcctgctctgttatttcttcatctgctggggggaaaaagtaaattacaaacaaacaaacaaagcagaactaaaatattgggaccatggcagagaaaagcaggagaggagcaaaatgaaaattagttaacaaatgttcctcctccctctgggataccac

SEQ ID NO: 16758 - DNA, 464 bp, Homo sapiens
  ENST00000495280
tgggccaattctcaaaactatcctgtgtggtttcagaaccgaagagccaagttccgcaggaatgagagagccatgctagccaataaaaacgcttccctcctcaaatcctactcaggagacgtgactgctgtggagcagcccatcgtacctcgtcctgctccgagacccaccgattatctctcctgggggacagcgtctccgtacagatcctcgtccctcccaagatgttgtttacacgaggggcttcataacggattctaacggaagacactgaaaagcgccatggctacttattctgccacatgtgccaacaatagccctgcacagggcatcaacatggccaacagcattgccaacctgagactgaaggccaaggaatatagtttacagaggaaccaggtgccaacagtcaactgaggaaaaaaaataattaaacaggcctaagaagaaatcaaaaaccataa

SEQ ID NO: 16759 - DNA, 329 bp, Homo sapiens
  ENST00000485529
tggtcatggtgctgcctgacatctgctgaacgcatttggcttatttctccctttcacactttcaaaaatagatcctcgtccctcccaagatgttgtttacacgaggggcttcataacggattctaacggaagacactgaaaagcgccatggctacttattctgccacatgtgccaacaatagccctgcacagggcatcaacatggccaacagcattgccaacctgagactgaaggccaaggaatatagtttacagaggaaccaggtgccaacagtcaactgaggaaaaaaaataattaaacaggcctaagaagaaatcaaaaaccataa

SEQ ID NO: 16760 - DNA, 362 bp, Homo sapiens
  ENST00000496573
tcagcagtgaagtcctcaagtgaggaatattattggtaaccagagctgcaagaaagcatgtccactaaatgaagcatagtgtgatactaatctagagcagggctcttcagagattgctgtgcacaggaaacatctgggatcgcgtgactgtgcaaactctgattcactaattccagcgccatggctacttattctgccacatgtgccaacaatagccctgcacagggcatcaacatggccaacagcattgccaacctgagactgaaggccaaggaatatagtttacagaggaaccaggtgccaacagtcaactgaggaaaaaaaataattaaacaggcctaagaagaaatcaaaaaccataa

SEQ ID NO: 16761 - DNA, 1124 bp, Homo sapiens
  ENST00000328655
ggcctctgtcacccccgggcccacagcacagcccagggccatgctcctgttctcagtgttgctgctcctgtccctggtcacgggaactcagctcggtccacggactcctctcccagaggctggagtggctatcctaggcagggctaggggagcccaccgccctcagccccctcatccccccagcccagtcagtgaatgtggtgacagatctattttcgagggaagaactcggtattccagaatcacaggggggatggaggcggaggtgggtgagtttccgtggcaggtgagtattcaggcaagaagtgaacctttctgtggcggctccatcctcaacaagtggtggattctcactgcggctcactgcttatattccgaggagctgtttccagaagaactgagtgtcgtgctggggaccaacgacttaactagcccatccatggaaataaaggaggtcgccagcatcattcttcacaaagactttaagagagccaacatggacaatgacattgccttgctgctgctggcttcgcccatcaagctcgatgacctgaaggtgcccatctgcctccccacgcagcccggccctgccacatggcgcgaatgctgggtggcaggttggggccagaccaatgctgctgacaaaaactctgtgaaaacggatctgatgaaagcgccaatggtcatcatggactgggaggagtgttcaaagatgtttccaaaacttaccaaaaatatgctgtgtgccggatacaagaatgagagctatgatgcctgcaagggtgacagtggggggcctctggtctgcaccccagagcctggtgagaagtggtaccaggtgggcatcataagctggggaaagagctgtggagagaagaacaccccagggatatacacctcgttggtgaactacaacctctggatcgagaaagtgacccagctagagggcaggcccttcaatgcagagaaaaggaggacttctgtcaaacagaaacctatgggctccccagtctcgggagtcccagagccaggcagccccagatcctggctcctgctctgtcccctgtcccatgtgttgttcagagctattttgtactgataataaaatagaggctattctttca

SEQ ID NO: 16762 - DNA, 1005 bp, Homo sapiens
  ENST00000522210
ggcctctgtcacccccgggcccacagcacagcccagggccatgctcctgttctcagtgttgctgctcctgtccctggtcacgggaactcagctcggtccacggactcctctcccagaggctggagtggctatcctaggcagggctaggggagcccaccgccctcagccccctcatccccccagcccagtcagtgaatgtggtgacagatctattttcgagggaagaactcggtattccagaatcacaggggggatggaggcggaggtgggtgagtttccgtggcaggtgagtattcaggcaagaagtgaacctttctgtggcggctccatcctcaacaagtggtggattctcactgcggctcactgcttatattccgaggagctgtttccagaagaactgagtgtcgtgctggggaccaacgacttaactagcccatccatggaaataaaggaggtcgccagcatcattcttcacaaagactttaagagagccaacatggacaatgacattgccttgctgctgctggcttcgcccatcaagctcgatgacctgaaggtgcccatctgcctccccacgcagcccggccctgccacatggcgcgaatgctgggtggcaggttggggccagaccaatgctgctgacaaaaactctgtgaaaacggatctgatgaaagcgccaatggtcatcatggactgggaggagtgttcaaagatgtttccaaaacttaccaaaaatatgctgtgtgccggatacaagaatgagagctatgatgcctgcaagcaaagctattttcccactttacaaagaatgaacaccggaagctctcaaacaaagccgcctgggtctcacacctttcatctgcaaaactgatgctttgctctttcttctacatggagccatttttggggcagaaaacatacccttgggcatagccttgagttgaaaatctttgagggtgttttctgtccaaatgactgaaaaaatgaataaaagcctccccattt

SEQ ID NO: 16763 - DNA, 2374 bp, Homo sapiens
  ENST00000518641
ttggaagcctgctcctcccagcccggtccccagctcacactggatgctgactaagtgtttccccttttcctttccactctctttctttccaccagaatgtggtgacagatctattttcgagggaagaactcggtattccagaatcacaggggggatggaggcggaggtgggtgagtttccgtggcaggtgagtattcaggcaagaagtgaacctttctgtggcggctccatcctcaacaagtggtggattctcactgcggctcactgcttatattccgaggagctgtttccagaagaactgagtgtcgtgctggggaccaacgacttaactagcccatccatggaaataaaggaggtcgccagcatcattcttcacaaagactttaagagagccaacatggacaatgacattgccttgctgctgctggcttcgcccatcaagctcgatgacctgaaggtgcccatctgcctccccacgcagcccggccctgccacatggcgcgaatgctgggtggcaggttggggccagaccaatgctggtatgtgactgctcagcttcccctggggaaaaagccactgcaatgtgaaggagaggggaggaagctaaggaaggagtgaggacaagacttgcattggagcagattcccgctcagtggagtctcacagtgcccaaagtttagctccttttgggtgccgaaaccccaagctgacaaaaactctgtgaaaacggatctgatgaaagcgccaatggtcatcatggactgggaggagtgttcaaagatgtttccaaaacttaccaaaaatatgctgtgtgccggatacaagaatgagagctatgatgcctgcaagacccagcgctgccgcgtgcttctttcctctggattcgaatttcctgggccaccaccgaagatgcaaaggcaaattcaggaaatgcaaatccttaaatggaagcttgggcttttcctggggacctacagcctggctgagtgttctccagaaagagactgaagaaaagcttcctggttgggcgaggtggctcatgcctgtaatcccagcactttgggaggctgagatgggtggatcacctaaggccaggagttcaagaccagtctggccaccacggtgaaaccccgtctctactttaaaaaatacaaaagttagccgggtgtggtggcgggcacctgtaatcccagccaatcgggatcctgaggcaggataacggcttgaacccaggaggtggaggttgcaatgagcggagatcacgccactgcactccggcctgggcatcaagagtgaactctatctccaaaaaaaaagaaaaaagaaaaaaagcttcctagttatcctttttcccactctaaccctactcctccagaggtcctacagctacaatgtctagaagccattttttcagaagctcctaagaacctgggactcaggcaggcccagtggagggtggccagctggagtgttcaccatctcaggacatcaccactgtccactccactttcctgctcaccgccctctgacttctgtgtgggggccctcccttttcacccactctccaatttgcatagttctggatggctggccctttgctgggggctggggtgggcatagaactcgagcctggcctagaaggacattgattttggccacagggatgggagcagcaatgggctgtgggctttataggtcacaagagcaagaccaagacttctgctggagttatcaggaacaagactgactgactctcctgggactcccaacatggtagggtgcatgttgaaggtactgctcatgtgaaggctgctggggagtgtggtggttccttttgtctgtcaacttggaggggatctgtggatgagattgatgtttaaattggtaaactgtgacgaagcagattgccctccataatggggtgagcctcatccaatccgttgaaggcctgagtaggacaaaaatgattggcctccccacacaagagggaattcctcagccgcccaccttcagacttcatctgcattgtcagctcttctggggctctgcctgccagtctctaaaccagagcagcaccaccagctctcctgcatctcgagcctgccagtccacaccccaggtttgagcttgccagtctctgtaatcagggacagaaaactgactgtgtgctctgttgacccagcctcaacaaacaggacatggtggcctgcacctgtgcttctcagaccatctgtgaggaaaaagaccagggcttttggtttttggttttgcttcgaaatttccaacttatttcaaaccaatactttcataaaacataaaattgaactactcgaaaaatgaaatcgaaaatgaacaaataaaatgcaagcccaca

SEQ ID NO: 16764 - DNA, 4513 bp, Homo sapiens
  ENST00000274710
ctcgctcagcctctccacatcgcggctccggcacctgaagggacgcgggcgggcgcgggcagctccgaccggcggcggcggggcgggacaggcagcccggcggcctccgatggccccgccgtgagaggccggacccgcggcggggaccagcagcggtctagaggagtcccaggagcagccaggacaggcggaagcagtggctgccatggaggaggacaagctcttatctgcagtgcctgaggaaggcgatgccacccgtgaccccggtccagagcctgaagaggagccaggggtccggaatgggatggccagtgagggcctgaacagcagcctctgcagcccagggcacgagcgaaggggcaccccagcggacactgaggaacccacgaaggacccagatgtggccttccatggcctcagccttggcctctctctcaccaatggcctagccctggggccagacttgaacattctggaagattcagcggagtccaggccctggagggctggcgtgctggcagagggggacaatgcttccaggagcctctacccagatgctgaggaccctcagctggggttggatggtcccggggagccagatgtgcgggatggcttcagcgccacgtttgagaagattctggagtcagagctgctgcggggcacccagtacagcagcctcgactccctagacgggctgagcctcacggatgagagcgacagctgcgtcagcttcgaggcccccctcacacccctcatccagcagcgggcccgtgacagccctgagccaggggctgggttgggcattggggacatggcgtttgagggggacatgggggcagctggtggtgatggggagctgggcagccccctgcggcgctccatctccagcagccgctctgagaatgtcctgagccgcctgtctctcatggccatgcccaatggattccatgaagatggccctcagggcccagggggggatgaggatgatgatgaggaggacacggacaagttgctgaactcagccagtgaccccagcctgaaggatggcctgtcagactcagactctgagctcagcagctcggaggggttggagcctggtagtgcagaccctctggccaacgggtgccagggggtcagtgaagctgctcatcggctggcacgccgtctctaccacctcgagggcttccagcgctgtgatgtggcccggcagctgggcaagaacaacgagtttagcaggctggtggccggggagtacctcagtttcttcgacttctcgggcttgactctggacggagcactcagaacattcttgaaggccttcccgctgatgggggagacacaagagcgtgagcgggtcctcacacacttctcccgccggtactgccagtgcaaccctgatgacagcacttcggaagatgggatccacacgctcacctgtgccctgatgctgctcaacacggacctgcacggccacaacattggcaaaaagatgtcctgtcagcaattcattgccaacttggaccagctgaatgatggccaagactttgccaaagacctgctgaagaccctttacaactccatcaagaatgaaaagctggaatgggccattgatgaggatgagctgaggaaatccctgtctgagctggtggatgacaagttcgggacaggcacgaagaaggtgacgcgaatcctggatggtggcaaccccttcctggatgtcccacaggcgctcagtgccaccacctacaagcacggcgtcctgacccggaagactcacgctgacatggatggcaagaggacgccccgtgggaggcgtggctggaagaaattctacgcagtgctcaaagggaccatcctgtacctgcagaaggatgagtacaggcctgacaaagctctatcggagggtgacctgaagaacgccattcgcgtgcatcacgctctggccaccagggcctctgactacagcaagaagtccaacgtgctgaagcttaagacagccgactggagggtattcctcttccaggcaccgagcaaggaagaaatgctgtcctggatcctcaggatcaacctggtggcagccatcttctctgccccggccttcccagccgctgtcagctccatgaagaagttctgtcggcccctgctgccctcctgcaccacccgcctctgccaggaggagcaactgcggtctcatgagaataagttgaggcagctgactgcggagctggccgaacacaggtgtcacccagtcgagaggggcatcaagtccaaggaggccgaggagtaccggttgaaggagcactatctcaccttcgagaaaagccgttatgagacctatatccacctcctggctatgaaaatcaaagtgggctcagatgatctggagcggattgaggcccggctggccactctggaaggggatgacccttctctccggaagacacattcaagccctgccctcagccagggccatgtgactggcagcaaaaccacaaaggatgccactgggcctgatacttagctgacatggatttgcagaccccagggtgggcagatgtctccagtggggtcagtgagcacaattccagccaggggccacttggaccaagctccagtcagttgatgggcagctagaggggtgcagaaagcctgtgggcccaggagatggagatgccgtttgtggcgttgatctccttgcgtccttgggcatctccgggcatcagaccctctccctggcccttgttttcctctccaccatggagcctcattttgtaggccagttgtgtgcatgctctagacaccacctcgctggagaagctggaagggctgttgtcttcccaggtctttctcttctcatcaagctcctctcctcatcttttttgtgtgtgagggcaggtcttgactctaggtctcagctggaaccccaccctttctcctcctccttcctctgagttgaccagcagcaggtctgccgaccaccagcaccatcctctcctcccagcagcctccagaaccatgcccaggtctcctgcctcacatcacaataatctgggacccaggcttgtgccctttcagtgtaaagctgactccatcacatgtgcatccacttcttttcatccattgagatcacactgcctcctttttatacagacacaaatatacatctataagaataatatatacataaggaacccctgaaagatggttttggaactggaatcagttagaggatgaaatcagataaaggaaaagcctattttggagcttcccctgttaggaaggatggctgcacctggccccctggcattcctgacgctctaggagggaagggggaggcagtgctggcctcccttgccctgtttttccctcttccagctgacctgtgacttatactgctcttaccgatgatacttttggaaaaaatagagcgtgtatgcaccgccccgtttgtcccatggatatcctggggtgtgagtcggatgggaccacggccctgtttatatttgggtctttatgttggtgctgccaggtctctgagctccagaggtggcctcttggacagatctactgctataggaataaaagacactctgtctcgcaaatggctgcttgtcaacaagcccaaagatgcttgtcggaggacggttatggaagcccttaattcttggttgtgggaaaaggtggaatgacaagttattgattgtttttctgtcgctatttctttcatttgtctagtgaatcagaaaggcttagccaaggccacatctgggaagagtggagaaatttgccacttgacgatcacggattagctagcacctttaagccctgcatttctccaactgacaagtgggtgggggtgatggcacattcagtgtggctatgaagagcgaatcctctctattgtttaaatagattactgtagtttggccaggaatttggcgtcagtggtaacacacttagttaataaaataagccaggcttgcaactaagtatctaactttacaggcccactcacatttgaggcaaggggctattgagtatgtggagagatgtagtgatttaaattcagattatttaagttggatcagctgaagtgtgttttagacccaaaccatctggccccttcgttttgctcagaggaagtaaatgttcacttaaatgaaattgaaaacgccatgtggcaccacaaaagagctctctgtactttccccatgctgcctcaaaagttctgtgagtttcggggtcagtgtcccacccttcacttcccgagggcgggtgagtggagagcagagccaggagctctggcagctgtggacagatgtgcttcctgagcatgggttgtgcctcccatcagtaaaaaaatgtttagttcacttccttaattgtataattatttatttgtaaattatatacatgtactactgtactaaaatattatgtacattataaaacatacacaaaaatagaaatttaaaaaagatgagatgaaaataaatctaagtcaaagttctaa

SEQ ID NO: 16765 - DNA, 1584 bp, Homo sapiens
  ENST00000369904
ctgttgcgtggaagataaggcggcgcgggaagtggacacagggtgggctggagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagtgaggagaccagagcagccaagttgcgggcctgccagccgaatgccactcaccagccggagtgtgccacctggcagaggtgccctacctccggattctctgtcaactcgaaaagggcttccaagaccaagcactgcaggacacagagtgcgggaaagtggacacaaggttcctgtttcccagcgactaaatcttcctgtcatgggtgccactcgcagcaatctgcagccccccaggaaagtggcagtcccaggacctaccaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtatttttatattctctgta

SEQ ID NO: 16766 - DNA, 1730 bp, Homo sapiens
  ENST00000409267
gggagaaagcctgttgcgtggaagataaggcggcgcgggaagtggacacagggtgggctggaggtgtgcttcgcgtgtgatgccaggggagtggaaagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagcccacccacccccatcagatccgtcctggccccacagccttctaccagcaactctcaacgcctgccccggccgcagggagcagctgctaaatcttccagtcaactgcccattccctcggccatccccaggcctgccagccgaatgccactcaccagccggagtgtgccacctggcagaggtgccctacctccggattctctgtcaactcgaaaagggcttccaagaccaagcactgcaggacacagagtgcgggaaagtggacacaaggttcctgtttcccagcgactaaatcttcctgtcatgggtgccactcgcagcaatctgcagccccccaggaaagtggcagtcccaggacctaccaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtatttttatattctctgta

SEQ ID NO: 16767 - DNA, 1717 bp, Homo sapiens
  ENST00000369907
ctgattcccgggactaggttgcgggagaaagcctgttgcgtggaagataaggcggcgcgggaagtggacacagggtgggctggagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagcccacccacccccatcagatccgtcctggccccacagccttctaccagcaactctcaacgcctgccccggccgcagggagcagctgctaaatcttccagtcaactgcccattccctcggccatccccaggcctgccagccgaatgccactcaccagccggagtgtgccacctggcagaggtgccctacctccggattctctgtcaactcgaaaagggcttccaagaccaagcactgcaggacacagagtgcgggaaagtggacacaaggttcctgtttcccagcgactaaatcttcctgtcatgggtgccactcgcagcaatctgcagccccccaggaaagtggcagtcccaggacctaccaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtatttttatattctctgta

SEQ ID NO: 16768 - DNA, 1826 bp, Homo sapiens
  ENST00000409138
gggcctgagagattcgaaaggagccccgccccctcggagctgattcccgggactaggttgcgggagaaagcctgttgcgtggaagataaggcggcgcgggaagtggacacaggatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagtgaggagaccagagcagccaagttgcgggtgagtgggagtggggagtttgtgggattgaccctgaaatttctccacccctctccaccaggcccacccacccccatcagatccgtcctggccccacagccttctaccagcaactctcaacgcctgccccggccgcagggagcagctgctaaatcttccagtcaactgcccattccctcggccatccccaggcctgccagccgaatgccactcaccagccggagtgtgccacctggcagaggtgccctacctccggattctctgtcaactcgaaaagggcttccaagaccaagcactgcaggacacagagtgcgggaaagtggacacaaggttcctgtttcccagcgactaaatcttcctgtcatgggtgccactcgcagcaatctgcagccccccaggaaagtggcagtcccaggacctaccaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtatttttata

SEQ ID NO: 16769 - DNA, 1870 bp, Homo sapiens
  ENST00000492431
ggtttggcgcacttggggctgctgggcggctggctgactcgggcctctatgacactattggtagcggggagagaagggagaagctggagttagatttcagggtgttaagaagaaggataagtggatttgctgcatctccatcctggcatcatttctgatgtccgtaaatgctaaaggcctattaggccccatagaaccaggtatctcatcgcccagaggccacatctcacagccagcatgggcatcggggcctagggtcatgtccctggctctgttgtggggcttttatgcagtctcccttgcataatctcctgttcccttttgcatgggcatgatgcctggtttgtttcctgtctcagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagcccacccacccccatcagatccgtcctggccccacagccttctaccagcaactctcaacgcctgccccggccgcagggagcagctgctaaatcttccagtcaactgcccattccctcggccatccccaggcctgccagccgaatgccactcaccagccggagtgtgccacctggcagaggtgccctacctccggattctctgtcaactcgaaaagggcttccaagaccaagcactgcaggacacagagtgcgggaaagtggacacaaggttcctgtttcccagcgactaaatcttcctgtcatgggtgccactcgcagcaatctgcagccccccaggaaagtggcagtcccaggacctaccaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtattttta

SEQ ID NO: 16770 - DNA, 1710 bp, Homo sapiens
  ENST00000369903
agaaagcctgttgcgtggaagataaggcggcgcgggaagtggacacaggctgcgagccttgggcagaatggatacctgaggaaaggtatggtttctctccagctcagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagcccacccacccccatcagatccgtcctggccccacagccttctaccagcaactctcaacgcctgccccggccgcagggagcagctgctaaatcttccagtcaactgcccattccctcggccatccccaggcctgccagccgaatgccactcaccagccggagtgtgccacctggcagaggtgccctacctccggattctctgtcaactcgaaaagggcttccaagaccaagcactgcaggacacagagtgcgggaaagtggacacaaggttcctgtttcccagcgactaaatcttcctgtcatgggtgccactcgcagcaatctgcagccccccaggaaagtggcagtcccaggacctaccaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaat

SEQ ID NO: 16771 - DNA, 366 bp, Homo sapiens
  ENST00000474126
gaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagtgaggagaccagagcagccaagttgcggggagcagctgctaaatcttccagtcaactgcccattccctcggccatccccaggcctgccagccgaatgccactcaccagccggagtgtgccacctggcagaggtgccctacctccggattctctgtcaactcgaaaagggcttccaagaccaagcactgc

SEQ ID NO: 16772 - DNA, 835 bp, Homo sapiens
  ENST00000429031
agaaagcctgttgcgtggaagataaggcggcgcgggaagtggacacaggctgcgagccttgggcagaatggatacctgaggaaaggtatggtttctctccagctcagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagcccacccacccccatcagatccgtcctggccccacagccttctaccagcaactctcaacg

SEQ ID NO: 16773 - DNA, 1040 bp, Homo sapiens
  ENST00000418914
agaaagcctgttgcgtggaagataaggcggcgcgggaagtggacacagggtgggctggaggtgtgcttcgcgtgtgatgccaggggagtggaaaggtggcttggggagtgcagaaccctgaggatagtggcggggaggaagatggggcgtgcaggccgcccccagtgaggagaggccaggatgcagggcggctccagggcaatctgggcagttgggggagccctccgtatcgttcccggaggtagcaggagtagctgtgcgggaggtgccactcctgggcgcttgctttgcctccagcatgacccccgaccctggcttgcaccctgaatctagctgcgagccttgggcagaatggatacctgaggaaaggtatggtttctctccagctcagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggccca

SEQ ID NO: 16774 - DNA, 839 bp, Homo sapiens
  ENST00000459765
gattcccgggactaggttgcgggagaaagcctgttgcgtggaagataaggcggcgcgggaagtggacacaggatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggtgagttgagagagttgagttggaggtgtgccccagacatggtgtgtgccatgatgcagggagtggtttccttattggtaaaacagggatagcatttctacatctagaattgttggaattaaatgagaaccatgaaaaaagagaaccaaaactcttaccacagtgtctgagtatatgtctatgataaactcaataaatggtattggcaatagtga

SEQ ID NO: 16775 - DNA, 738 bp, Homo sapiens
  ENST00000471740
attcccgggactaggttgcgggagaaagcctgttgcgtggaagataaggcggcgcgggaagtggacacagggtgggctggagatctaactggactctcgctcctgctggctggacatggaggatttggaggaaggtaaggaaaggagggagggaagaatgaaagggaggagtgagacccagcgatggagagctgcatcagggacccatgactggctttcattcttctttccccttcagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagg

SEQ ID NO: 16776 - DNA, 1742 bp, Homo sapiens
  ENST00000369909
aggagccccgccccctcggagctgattcccgggactaggttgcgggagaaagcctgttgcgtggaagataaggcggcgcgggaagtggacacagggtgggctggagctcagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagcccacccacccccatcagatccgtcctggccccacagccttctaccagcaactctcaacgcctgccccggccgcagggagcagctgctaaatcttccagtcaactgcccattccctcggccatccccaggcctgccagccgaatgccactcaccagccggagtgtgccacctggcagaggtgccctacctccggattctctgtcaactcgaaaagggcttccaagaccaagcactgcaggacacagagtgcgggaaagtggacacaaggttcctgtttcccagcgactaaatcttcctgtcatgggtgccactcgcagcaatctgcagccccccaggaaagtggcagtcccaggacctaccaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtatttttatattctctgt

SEQ ID NO: 16777 - DNA, 2900 bp, Homo sapiens
  ENST00000589328
ggcagtcaggcctccccgctctgtgctacctgcggcccggctctcctccgcgcccccactcgcgctgcgatgacgcgctcactgttcaagggaaacttttggagtgcagacatcctcagcaccatcggctatgacaacattatccaacatctgaacaatggccgcaagaactgcaaagagtttgaagactttctaaaagaaagggcagcaattgaagagaggtatggcaaagatctgctcaacctctctaggaagaagccgtgtggacagtctgaaatcaacaccctgaagcgggcccttgaagtcttcaagcagcaagtagacaatgtggcacaatgtcacattcagcttgcacagagtttaagagaagaggccaggaagatggaagaattcagggaaaagcaaaaactacaacgaaaaaagacagagctcataatggatgctatccataaacaaaagagcttacaattcaagaaaaccatggatgcaaagaagaactatgagcagaaatgccgggacaaagatgaggcagaacaggccgtcagccggagtgccaacctggtgaacccgaagcaacaagaaaagctttttgtgaaactggcaacttcaaagaccgcagtagaggactcagacaaagcatacatgctgcacatcggcaccctggataaggtccgagaagagtggcagagtgagcacatcaaggcctgcgaggcatttgaggctcaagaatgtgaacgaataaacttcttccggaatgcattgtggttacatgtgaatcagctgtcacaacaatgtgtcaccagtgatgaacacccatcatgtatgagaatttctactcctcccagaagaatgcagtcccagcaggaaaggctacagggcctaacttggcaaggagaggacccctcccaattcctaaaagctcaccagatgatcccaattactctttggttgatgactacagtttgctctatcagtaaaatcaatgaaaccagagctttttccggctagtgcttctgtgatatggaaagggcacccagagcagcaggacctatagccacgttatgtcagcaatgaagactttgaagtgaacccttgctataattttttagagatttaaaatttatggtagacatttaggacaacataagcaagtagagttctgcagttttttgaagtttacaaattgccccattctgaagaattattctttcccagttactcaggttatgaatgaattaggttttcaacatgggaagcatgaaatccacttctggatttggagcatccacttgaggagcagaggtggcagcagaggattctgagccaccaactgcagtagtggctcctttggctttgggcagcctggctgtggagtttccacggcgacacacagcctcagtggtgcaagatttaaaattaccttcctttttggctggaagacttagaagccgcctgatcatactttctcattttacagatgaggaaataaagcctacaagtgtgaaattaatttccttacagttttcctagctgatgagggacagaaccagaactagagcctgagcccaacccacatcactattcttctaacccttcctgaagttgtgatgctcatgctgaaatttaagatgccaaatatttttgccagcactttttcagttgggagaatcaccagggtttaaatgtcagatttatttttatgtggatccctgtgtatgctgaactacagagcatgatgtttaatctaatttaaggagccactgattgtaaaacatgccattattttatgttgcactaagaaggtggggtcgaggagttgccaataaacttgggacagactattgatggccaagcccatctgaatttaagatgctaaagtatgaaaaaaatacatcttagaatcaatgaaataccatattttgattccattcctcaagataattttagagttataaaaccagtcctcaattttgggtcttcacagagaatctttcccttgctagaccccagaattttaaatgcatccgtcttacactttcacaaatatttgggttttcctttttcactcacaaacagcagggaggtcatgtactttttgtacaacacctgtgcactatgagaaaatggtaccttttagttattgacaagttaaaatagcactctcagtttttcagtattacagagagcaaatagtttcctctcctgctctgtgcagtagcttttccagaactatggacaaattgatcagaagaagattgattatttcctcatctttttttcttttttttgagacagagtctctctctgtcccccaggctgaagtgcagcggcatgatctcagctcactgcaacctctgcctcccgggttcaagtgattctcctgcctcagcctcctgagtagctgggattacaggcacccaccaccacacctggctaattttttgtatttttagtaaagacagggttttaccatgttggtcaggctggtctcaaactcctgacctcaggtgatccacctgcctcggcctcccaaagtgctgggattacaggcgtgagccactgcgcccggcctatttccccacctttcgtgtaaggtgctactgaacatgacagcttcttgtcatgacaggaaacttgcatcagttggatatccttttgagaaactgaattttgcaaagggccaaatttccccaaactgaacgggctcaggaaatgttcctttacactcagaacattctattttaagtatattatttattgttggcagttcctcagggatttcccttttctctgtattggtcagtgtagttgatgtaaaaccgttttgtggatggaaaatatttttattttattgctcttttagtttggtaggttaaataaaggttcttggtaatttggga

SEQ ID NO: 16778 - DNA, 3000 bp, Homo sapiens
  ENST00000409746
agtggcagtcaggcctccccgctctgtgctacctgcggcccggctctcctccgcgcccccactcgcgctgcgatgacgcgctcactgttcaagggaaacttttggagtgcagacatcctcagcaccatcggctatgacaacattatccaacatctgaacaatggccgcaagaactgcaaagagtttgaagactttctaaaagaaagggcagcaattgaagagaggtatggcaaagatctgctcaacctctctaggaagaagccgtgtggacagtctgaaatcaacaccctgaagcgggcccttgaagtcttcaagcagcaagtagacaatgtggcacaatgtcacattcagcttgcacagagtttaagagaagaggccaggaagatggaagaattcagggaaaagcaaaaactacaacgaaaaaagacagagctcataatggatgctatccataaacaaaagagcttacaattcaagaaaaccatggatgcaaagaagaactatgagcagaaatgccgggacaaagatgaggcagaacaggccgtcagccggagtgccaacctggtgaacccgaagcaacaagaaaagctttttgtgaaactggcaacttcaaagaccgcagtagaggactcagacaaagcatacatgctgcacatcggcaccctggataaggtccgagaagagtggcagagtgagcacatcaaggcctgcgaggcatttgaggctcaagaatgtgaacgaataaacttcttccggaatgcattgtggttacatgtgaatcagctgtcacaacaatgtgtcaccagtgatgaaatgtacgaacaagtccgaaagagtttagaaatgtgcagcattcagagggacattgaatactttgtgaatcaacgcaaaactggacagattccaccagcacccatcatgtatgagaatttctactcctcccagaagaatgcagtcccagcaggaaaggctacagggcctaacttggcaaggagaggacccctcccaattcctaaaagctcaccagatgatcccaattactctttggttgatgactacagtttgctctatcagtaaaatcaatgaaaccagagctttttccggctagtgcttctgtgatatggaaagggcacccagagcagcaggacctatagccacgttatgtcagcaatgaagactttgaagtgaacccttgctataattttttagagatttaaaatttatggtagacatttaggacaacataagcaagtagagttctgcagttttttgaagtttacaaattgccccattctgaagaattattctttcccagttactcaggttatgaatgaattaggttttcaacatgggaagcatgaaatccacttctggatttggagcatccacttgaggagcagaggtggcagcagaggattctgagccaccaactgcagtagtggctcctttggctttgggcagcctggctgtggagtttccacggcgacacacagcctcagtggtgcaagatttaaaattaccttcctttttggctggaagacttagaagccgcctgatcatactttctcattttacagatgaggaaataaagcctacaagtgtgaaattaatttccttacagttttcctagctgatgagggacagaaccagaactagagcctgagcccaacccacatcactattcttctaacccttcctgaagttgtgatgctcatgctgaaatttaagatgccaaatatttttgccagcactttttcagttgggagaatcaccagggtttaaatgtcagatttatttttatgtggatccctgtgtatgctgaactacagagcatgatgtttaatctaatttaaggagccactgattgtaaaacatgccattattttatgttgcactaagaaggtggggtcgaggagttgccaataaacttgggacagactattgatggccaagcccatctgaatttaagatgctaaagtatgaaaaaaatacatcttagaatcaatgaaataccatattttgattccattcctcaagataattttagagttataaaaccagtcctcaattttgggtcttcacagagaatctttcccttgctagaccccagaattttaaatgcatccgtcttacactttcacaaatatttgggttttcctttttcactcacaaacagcagggaggtcatgtactttttgtacaacacctgtgcactatgagaaaatggtaccttttagttattgacaagttaaaatagcactctcagtttttcagtattacagagagcaaatagtttcctctcctgctctgtgcagtagcttttccagaactatggacaaattgatcagaagaagattgattatttcctcatctttttttcttttttttgagacagagtctctctctgtcccccaggctgaagtgcagcggcatgatctcagctcactgcaacctctgcctcccgggttcaagtgattctcctgcctcagcctcctgagtagctgggattacaggcacccaccaccacacctggctaattttttgtatttttagtaaagacagggttttaccatgttggtcaggctggtctcaaactcctgacctcaggtgatccacctgcctcggcctcccaaagtgctgggattacaggcgtgagccactgcgcccggcctatttccccacctttcgtgtaaggtgctactgaacatgacagcttcttgtcatgacaggaaacttgcatcagttggatatccttttgagaaactgaattttgcaaagggccaaatttccccaaactgaacgggctcaggaaatgttcctttacactcagaacattctattttaagtatattatttattgttggcagttcctcagggatttcccttttctctgtattggtcagtgtagttgatgtaaaaccgttttgtggatggaaaatatttttattttattgctcttttagtttggtaggttaaataaaggttcttggtaatttggga

SEQ ID NO: 16779 - DNA, 1023 bp, Homo sapiens
  ENST00000588801
tttctggttgcagggctagctagatacctggaattttccttgaaggaactgaaacatgttctttcatctccagggtgggggtggagaagcctgacaggctcctaagtgggtccctgcgccatctcaaaagtgcagacatcctcagcaccatcggctatgacaacattatccaacatctgaacaatggccgcaagaactgcaaagagtttgaagactttctaaaagaaagggcagcaattgaagagaggtatggcaaagatctgctcaacctctctaggaagaagccgtgtggacagtctgaaatcaacaccctgaagcgggcccttgaagtcttcaagcagcaagtagacaatgtggcacaatgtcacattcagcttgcacagagtttaagagaagaggccaggaagatggaagaattcagggaaaagcaaaaactacaacgaaaaaagacagagctcataatggatgctatccataaacaaaagagcttacaattcaagaaaaccatggatgcaaagaagaactatgagcagaaatgccgggacaaagatgaggcagaacaggccgtcagccggagtgccaacctggtgaacccgaagcaacaagaaaagctttttgtgaaactggcaacttcaaagaccgcagtagaggactcagactattgatggccaagcccatctgaatttaagatgctaaagtatgaaaaaaatacatcttagaatcaatgaaataccatattttgattccattcctcaagataattttagagttataaaaccagtcctcaattttgggtcttcacagagaatctttcccttgctagaccccagaattttaaatgcatccgtcttacactttcacaaatatttgggttttcctttttcactcacaaacagcagggaggtcatgtactttttgtacaacacctgtgcactatgagaaaatggtaccttttagttattgacaagttaaaatagcactctcagtttttcagtattacagagagcaaatagtttcctctcc

SEQ ID NO: 16780 - DNA, 515 bp, Homo sapiens
  ENST00000593086
ctcagttagaacattggtatctgggatcatcattactttttaccctcagaactatttccaagcctgtttgtgttactgtgatattaggatttgtttgcattctttgtgatatgagtttatgagtttcctcagtggtgggggagaagcattctaaattggacaataagtttacagataactgaaggttgacactgtttcttaagtcacagctagccaaaatgaatggtccttttccttgcatatctatgtacacgtagctatttttctgtaggcatttgaggctcaagaatgtgaacgaataaacttcttccggaatgcattgtggttacatgtgaatcagctgtcacaacaatgtgtcaccagtgatgaaatgtacgaacaagtccgaaagagtttagaaatgtgcagcattcagagggacattgaatactttgtgaatcaacgcaaaactggacagattccaccagcacccatcatgtatgagaatttctactcctcccagaagaatgcagtcc

SEQ ID NO: 16781 - DNA, 569 bp, Homo sapiens
  ENST00000591729
atgagaaaaggatcataactcctatcctatcattggagaaaatgaaacacaaagagttttggcatgttgctctccccaaatgaacagtgaagaatttcttgtgcctgggattgaggaaactggacttaagaagtcttggtcttttgctgtctctctagctcatgggcaaaaattggtctgtagtttctaagttaagatatgggcagagagaagcatgcaaaggcattataataagattgtgcagagaatttccagaactgaaattatatatgtgcttgttttttttagcaccctgaagcgggcccttgaagtcttcaagcagcaagtagacaatgtggcacaatgtcacattcagcttgcacagagtttaagagaagaggccaggaagatggaagaattcagggaaaagcaaaaactacaacgaaaaaagacagagctcataatggatgctatccataaacaaaagagcttacaattcaagaaaaccatggatgcaaagaagaactatgagcagaaatgccgggacaaagatgaggcagaacaggccgtcagccggagtgccaacctgg

SEQ ID NO: 16782 - DNA, 859 bp, Homo sapiens
  ENST00000587042
ggagccgcgggcagtggcagtcaggcctccccgctctgtgctacctgcggcccggctctcctccgcgcccccactcgcgctgcgatgacgcgctcactgttcaagggaaacttttggagtgcagacatcctcagcaccatcggctatgacaacattatccaacatctgaacaatggccgcaagaactgcaaagagtttgaagactttctaaaagaaagggcagcaattgaagagaggtatggcaaagatctgctcaacctctctaggaagaagccgtgtggacagtctgaaatcaacaccctgaagcgggcccttgaagtcttcaagcagcaagtagacaatgtggcacaatgtcacattcagcttgcacagagtttaagagaagaggccaggaagatggaagaattcagggaaaagcaaaaactacaacgaaaaaaggttggatttgcatacgtgttaaggtgtttcctttcctcctatagaaaaccgcaggcttgtttgttcattatactcctcagctcagctcccaccatcatgtaatcatgacctgagaaattacttactggagtccccacatggggactcagtccagatgggtatatgcatttctacaccccaggccagttgtccttttttaaagttcacataggattcagaggtccagcttgcattcctcttcaggtctgctgccgctattcagactatgaatggaaaggggaaccctctgaattcaatagactctagcacatcccagctggacggctcccaaaaccacactcctcatcctggacaaggcaataggggaagggagaagtagtggaagagactcccgctccccctgaagaccataatgtagtcc

SEQ ID NO: 16783 - DNA, 1110 bp, Homo sapiens
  ENST00000438067
ctttgacttcattgtaaggtacttctttgcggcgctgacagtgctcacgctcctgggcctcctccatggactcgtgctgctgcctgtgctgctgtccatcctgggcccgccgccagaggtgatacagatgtacaaggaaagcccagagatcctgagtccaccagctccacagggaggcgggcttagagtggggagtttgcaagtgaacattagctattggaaggagcttctctggtgccaggacctgaggcccgaggagatctagcctctgcctcccaccccagcaccccctcatcagacacacggagcgccactgtctggacaggctgaattggtcttcgggtccctaatttctcatacgccattccctctgcctagaacactttctcacctccccttgatgtgaccccatatcacccttcgaggtgaattggatcggatgccatctcctccaggaggggtggggtcgtgcctcctgtgaggtcccagtgcccctgagtgtctgtgcccgtctgtttccccgtccctctctctaagcccggaggcttactgcgggtaaggacggcgggacaggaccttaacccctgggacgaacaccagctccgcaaaggactccgcacccggcgccgcccacggggtgcgggtcccaggaggaccagcagagaggagcataggagagcaaaggagatcagtgacccatggcttccccggtggcgcggaacagcccggagccgcctgtgatttgcatacccatggtgcaccacgaaaagataccctcaagatgcttgcactccctctgtgcgcgcatttctgcactgttttagagcatgatgcctcttacacgcatctgtgtgcataaactacatatagggagtgcgtaccacgcaggcatccaacaaccataagtgtgttaagtgttagttctccctgcgaggttcgaagcggaagtcacgaatatactcgggtttctcttcaaagcgcataaatctttcgccttttactaaagatttccgtggagagaaagttgtgagtttttattcaattttttgaggcctcttatttcctgaggctacatttttaagtattaaaagttaggcaactacaaccaag

SEQ ID NO: 16784 - DNA, 4225 bp, Homo sapiens
  ENST00000372192
cccacgcccgcgccttggcggccccactgaatccctacgcggggcccagcggtaccgggagaccgggctagcctatgggagcgcccagataacgcgggttgggggcgcccgcgccccccatccccgccagcatgactcgatcgccgcccctcagagagctgcccccgagttacacacccccagctcgaaccgcagcaccccagatcctagctgggagcctgaaggctccactctggcttcgtgcttacttccagggcctgctcttctctctgggatgcgggatccagagacattgtggcaaagtgctctttctgggactgttggcctttggggccctggcattaggtctccgcatggccattattgagacaaacttggaacagctctgggtagaagtgggcagccgggtgagccaggagctgcattacaccaaggagaagctgggggaggaggctgcatacacctctcagatgctgatacagaccgcacgccaggagggagagaacatcctcacacccgaagcacttggcctccacctccaggcagccctcactgccagtaaagtccaagtatcactctatgggaagtcctgggatttgaacaaaatctgctacaagtcaggagttccccttattgaaaatggaatgattgagcggatgattgagaagctgtttccgtgcgtgatcctcacccccctcgactgcttctgggagggagccaaactccaagggggctccgcctacctgcccggccgcccggatatccagtggaccaacctggatccagagcagctgctggaggagctgggtccctttgcctcccttgagggcttccgggagctgctagacaaggcacaggtgggccaggcctacgtggggcggccctgtctgcaccctgatgacctccactgcccacctagtgcccccaaccatcacagcaggcaggctcccaatgtggctcacgagctgagtgggggctgccatggcttctcccacaaattcatgcactggcaggaggaattgctgctgggaggcatggccagagacccccaaggagagctgctgagggcagaggccctgcagagcaccttcttgctgatgagtccccgccagctgtacgagcatttccggggtgactatcagacacatgacattggctggagtgaggagcaggccagcacagtgctacaagcctggcagcggcgctttgtgcagctggcccaggaggccctgcctgagaacgcttcccagcagatccatgccttctcctccaccaccctggatgacatcctgcatgcgttctctgaagtcagtgctgcccgtgtggtgggaggctatctgctcatgctggcctatgcctgtgtgaccatgctgcggtgggactgcgcccagtcccagggttccgtgggccttgccggggtactgctggtggccctggcggtggcctcaggccttgggctctgtgccctgctcggcatcaccttcaatgctgccactacccaggtgctgcccttcttggctctgggaatcggcgtggatgacgtattcctgctggcgcatgccttcacagaggctctgcctggcacccctctccaggagcgcatgggcgagtgtctgcagcgcacgggcaccagtgtcgtactcacatccatcaacaacatggccgccttcctcatggctgccctcgttcccatccctgcgctgcgagccttctccctacaggcggccatagtggttggctgcacctttgtagccgtgatgcttgtcttcccagccatcctcagcctggacctacggcggcgccactgccagcgccttgatgtgctctgctgcttctccagtccctgctctgctcaggtgattcagatcctgccccaggagctgggggacgggacagtaccagtgggcattgcccacctcactgccacagttcaagcctttacccactgtgaagccagcagccagcatgtggtcaccatcctgcctccccaagcccacctggtgcccccaccttctgacccactgggctctgagctcttcagccctggagggtccacacgggaccttctaggccaggaggaggagacaaggcagaaggcagcctgcaagtccctgccctgtgcccgctggaatcttgcccatttcgcccgctatcagtttgccccgttgctgctccagtcacatgctaaggccatcgtgctggtgctctttggtgctcttctgggcctgagcctctacggagccaccttggtgcaagacggcctggccctgacggatgtggtgcctcggggcaccaaggagcatgccttcctgagcgcccagctcaggtacttctccctgtacgaggtggccctggtgacccagggtggctttgactacgcccactcccaacgcgccctctttgatctgcaccagcgcttcagttccctcaaggcggtgctgcccccaccggccacccaggcaccccgcacctggctgcactattaccgcaactggctacagggaatccaggctgcctttgaccaggactgggcttctgggcgcatcacccgccactcgtaccgcaatggctctgaggatggggccctggcctacaagctgctcatccagactggagacgcccaggagcctctggatttcagccagctgaccacaaggaagctggtggacagagagggactgattccacccgagctcttctacatggggctgaccgtgtgggtgagcagtgaccccctgggtctggcagcctcacaggccaacttctaccccccacctcctgaatggctgcacgacaaatacgacaccacgggggagaaccttcgcatcccgccagctcagcccttggagtttgcccagttccccttcctgctgcgtggcctccagaagactgcagactttgtggaggccatcgagggggcccgggcagcatgcgcagaggccggccaggctggggtgcacgcctaccccagcggctcccccttcctcttctgggaacagtatctgggcctgcggcgctgcttcctgctggccgtctgcatcctgctggtgtgcactttcctcgtctgtgctctgctgctcctcaacccctggacggctggcctcatagtgctggtcctggcgatgatgacagtggaactctttggtatcatgggtttcctgggcatcaagctgagtgccatccccgtggtgatccttgtggcctctgtaggcattggcgttgagttcacagtccacgtggctctgggcttcctgaccacccagggcagccggaacctgcgggccgcccatgcccttgagcacacatttgcccccgtgaccgatggggccatctccacattgctgggtctgctcatgcttgctggttcccactttgacttcattgtaaggtacttctttgcggcgctgacagtgctcacgctcctgggcctcctccatggactcgtgctgctgcctgtgctgctgtccatcctgggcccgccgccagaggtgatacagatgtacaaggaaagcccagagatcctgagtccaccagctccacagggaggcgggcttaggtggggggcatcctcctccctgccccagagctttgccagagtgactacctccatgaccgtggccatccacccaccccccctgcctggtgcctacatccatccagcccctgatgagcccccttggtcccctgctgccactagctctggcaacctcagttccaggggaccaggtccagccactgggtgaaagagcagctgaagcacagagaccatgtgtggggcgtgtggggtcactgggaagcactgggtctggtgttagacgcaggatggacccctggagggccctgctgctgctgcatcccctctcccgacccagctgtcatgggcctccctgatatccatacagaacagccaccgatttgcacatccaggcctgtgtgagcctgtatctgtgtcacttgagagtgaaagctggcacttggggctgcagtgcagccctgtcccccttcccaccccacaccactgcctgcccagctgaccaagcctgagggaccctccagcacccttccgtctggtgactcctgggcaggctctccatatccctgcccacctcctaccacatccattatttatatgaaaatgtctatttttgtagtatacatacatgttagctatgatgaaagttttattttttaaagaatgaaatatattctatgtgaactaatctca

SEQ ID NO: 16785 - DNA, 4298 bp, Homo sapiens
  ENST00000447098
atccccgccagcatgactcgatcgccgcccctcagagagctgcccccgagttacacacccccagctcgaaccgcagcaccccagatcctagctgggagcctgaaggctccactctggcttcgtgcttacttccagggcctgctcttctctctgggatgcgggatccagagacattgtggcaaagtgctctttctgggactgttggcctttggggccctggcattaggtctccgcatggccattattgagacaaacttggaacagctctgggtagaagtgggcagccgggtgagccaggagctgcattacaccaaggagaagctgggggaggaggctgcatacacctctcagatgctgatacagaccgcacgccaggagggagagaacatcctcacacccgaagcacttggcctccacctccaggcagccctcactgccagtaaagtccaagtatcactctatgggaagtcctgggatttgaacaaaatctgctacaagtcaggagttccccttattgaaaatggaatgattgagcggatgattgagaagctgtttccgtgcgtgatcctcacccccctcgactgcttctgggagggagccaaactccaagggggctccgcctacctgcccggccgcccggatatccagtggaccaacctggatccagagcagctgctggaggagctgggtccctttgcctcccttgagggcttccgggagctgctagacaaggcacaggtgggccaggcctacgtggggcggccctgtctgcaccctgatgacctccactgcccacctagtgcccccaaccatcacagcaggcaggctcccaatgtggctcacgagctgagtgggggctgccatggcttctcccacaaattcatgcactggcaggaggaattgctgctgggaggcatggccagagacccccaaggagagctgctgagggcagaggccctgcagagcaccttcttgctgatgagtccccgccagctgtacgagcatttccggggtgactatcagacacatgacattggctggagtgaggagcaggccagcacagtgctacaagcctggcagcggcgctttgtgcagctggcccaggaggccctgcctgagaacgcttcccagcagatccatgccttctcctccaccaccctggatgacatcctgcatgcgttctctgaagtcagtgctgcccgtgtggtgggaggctatctgctcatgctggcctatgcctgtgtgaccatgctgcggtgggactgcgcccagtcccagggttccgtgggccttgccggggtactgctggtggccctggcggtggcctcaggccttgggctctgtgccctgctcggcatcaccttcaatgctgccactacccaggtgctgcccttcttggctctgggaatcggcgtggatgacgtattcctgctggcgcatgccttcacagaggctctgcctggcacccctctccaggagcgcatgggcgagtgtctgcagcgcacgggcaccagtgtcgtactcacatccatcaacaacatggccgccttcctcatggctgccctcgttcccatccctgcgctgcgagccttctccctacaggcggccatagtggttggctgcacctttgtagccgtgatgcttgtcttcccagccatcctcagcctggacctacggcggcgccactgccagcgccttgatgtgctctgctgcttctccagtccctgctctgctcaggtgattcagatcctgccccaggagctgggggacgggacagtaccagtgggcattgcccacctcactgccacagttcaagcctttacccactgtgaagccagcagccagcatgtggtcaccatcctgcctccccaagcccacctggtgcccccaccttctgacccactgggctctgagctcttcagccctggagggtccacacgggaccttctaggccaggaggaggagacaaggcagaaggcagcctgcaagtccctgccctgtgcccgctggaatcttgcccatttcgcccgctatcagtttgccccgttgctgctccagtcacatgctaaggccatcgtgctggtgctctttggtgctcttctgggcctgagcctctacggagccaccttggtgcaagacggcctggccctgacggatgtggtgcctcggggcaccaaggagcatgccttcctgagcgcccagctcaggtacttctccctgtacgaggtggccctggtgacccagggtggctttgactacgcccactcccaacgcgccctctttgatctgcaccagcgcttcagttccctcaaggcggtgctgcccccaccggccacccaggcaccccgcacctggctgcactattaccgcaactggctacagggaatccaggctgcctttgaccaggactgggcttctgggcgcatcacccgccactcgtaccgcaatggctctgaggatggggccctggcctacaagctgctcatccagactggagacgcccaggagcctctggatttcagccagctgaccacaaggaagctggtggacagagagggactgattccacccgagctcttctacatggggctgaccgtgtgggtgagcagtgaccccctgggtctggcagcctcacaggccaacttctaccccccacctcctgaatggctgcacgacaaatacgacaccacgggggagaaccttcgcatcccgccagctcagcccttggagtttgcccagttccccttcctgctgcgtggcctccagaagactgcagactttgtggaggccatcgagggggcccgggcagcatgcgcagaggccggccaggctggggtgcacgcctaccccagcggctcccccttcctcttctgggaacagtatctgggcctgcggcgctgcttcctgctggccgtctgcatcctgctggtgtgcactttcctcgtctgtgctctgctgctcctcaacccctggacggctggcctcatagtgctggtcctggcgatgatgacagtggaactctttggtatcatgggtttcctgggcatcaagctgagtgccatccccgtggtgatccttgtggcctctgtaggcattggcgttgagttcacagtccacgtggctctgggcttcctgaccacccagggcagccggaacctgcgggccgcccatgcccttgagcacacatttgcccccgtgaccgatggggccatctccacattgctgggtctgctcatgcttgctggttcccactttgacttcattgtaaggtacttctttgcggcgctgacagtgctcacgctcctgggcctcctccatggactcgtgctgctgcctgtgctgctgtccatcctgggcccgccgccagaggtgatacagatgtacaaggaaagcccagagatcctgagtccaccagctccacagggaggcgggcttaggcccgaggagatctagcctctgcctcccaccccagcaccccctcatcagacacacggagcgccactgtctggacaggctgaattggtcttcgggtccctaatttctcatacgccattccctctgcctagaacactttctcacctccccttgatgtgaccccatatcacccttcgaggtgaattggatcggatgccatctcctccaggaggggtggggtcgtgcctcctgtgaggtcccagtgcccctgagtgtctgtgcccgtctgtttccccgtccctctctctaagcccggaggcttactgcgggtaaggacggcgggacaggaccttaacccctgggacgaacaccagctccgcaaaggactccgcacccggcgccgcccacggggtgcgggtcccaggaggaccagcagagaggagcataggagagcaaaggagatcagtgacccatggcttccccggtggcgcggaacagcccggagccgcctgtgatttgcatacccatggtgcaccacgaaaagataccctcaagatgcttgcactccctctgtgcgcgcatttctgcactgttttagagcatgatgcctcttacacgcatctgtgtgcataaactacatatagggagtgcgtaccacgcaggcatccaacaaccataagtgtgttaagtgttagttctccctgcgaggttcgaagcggaagtcacgaatatactcgggtttctcttcaaagcgcataaatctttcgccttttactaaagatttccgtggagagaaagttgtgagtttttattcaattttttgaggcctcttatttcctgaggctacatttttaagtattaaaagttaggcaactacaaccaag

SEQ ID NO: 16786 - DNA, 13714 bp, Homo sapiens
  ENST00000379361
tttggaaggaggcgtgatttccacgttcgagcgtcttcgctccccaccccctctcggcaccagccagtgcgcgccaccacctgagcctggcgagagccgggacgcacgcagtcttcagcctgctcctttaagcctctggagagactcggctctgagcgggtccgcccgacacccgccccctccccccactcctgagaactctttactttttgtttggaaaatcggggccatttctttatttatctctgggtcttcccggaggagggcagagaaggggagagcgagcttggcgggccggaccgggggaggggagcgaagggaggggaggggactgggtgtagcctggaattctccgtcctcgtgttcctgggcgggcgcgcagagtctcctggcgatagcgccgtcgccgctccccgcgccaccccgtcgttggccttgggggtcgggtgagtggggtcatgacgagccgcgggggctgccccgggccccgcccgcgctgagaggggacgcggccgcgcggcgcggagcccccctggcggggaggccgcggggggtggggagggcgcacgcggtagggcggagtgggggcggcgcagaggccgccaagctggggggctctccgggagggcgcggccgcgggcaggagggcgtgtctccggctcgaggggaccctcccgaggcgcggcgcgggactccccgatggtggtgccgcggctccgggagagctcagggtctcgccgccgccgccgtcgccgccgccgcgggcgccgctgccgccgccgccgccgccgccgccgccgccgcccgaacccgcgccgagcgtgcgcctcgccctcctcccgcgcccgctctgctctaggatgctgcggcaggttctgcacaggggcttgaggacgtgtttctcccggctcggccacttcattgccagtcaccctgtcttcttcgcctcggcgccggtgctcatctccatcctgctcggcgccagcttcagccgctaccaggtcgaggagagcgtggagcacctgctggcgccccagcacagcctggccaagatcgagcgcaacctcgttaacagcctcttcccggtcaaccgctccaagcaccgtctctactcggacctgcagacccccgggcgctacggccgggtcatcgtcacctccttccagaaagccaacatgctggaccagcatcacaccgacctgatcttaaagttgcatgctgctgtcaccaagatccaggttccaaggcctggttttaattacacgtttgcccatatatgtatcctgaataatgataagacttgcatcgtggatgacatagtgcacgtcctggaagagctaaagaatgctcgggccaccaatcggaccaattttgctatcacatacccaatcactcacttaaaggacgggagggctgtgtacaatgggcaccagcttgggggcgtcactgtgcacagcaaagaccgggtgaaatctgcagaggccatccagctcacctactacctgcagtcaatcaacagtctcaatgacatggtggctgagaggtgggagtccagcttctgcgacactgtcagactgtttcagaaatccaacagcaaagtcaaaatgtacccttacacgtcctcctcactgagggaagatttccagaagaccagccgcgtatcagaacgttacctggtcaccagcctgattctggtggttaccatggccatcctgtgttgctctatgcaggactgcgtccgcagcaaaccctggctaggcctgctcggattggtgaccataagcctggccactctcactgcagccgggatcatcaatcttactggtgggaaatataattccaccttcctgggagtccctttcgtcatgctaggtcatggattatatgggacttttgaaatgttatcctcctggaggaaaactagagaagaccaacatgttaaagagagaactgcagcagtctatgcagactccatgctctccttttctctcaccactgccatgtacctggtcacctttggcataggggccagccctttcacgaacattgaggcagccaggattttctgctgcaattcctgtattgcaatcttcttcaactacctctatgtactctcgttttatggttccagcctagtgttcactggctacatagaaaacaattaccagcatagtatcttctgtagaaaagtcccaaagcctgaggcattgcaggagaagccggcatggtacaggtttctcctgacggccagattcagtgaggacacagctgaaggcgaggaagcgaacacttacgagagtcacctattggtatgtttcctcaaacgctattactgtgactggataaccaacacctatgtcaagccttttgtagttctcttttaccttatttatatttcctttgccttaatgggctatctgcaggtcagtgaagggtcagaccttagtaacattgtagcaaccgcgacacaaaccattgagtacactactgcccagcaaaagtacttcagcaactacagtcctgtgattgggttttacatatatgagtctatagaatactggaacactagtgtccaagaagatgttctagaatacaccaaggggtttgtgcggatatcctggtttgagagctatttaaattaccttcggaaactcaatgtatccactggcttgcctaagaaaaatttcacagacatgttgaggaattcctttctgaaagcccctcaattttcacattttcaagaggacatcatcttctctaaaaaatacaatgatgaggtcgatgtagtggcctccagaatgtttttggtggccaagaccatggaaacaaacagagaagaactctatgatctcttggaaaccctgaggagactttctgtcacctccaaggtgaagttcatcgtcttcaatccgtcctttgtatacatggatcgatatgcctcctctctgggagcccccctgcacaactcctgcatcagtgctttgttcctgctcttcttctcggcattcctggtggcagattcactgattaacgtctggatcactctcacagttgtgtccgtggagtttggagtgataggtttcatgacattatggaaagtagaactggactgcatttctgtgctatgcttaatttatggaattaattacacaattgacaattgtgctccaatgttatccacatttgttctgggcaaggatttcacaagaactaaatgggtaaaaaatgccctggaagtgcatggggtagctattttacagagttacctctgctatattgttggtctgattcctcttgcagctgtgccttcaaatctgacctgtacactgttcaggtgcttgtttttaatagcatttgtcaccttctttcactgctttgccattttacctgtgatactgactttcctgccaccctctaagaaaaaaaggaaagagaagaaaaatcctgagaaccgggaggaaattgagtgtgtagaaatggtagatatcgatagtacccgtgtggttgaccaaattacaacagtgtgataatgtctgcttggcatattttcaccttaggtcttatcaagaccaaagagattatgttaatgaaacaattaaattcaaagttcttcccttttttaaagataggaaacaggcattgccaaaaaaaaaaaaaaaaaaaaaaggaaaggacagtggggagaaatgggcctggcatattttcagtctttaaaacaaaggagttgttatgagaattcacacacacatagacacacacacacacacacacacacacacacacacacacacaccctgggagacctatagtctcttaaactaagatcaagtagaagaaagcttattaacaagcaggatcctgccttatccaaactgcagatgttgctggcattgtgacaaaacccactgattgaaaggtcaactgccaaggcagaaacacctttaagcattgttcaaacaataaggcttccagaacttctgtagagcagtagctccagtcatggtctgtggtttgaggttttagctgtctcacctagctccctaacactgaaggagatacttgtgaaagttctgaccagcaaaagcaagccagagccttggaaactgatatgtggtagagtggccatcactcatggactaaaattgattcaccgctaaatttacccaggtgaagcagtttcgttgtctagaatgaaattatcatattccgccattggtatgcctttaacatttgtatagtttggtttgcttaaaacaccttaaaaccaatgacagctccagcactgcagaattggtgtgattctactttggaatagcttgtcacttgtcaccaaatgggtctgctttattagttacagctcttggcaggaggatccagggacccaaaaccacagggccaaacccaaatacctggcatgatggagcaaaagcaggtgtctacttggacccagatatagtgtctccattttaacaacaacaacaaaatagccagctggtacagctgtttgcattggccctacatgcattttttgcatggatatccagaaacatctgcccacacaaaactgcggggaaaaaaaatgaacactgaaatagttatttgctgttgcttccaacttgtagtgccagtctgcctttgctgtgaaacacacctgctcagagacagagaggggaagaagatctttggtaagtctaagtcctgacgctgagaagctttgtaaaagtgcagggagataaagggccaaaagggagatagatggaaaacactggaaaaagtattcactgatacaaatctatcaatgatggcagtccaattctcttgctaaagtggctgcacctcaccttgctggtcccccccacaccttttttgatgtccttctgcgtcatcatagcaaggcccttctgtaaattaacaagcctagatatttatactcttgacttccagtatctacagaagaatggttcatagatctaaacagaaatggtttagatctaaaaaggctgtatacgttgcccaggcccctgcatttctttaaatttataaaaatgaagctaaaacctggttacatttgaagcaaatatctacagtatttttcccttttagagatgtagcttccttagacatctgtagtggtaagcatttcccaaaagcatcttacctttctgaaccttagcagacatactgtgcagcttacctatcttctgcagaggaggaaactgagacctaggagaataaagtgactcactcaggtcacaccactaaagggttttcatcatttcagcatacctaagacagggcagtccaattttcagtattctcataagatggctattactcctctcaaaatgcatttccaaagtaggaacataggacttcgttggccacagggcagacatttttttagtgtctggaattaaaatgtttgaggtttaggtttgccattgtctttccaaaaggccaaataattcagatgtaaccacaccaagtgcaaacctgtgctttctatttcacgtactgttgtccatacagttctaaatacatgtgcaggggattgtagctaatgcattacacagtcgttcagtcttctctgcagacacactaagtgatcataccaacgtgttatacactcaactagaagataataagctttaatctgagggcaagtacagtcctgacaaaagggcaagtttgcataatagatcttcgatcaattctctctccaaggggcccgcaactaggctattattcataaaacacaactgaagaggggattggttttactgttaaatcatgtgttgctaaatcattttctgaacagtgtgttctaaatcagtcattgatttagtgtcagccacgtggagcacctcggcttaaagcagctccacaaaacctgacacaacacacacaccaattaaatggattttgttgagaatttaatcattcaatttggtcaaccagaatgacttcctgtggaactctgttttatgacagataatagttttccaacttgattgagtctctgtataccctgggatattgtattttttaatgaagggcattttcaaacttgtcaacttctcttttcagcacttgaaatgaaggcttatggaattctgactgtgaaatgaatttttctattgggagattatgcatgccaagatttattatttattgttagataattattatttatttgttaatactgattattgattattgctctgctgcattggtttagccccgctatggagaagacactttagaagtaactcagaatcacatccccataaaatctaagtctttacttcatcaagttttactttttgaattgctataaagacggaaaaattgatccctgcaaacacttgaagaagctgtgttttttttctttcaattaattccaaccaagacattaacgtccactttaccaaagaaacttacttggttggtttttagttggtgtttgttgtttgtttaccaaagaaaatattcgattcatcaaaaatattgctcctggtcaactaaaaaactgtgatactgggacttttttggccattcataaggaaaatttttaaaagtcaaggtaagggtgatattctctcatttagtggaagaagaagatgtcaattcacagggaatgtggtgttcgcaagaaagaaaatgatacttgaaatagggcattattgtttagcctacagcaacatttcaacaagcagcatcagggctcctcaggttaaaagaagtacagtttgtttcagagaaaaaggaagacaaaccctcgtgaaatgtttctccattgttccagctcataagttttactttgttttgggttttggagtttttagtttctttgatgtttgttttgctttaatttggtttgtggtttgtgtttgcttgtgtttgcttctgcctttcctaccttctgccttttactccctcagttttcagtcagaagtgtgataatcagatgccatcctccatggccacgcttatgtatgcaatataccgctccaaatgaggaccttggtaacccttgaccctttaattctaactaaccatcacccaatcgtaagtggcattatgggaccatgataccacttttctccagtgtcaatgacagagctcagctgtgtccatcacaagaaaaggtggaatgggcagctgtcttgggggtgtggcaagaggcagaacctcttggacacaaatgttatcttcctcataatggctttattcttttggatcctattaaagtacccctgtagcttatagtagtgtttgacctctgtgactctgttttctcatctgtaaaatggggataatatcagtaaatgtctttaaattcagcaaatacttatcgagtgccaaatatcgcccagatactgttcgagaggctggggacacaacagtcaacaaatcagattttttaaaatctgctcttgtagagtctacctttgagtgacattgcaggtatattgtggggattgaatgagatgagagatgacatttggaaagcactcttggaaaggcctggcaaagaaaagagactcaagacattatttgtaattcagcaatctcgcacagtagcattagggctcgggatgtaaagctactgagaagtagatttgagcctgagaattagggctacaaatacaatgagttgccacagaaggtagttaattaccagtcattttaggacatcaaaatgaagctgatcaccacatagtggggccactgtaaaggggctgcaagtcctggatgttggcatcatactatgatctttgaaaaaaacagatacaggcacttgcttttggggatggggaagggacaccactgattactgaataactgtggctggcttgtctgagggaatgtaaacattcccttgaggtaatttgcttttaattttgtgtaaaaagcaccaggtatttagagacataaagttcccgttttttaaaagaatagtaaatctgcaatacaaagaaaaatattaagttagtggattcgctggcaaagaactaagaatggctgcagccaacacactgcagagttcctccctgtggtggttacaactgttatttctgtttcatgccagtccaggagaaagcaaagaggaaagtggatgagctataatccgttcacctgaataggcagtgccaggatgtcccccccagcttgcctctcacccgccccgctgctgcccagctgatttgtttgaagtcctctttgatatctatgagagcaccgtggaaggaagaagaagggaggcgaccggagagctatggcctctgtgcagatttttgagttagattaaaattagtaccacctgattaggagcctacctggtgaggaaaaaagccttcttttcaaagtacaaaaaaaagcgatgtgtaccaaggagaaaaccagcagagaaagcttggtggaagaagtgatgttcttgtggaatgtgccagcagcttctccttccagaatgctgacaccagatgaatctttggttagaattaagcctacccctttgtttttcacatgagaaaactgaaccctcgagtaatgaaattatattcacagagctaattagaaacaggagactataattgaaatctagtttttagcctcaattctttctccattttgccactttactgccaaattctattcatctaaattattggggtcttaacctgggggccaaatgagttcatgggaggggtctctgagtttcctacaattaagttacatgcaaaaatgtgtgtatatgttcaacatgtgcattttcctaaactgagggctcagattccaaaagaggtctatgaccgaaaaagggtgaagaaccactgtcctaaattaatacagacctcattgggagtgtgatcctggtgtcctcattttggctaatgagcaatcaagaacttttgaactatcttttctctaaggatccaaaaatgcttcaaaatattggtttcttcatcccaagccaagtgcctacttctattcatttattcttcattcattctttcattcattcatttctttattctgcaaatgtattttcagtgccaattcatgttctagcagcagctaaatatgccctccacagcaggaccaggaaaggagccctctgtactgtgctcttgttggcaagaggaacaccaggttgctaccacattctcactgttgcaacaaattatatatagcctcaaattttcagtaaccatcccacacacacatacacacataaaggcagcagccaacaaagccaacatatagaagtgtgccctgtcaaagaaccaggaagagcagcctatttccaggttatatacagtgatatgctgtttacaactgcataccacatccttagaaggcctgctcccaaatgagccctactctgagatgtctacaccaggcatgctttcacacacgtgcagtaccctactctcaaaacaagtatggagagaataagtctcattcatctcgttaatatttttagtgggcaaagaagcaaccgtggccatggacagatgggtgcatttaaggacaggtgtggccgggcacagtggctcaagcctgtaatcccagcactttgggaggcggaggcgggcagatcacgaggttaagagattgagaccatcctggccagcatggtgaaaccccgcctctactaaaaaatacaaaaaaattagctgggcgtggtggcacgtgcctgtagtcccagctactcaggaggcaggagaatcccttgaacccgggaggtagaagttgcagtgagccgagatttcaccactgccctccagactggcaacagagtgagacttcgtctcaaaaaaataaaggacaagtgtgttttatacacaaatatgcagaagcccagttctcttgactccaagtcagaagctagataaaatagaggttgctgggggaagttggaaaataaatgactatactgtacttgttggctctgctgctgctgatataacttcaggcacaacggaagccgcctcggttggcctatgggaagggctgggtgaatcactgcttggccttgcatgaagcacaaaggacacaccaatggctgatcagtggcccttccatcatcttctgcccagccatgataaggaaagccttctattgagatggaggaatattagctcaactttgtagcatctgatgtaaagtttgaggggtttgtcttttttgtttgtttgtttgtttttttttgagatggagtctcactctgtcacccaggctggagtgcagtggcgccatctcagctcactgcaagctccacctcccaggttcacgacattctcctgcctcagcctcctgagtagctgggactacaggtgcccgccaccgcgcccggctaattgtgtgtgtgtgtgtgtgtgtgtgtgtgtgtgtgtttagtagagatggggtttcaccgtgttacccatgatagtctcgatctcctaacctcgtgatccacccgcctcggcctcccaaagtgctgggattacaggcgtgagccaccgtgcccggcaagggctttgttcattaggatcaacaaagtgctttgtctaattcctgcaaaatggcaaagacccagcccatttccattactcattccaggctcatgctcaggaaaactaataacgttctctttgacaaaacaatttccttaattttctaggatgaatcttgaacatgtttagctcagcctttcagatatttattctttaaattaccatcctgtcaaaattgcctttacgcactgatccagaatcaccaaggcagttgccacgatgcctcccaggactgtgggtgactgggcaaactggtaatgacccgttggctctgcttcacacacacacatacacattgacacacataaatgtacacatgcatatatgtgtgtacaacacaactataaaacatagaaacatatacctgtacatatgcacatgcttacatacacacatatcacagatgtgcatgcacacatacacatgcacaccaccttttacaatatgcctgacacatttgaggcacattaaaatgccttggcaggcccagccctatagttctgtaaggtttggcaggccaaaggcttcggatgtctgcaggataccattgaaaaaatgttatcttccccttctatatgtttcttatgcacgagcacagctaagagcagccaaatagtaagctttaaagaaaagaaacctggaaaagtgaatgtgccttgcaatttaaaaattgctaacagtttcacagtgggaaaattgcatttgttggaattttccaagtcataagcaagaagaatagcatagacccaaaacgacagagatctcttccaaggtatggaattgtggaaatttatttagaatatttgcttggtgatccagagaagggggaaagaagtggtgaggaagaatatatggggtgatccctccaaattgccaactcctcgtcttaggaagaagtgggcagtttccattgatccctagcatcagtttgacgggaaaaccggtgcatttcatcaacctcaaggaaaggaagtgccatgcatggaggcctggtgataggcaacatccatttagaagaacagtcacacaagcaacagaagaactatccaagactagaagcttagaagcttataccaaactctctgtctctctctctctctctcacacacacacacacagagtggatgggaggggacattaagaggaaccctagtgcagttcccccaaaaaaccttggcatagagtataacagggaaaaagtaattactgggaagctgaaaacaatcaaatatgtgaggaatgactgaatatgagctgaggataatgtaaattgttctggattgtctataagataaagatacagagcctgaatctatgtttttctgaataaagagaccccatattctcttttgaattattgacctataattcctcttcagcagctttgaatacactcaagttctcttcctattgtttatgatcccataatacaaccacccactatttgttgtggtttacaatccagcttagaacccttgagcaaaattattgaattattgaatgctaggcccaaacaaaagaaatttcagcttggttttagtaatttcttgatcaaacttctctcattcctctaaatgtacaaaggtttcaaagttgtaaaaaatatgtctacatagccaatgctcttagtatttttaacagcaaagataatctctgccaataattattaatgacaaaatagtgataactgttcaatgttgctttaacagtccaattgtagtaggtgagaaaacaaaaaagaagagaagctatgttgaatatttagtaatgttggaaaagatcctcaccctagacataaaatagtttaaacatttaaacatggcccctctcttattgtcattgctagtgaaagaagttcctgaaattgcatattacattgtaaagttttgggctaaatcacaatacatttttaagttgcttccatggcaatagatcgtaagaccacagcttgtcaaagtaaccactaattcagtattcagaaaccttatcatctgttcctccaaaaagaccccatagttaatgttgtgtttcccagtattttagttgggtttcttcacacttaggcaagtgggtgattctggtcataataaactattttcaaactaggaaaaagtatccaaatgctagagcacataatgagttcagcttggtcagttttgagacagataagcataaaaccctactagaaaaaaataatagtcaaacctaaagctttaaaaaatgtgagtcacatcacttttctccaggaaaggcagaacgtgctcagggtggaatttaatcaaaaatgtacccagaacaatttcccacaaagagctgtaatactttgcagcaaggggcattaataaactctaatttttaccgaaagtcaagagacacacagatcttttttggtaccctctacatcatcatagcaaggcccttctgaacattaacaagcctagatgtttctactgcttatttgcagtatctacaggggaatggttcgtggatataaacagaaatgttttatctgaagaggctgtgtatgccaccccagacccctgcatttcttaatatctataaaaatatgactaaacttgttacatttgaggcaaatatgtacagtatttttcccttttaaagatagtttaaaaaatcaaggtaataaaaaacggccaactctttcaggaaaaaaaaaatccggtattttgtactacttgagtttctctaatgcctaaaatatgcatttaaatcatcccacacctacacagaaacaaaatcagcagggaaaaccatcccactgatgattggcaattccaccgttcctctccatctgaccagctttcaccagagggcgatctttcatgcttgcacatcgagtttatacaatgtagaagcccccaagtcacctgggaaatggctcatgccaaatacatggagtccttagttgactatcttttcatattaaaatcccatcttccaatgaagcatcctgttttcaatactgatatcaaatttcgaatgtaaaggagatttcaaatgtattgctttcaccttttcttttttattcatttatttttaattgacataaaaattgtatatatttatgggatacaatgtgatgttttgatatatgtatgcattgtggaatgattaaatcaagctaattaaca

SEQ ID NO: 16787 - DNA, 736 bp, Homo sapiens
  ENST00000456522
tcgagcgcaacctcgttaacagcctcttcccggtcaaccgctccaagcaccgtctctactcggacctgcagacccccgggcgctacggccgggtcatcgtcacctccttccagaaagccaacatgctggaccagcatcacaccgacctgatcttaaaggtcatggattatatgggacttttgaaatgttatcctcctggaggaaaactagagaagaccaacatgttaaagagagaactgcagcagtctatgcagactccatgctctccttttctctcaccactgccatgtacctggtcacctttggcataggggccagccctttcacgaacattgaggcagccaggattttctgctgcaattcctgtattgcaatcttcttcaactacctctatgtactctcgttttatggttccagcctagtgttcactggctacatagaaaacaattaccagcatagtatcttctgtagaaaagtcccaaagcctgaggcattgcaggagaagccggcatggtacaggtttctcctgacggccagattcagtgaggacacagctgaaggcgaggaagcgaacacttacgagagtcacctattggtatgtttcctcaaacgctattactgtgactggataaccaacacctatgtcaagccttttgtagttctcttttaccttatttatatttcctttgccttaatgggctatctgcaggtcagtgaagggtcagaccttagtaac

SEQ ID NO: 16788 - DNA, 2850 bp, Homo sapiens
  ENST00000339488
gagaacggggtagcccggcgcttacacatgtcacatgtgctttttaagacggccgggagcgcctgcgagctggatctggtggaggatgctgcggcaggtgcttcgcagagggctccagtcgttctgccacaggctgggtttgtgcgtgagccggcacccggtctttttcctcaccgtgcccgcagtcctgacaatcaccttcggcctcagcgcgctcaaccgcttccagcccgagggcgacctggagcgcctggtcgctcccagccacagcctggccaagatcgagcgcagcctggccagcagccttttccccctggaccagtccaaaagccagctctattcggacttacacacccctgggaggtatggcagggtgatcctcctctccccaaccggggacaatattttgctccaggctgaggggatcctgcagacccaccgagccgtgctggaaatgaaggatgggaggaacagttttattggacaccaactgggcggggtagtggaagtgccaaacagcaaagatcagcgggtcaagtcagccagagccattcaaatcacctactacctccagacctatggctctgccacccaagacctcataggggagaagtgggagaatgagttctgtaagcttataaggaagctccaggaggagcatcaagaactccagctctactctttagcatcctttagcctctggagggactttcataagaccagcatcctggccagaagcaaggtcctggtgagcctcgtgctgatcctgaccacagccaccctctccagctccatgaaggactgcttgcgcagtaagcccttcctgggcctcctgggggtgctcacagtatgcatctccatcatcacagcagcagggatcttcttcatcaccgatggaaagtacaactccaccctgctgggaatcccgttcttcgccatgggtcatggaactaaaggagtgtttgagcttctgtccggatggcggagaaccaaagagaacttgcccttcaaagacaggatagcagatgcctattctgatgtgatggtcacctataccatgaccagctccctgtacttcatcacttttggcatgggtgccagcccattcacaaacatagaggctgtgaaggtcttctgtcaaaacatgtgtgtctctattctgttgaactacttctacattttctccttctttggctcctgtctggtctttgctggccaactagagcaaaaccgctaccacagcatcttttgctgtaagatcccttctgcagaatacctggatcgcaaacctgtgtggttccagacagtgatgagtgatgggcatcaacagacgtcccatcatgagacgaacccctaccagcaccacttcattcagcacttcctccgtgaacattataatgaatggattaccaatatatatgtgaagccatttgttgtcatcctctatctcatttatgcctccttctccttcatggggtgcttacagatcagtgacggagccaacatcatcaatctactagccagtgattcgccaagtgtttcctatgccatggttcagcagaaatatttcagcaactatagccctgtgataggattctacgtctatgagcccctagagtactggaacagcagcgtccaggatgacctaagaagactctgtagtggattcactgcagtgtcctgggtggagcagtactaccagttcctgaaagtcagcaacgtcagtgccaataacaaaagtgacttcatcagtgtcctgcaaagctcatttttaaaaaagccagaattccagcattttcgaaatgatatcatcttctccaaggcaggggatgaaagcaatatcattgcttctcgcttgtatctggtggccaggactagcagagacaagcagaaagaaatcacagaagtgttggaaaagctgaggcccctatccctctcaaagagcatccgattcatcgtgttcaacccctcctttgtcttcatggaccattacagcttgtctgtcacagtgcctgttctgattgcaggctttggtgttctcctggtgttaatcctgacttttttcctagtgatccaccctctgggaaacttctggctaattcttagcgtcacctcaattgagctgggcgttctgggcttaatgacattatggaacgtcgacatggattgcatttctatcttgtgccttatctacaccttgaatttcgccattgaccactgtgcaccactgcttttcacatttgtattagcaactgagcacacccgaacacaatgtataaaaagctccttgcaagaccatgggacagccattttgcaaaatgttacttcttttcttattgggttagtcccccttctatttgtgccttcgaacctgaccttcacactgttcaaatgcttgctgctcactgggggttgcacacttctgcactgttttgttattttacctgtgttcctaacgtttttccccccttccaaaaagcaccacaagaaaaagaaacgtgccaagcgaaaggagagagaggaaattgaatgcatagaaattcaagagaacccggatcacgtcaccacagtatgaggggtatagaccagtggattatttttcttttccagtattgcacaatgatgcagggcaagtaaagctcagacctcagctgcttgggctggccaggggtaacaaggcaagtcagatcaagagtgcattattcatgacacttcaaggtgcctgcttcttggggggaagagggaataaaaaaagaggaaaaagttatttgcaaccttgttctcctctaaaaacaagtttctggatgtaatctgagagctcttccaaggaatggatgaatcaatggagtg

SEQ ID NO: 16789 - DNA, 3232 bp, Homo sapiens
  ENST00000398738
gtgctttttaagacggccgggagcgcctgcgagctggatctggtggaggatgctgcggcaggtgcttcgcagagggctccagtcgttctgccacaggctgggtttgtgcgtgagccggcacccggtctttttcctcaccgtgcccgcagtcctgacaatcaccttcggcctcagcgcgctcaaccgcttccagcccgagggcgacctggagcgcctggtcgctcccagccacagcctggccaagatcgagcgcagcctggccagcagccttttccccctggaccagtccaaaagccagctctattcggacttacacacccctgggaggtatggcagggtgatcctcctctccccaaccggggacaatattttgctccaggctgaggggatcctgcagacccaccgagccgtgctggaaatgaaggatgggaggaacagttttattggacaccaactgggcggggtagtggaagtgccaaacagcaaagatcagcgggtcaagtcagccagagccattcaaatcacctactacctccagacctatggctctgccacccaagacctcataggggagaagtgggagaatgagttctgtaagcttataaggaagctccaggaggagcatcaagaactccagctctactctttagcatcctttagcctctggagggactttcataagaccagcatcctggccagaagcaaggtcctggtgagcctcgtgctgatcctgaccacagccaccctctccagctccatgaaggactgcttgcgcagtaagcccttcctgggcctcctgggggtgctcacagtatgcatctccatcatcacagcagcagggatcttcttcatcaccgatggaaagtacaactccaccctgctgggaatcccgttcttcgccatgggcatctccactgaatttacctcaagctagaaacaaatttagtttggaagaaagaaaggagagaaggaaggagagaaaaaactggagaggagaaaaatatcacatttggaagattatatgtgaagactcctaggatacaataaaatcatcatcatcgtcatcatcatcatcatcaccaccaataccatcagagcaatctgagagttcattctagtctaagaacccagccctctattttttggaggttaagtatcctccaggtatttctttcctccctgtgcttaacagctgtgtgtctgtaacccatactgtcttttctatctcccacctgactcctctcatgggaaactaaattggtttaaatcatatggaagcattataagtactgtttagtgatgaaaataaattgattccaatcatataggtactttcctaaatactgactgatgaagtttagatgtgctgtaatttataaataaaatgaaggaggttacctggcaatatgtgagagggaggaacaattatcgtgtttgagatttaaaggaaagagtaatgaacacttcccaaataattctatgagataaatattaccctgatactaaaaccagacaaaaacatcacaaggaaggaaaactacaggttaataactttatgaacttgagtgtaaaaattctcaataaaatactagcaagccaaattcaatgaacaaatgaggtttatttctatttatttttatttttttttatttttattttattttattattttttttttttgagacggagtcttgctctgtcgcccaggccggactgcggactgcagtggcgcaatctcggctcactgcaagctccgcctcccaggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccatgcccggcccaaatgaggtttattttataaatgcaagagtggtttaacatttgaaaatcattaacataatataccatcaatagaattaaggtcaaaaaccgcatggtcatctcaatagacaaagaaagggcatttgacaaactctaacaacattttatgacaacaaaataactctcaacaaactagtaatagaagggaacttgcttaatctgatacagatatccataaaaacccaaagctaatatcatatttaatggagaaagaatgaacttaaaagttgtacttcaatgaataccatcaagaaagtgaaaaacaaactcacagaatgggagaaaatattttcaaattatctatcttataagagacttgtatacagaatatttaaaggactattacagcttaataataaaaacacaacccaatttcaaagtggacagaagattcgaatagacatttattctaagaagataaacaagtggccaaaagtatatttaaaatgctcaaaataattagttattaaagaaatgcaaatcaaaaccacattgagcacatcatatccattaggatgactaaaatcaagaagtaaggcaataacaagtattgatgaggtaggttaggaactctttacacattgctgatgaaaatgtaaatgatgcagctcttttggaaaatagtctgacagttcctaaaaatgctaaacttagtattagcattttgattcagtaattccactgctaggtatatactcaagagaaatgaaaatatttatccacacaaaactgtacaaatgttcatagcaatattattcataatggcaaaaggtagacacaatccaaatgtccatcaactgatgaatggaaacataaaaagtggtatatgcatacaatggaatattattcagccattaaaaaggaaacaagtactgatacatgctccaatatggatgagcattgaaaatattttgataagtgaaagaagtcatgaaagtgtacataattgcatgattctatatatatgaaatgttcagagtaggcaaatatgtagagacaggaagtagatgagtagttgctgaggattggtgggttaggggatgaagccagggaatggagtcactgctaatgatacagaagttctttcaggttgatgaaatgttctgaaattgattatggcaatcattgcacaactttgtagtatactagaaacttttaaattgtacacttttaatcaatgaattgcttggcattatatcacaataaagctgttaaaaacaaac

SEQ ID NO: 16790 - DNA, 1203 bp, Homo sapiens
  ENST00000535784
gagagaaccagagggcgaagtgggagggcacaggggagactaaaaaggccagggaagttggcctgccggaagttcccagggagaaggcagcgcgttgtacccgagaaaaaagaaatcctctttttagaacatctcttggtggtaccatcagaaatgtcttccttaagtggaaaagtccaaaccgttttgggccttgtagagccaagcaaactgggccgtaccctgacccatgaacacctggccatgacctttgactgctgttactgtccacctcccccgtgccaggaagctatttccaaagaacctatcgtgatgaaaaatttatattggattcagaaaaacgcctattcccataaagaaaaccttcaattaaatcaggagacagaagccataaaggaagaactgttgtattttaaagctaatggtggaggggctttggtggaaaacacaaccactgggattagccgagacacacagacgttgaagaggcttgcagaagagactggcgtccatatcatatctggagccgggttttatgtggatgcaactcactcctcagagaccagggccatgtcagtggagcagcttaccgatgtccttatgaatgaaattctccatggagctgatggaaccagtatcaagtgtggcattattggagaaattggttgctcctggcctttgactgagagtgaaagaaaggttctccaggccacagctcatgcccaggctcagcttggttgtcctgttattatccatcctggacggagctccagggcaccatttcagattatccgaatattgcaagaagcaggcgcagacatctccaaaacagtcatgtcacacctggataggactattcttgataagaaagagctcttggagtttgctcaacttggctgctacttggaatatgatctctttggtactgaactacttcattaccaactcggcccagatattgacatgcctgatgataacaaaagaattagaagggtgcgtctcctggtggaagagggctgtgaagatcgaattctggtagcacatgacatacatacgaaaacccggctgatgaaatatggaggtcacggctattctcatatactcaccaatgttgttcctaaaatgttgctgagaggcataactgagaatgtgcttgataagattctaatagagaaccctaagcaatggctaactttcaaatag

SEQ ID NO: 16791 - DNA, 3777 bp, Homo sapiens
  ENST00000378000
aaaaaggccagggaagttggcctgccggaagttcccagggagaaggcagcgcgttgtacccgagattcagggtctggctctgcttcccaggctagagtgcatttggcgcgatcacagctcactgcagcctcgacctcctgagctcaagcgaacttcctgcctcagcctcctgagcttcctgagtagctgcgactacagaaaaaagaaatcctctttttagaacatctcttggtggtaccatcagaaatgtcttccttaagtggaaaagtccaaaccgttttgggccttgtagagccaagcaaactgggccgtaccctgacccatgaacacctggccatgacctttgactgctgttactgtccacctcccccgtgccaggaagctatttccaaagaacctatcgtgatgaaaaatttatattggattcagaaaaacgcctattcccataaagaaaaccttcaattaaatcaggagacagaagccataaaggaagaactgttgtattttaaagctaatggtggaggggctttggtggaaaacacaaccactgggattagccgagacacacagacgttgaagaggcttgcagaagagactggcgtccatatcatatctggagccgggttttatgtggatgcaactcactcctcagagaccagggccatgtcagtggagcagcttaccgatgtccttatgaatgaaattctccatggagctgatggaaccagtatcaagtgtggcattattggagaaattggttgctcctggcctttgactgagagtgaaagaaaggttctccaggccacagctcatgcccaggctcagcttggttgtcctgttattatccatcctggacggagctccagggcaccatttcagattatccgaatattgcaagaagcaggcgcagacatctccaaaacagtcatgtcacacctggataggactattcttgataagaaagagctcttggagtttgctcaacttggctgctacttggaatatgatctctttggtactgaactacttcattaccaactcggcccagatattgacatgcctgatgataacaaaagaattagaagggtgcgtctcctggtggaagagggctgtgaagatcgaattctggtagcacatgacatacatacgaaaacccggctgatgaaatatggaggtcacggctattctcatatactcaccaatgttgttcctaaaatgttgctgagaggcataactgagaatgtgcttgataagattctaatagagaaccctaagcaatggctaactttcaaataggatggttgcttatgaattcacaccttgagtataaaacttgcagagaacattcagcgatttccagtccactgtgagatattaatcagttacctaggactaatgacagatcatttccttctgatgagaactaggagggtttgccttctctgagaccagctattacaactgtgcctctagggagttactcagcctaattgagccctattattttaacttaacaaaataaatacagaagtacctatttctaaacaatgatttaaagtctatatcccctaagcggagttgttgtttttctccctaatctatcagctgcactacttgagaaaatttaaagtgtttctagttaaattatttccttcttgagcgatctaatgtttcttgtaatattgatgatcctactaattatcctgctgttctttaattaatgcttaatgaataatatggcactgtaaaatagcttctgcaacaagggaagttaaattttgagacttttttccccaaaggatactgactgtaatacaattaccaattcacaatgataaaaatattttgaaaggttaattttatactgtccacctatctatatattcttctactgaaatgattttgatatctttggctttccggtatctatttttgccatacattttgctgttttgcaaagtttgtataagaacacataacactactgaattataaaaattcaatcataaaagtcaaaatatattacataatatagtttaatgaatcattacatttataataacaaaggccacaatttaattaattggtaagatataatgcaaaaaaaaaaagagaaatgtttgccttatgtatattccctttatttcctttaccttttgtttttccttggacctaaacagagaaaataatgcttatgtatctgaagaaaaggtcagatctattggaaatgacagcccgatacttgagcctcctctttaaaaggtatccagccctgatattttgtgtaaataaaatgtttttaaaacctgttagttaaaacacttaggtgatgggcactgctgcttataaattcatcttttggttgaatcctcactatgctatttggtacctaaaaatattctccaaacccttgctgccagttcctctttgataaatatatagttaattcgaaataaaatccattgcaattcatttatgagttatcttacatatcacaaagaccaattagaattagtcattattcttgatgaagagtctgtttttaatcataaaaatcatgacagttactcagacccaggcatttcaacagagctaacaccaccttcagataggcacaccatgcataactcttgggaagttgagctttgctaaataaaagatatttctgctgatcaaagatgatcaagctttctgtgtattggaacagaaagtaacaaagaggaatgagccaggagaacaaactaattcctttaaataaataaaaaaaaaaaatgcaaatgtccttcaccagtaaagcaagcaaatttttaaaatctctgtttttgaaatctactcgtcaaagagttttcagaggcaatgaaaggggaacagatttttcattgtaatagtggaagttgtgtgatagttaggagatatcaacatgcatttttaatcttttccttagatgaaagagatggcttttggcagtgtgttctaaccagaaagaaaggatttgtattactctccaaatctactgtactgtcagcttcactccacctgagaaaaaagaaaaaaaaattgatagctcaaatgcatgtaattcataaacactgcaaaggagagccacttggtgtctgcagtcctcatattaacagtctgtcacagaatgcagttaaagtattgattggcatatggtaatagagcaaccatagccttaacttacagacctgtgaaataaagggcattttgacctaatacaattaattttctggataactcttaaagagaagtcattttaactgtttttgctactccatatattgtcattcaaaatatattttaacccaaaataagttaaataatttgtgcatgtttgtgtgtgtatatatgcatacacttttttatattaaaattttgaggctatacagccactgtgccctgtggaataaagccatatatataaatgttttatatgtatatgttttatacataaataaaacatttcatctaatatatatatgtgtgtgtgagtatatgtgtgcatgtttagcagatatttgtataaaatataaacactctgttgtcatataggctatatgcgaaattgttaattttaaaataacctcaggccacagacttgtagtaatcatttgaaggcctcacctagtgtccccttggtgacgtatgcagcagctcaaattaaacctttgtgcattgggttatgaataatcttttcttccaaagatggcaaaagcctcggtttgatttgatactaaagaataaatttctctgactttc

SEQ ID NO: 16792 - DNA, 567 bp, Homo sapiens
  ENST00000485788
attagccgagacacacagacgttgaagaggcttgcagaagagactggcgtccatatcatatctggagccgggttttatgtggatgcaactcactcctcagagaccagggccatgtcagtggagcagcttaccgatgtccttatgaatgaaattctccatggagctgatggaaccagtatcaagtgtggcattattggagaaattggttgctcctggcctttgactgagagtgaaagaaaggttctccaggccacagctcatgcccaggctcagcttggttgtcctgttattatccatcctggacggagctccagggcaccatttcagattatccgaatattgcaagaagcaggcgcagacatctccaaaacagtcatgtcacacctggataggtaagtaggctgtcttacaaatggatgcaaactgccatataattaatgcatgatcaaattaagaatctacagtaatcagtcaatgcaatactaatcacgcagagaaaaccactaactatatggaaggtagtatttataaagtttcacaactgacatgaataaaagtcaatgctgc

SEQ ID NO: 16793 - DNA, 3212 bp, Homo sapiens
  ENST00000423462
gagagaaccagagggcgaagtgggagggcacaggggagactaaaaaggccagggaagttggcctgccggaagttcccagggagaaggcagcgcgttgtacccgagcttaccgatgtccttatgaatgaaattctccatggagctgatggaaccagtatcaagtgtggcattattggagaaattggttgctcctggcctttgactgagagtgaaagaaaggttctccaggccacagctcatgcccaggctcagcttggttgtcctgttattatccatcctggacggagctccagggcaccatttcagattatccgaatattgcaagaagcaggcgcagacatctccaaaacagtcatgtcacacctggataggactattcttgataagaaagagctcttggagtttgctcaacttggctgctacttggaatatgatctctttggtactgaactacttcattaccaactcggcccagatattgacatgcctgatgataacaaaagaattagaagggtgcgtctcctggtggaagagggctgtgaagatcgaattctggtagcacatgacatacatacgaaaacccggctgatgaaatatggaggtcacggctattctcatatactcaccaatgttgttcctaaaatgttgctgagaggcataactgagaatgtgcttgataagattctaatagagaaccctaagcaatggctaactttcaaataggatggttgcttatgaattcacaccttgagtataaaacttgcagagaacattcagcgatttccagtccactgtgagatattaatcagttacctaggactaatgacagatcatttccttctgatgagaactaggagggtttgccttctctgagaccagctattacaactgtgcctctagggagttactcagcctaattgagccctattattttaacttaacaaaataaatacagaagtacctatttctaaacaatgatttaaagtctatatcccctaagcggagttgttgtttttctccctaatctatcagctgcactacttgagaaaatttaaagtgtttctagttaaattatttccttcttgagcgatctaatgtttcttgtaatattgatgatcctactaattatcctgctgttctttaattaatgcttaatgaataatatggcactgtaaaatagcttctgcaacaagggaagttaaattttgagacttttttccccaaaggatactgactgtaatacaattaccaattcacaatgataaaaatattttgaaaggttaattttatactgtccacctatctatatattcttctactgaaatgattttgatatctttggctttccggtatctatttttgccatacattttgctgttttgcaaagtttgtataagaacacataacactactgaattataaaaattcaatcataaaagtcaaaatatattacataatatagtttaatgaatcattacatttataataacaaaggccacaatttaattaattggtaagatataatgcaaaaaaaaaaagagaaatgtttgccttatgtatattccctttatttcctttaccttttgtttttccttggacctaaacagagaaaataatgcttatgtatctgaagaaaaggtcagatctattggaaatgacagcccgatacttgagcctcctctttaaaaggtatccagccctgatattttgtgtaaataaaatgtttttaaaacctgttagttaaaacacttaggtgatgggcactgctgcttataaattcatcttttggttgaatcctcactatgctatttggtacctaaaaatattctccaaacccttgctgccagttcctctttgataaatatatagttaattcgaaataaaatccattgcaattcatttatgagttatcttacatatcacaaagaccaattagaattagtcattattcttgatgaagagtctgtttttaatcataaaaatcatgacagttactcagacccaggcatttcaacagagctaacaccaccttcagataggcacaccatgcataactcttgggaagttgagctttgctaaataaaagatatttctgctgatcaaagatgatcaagctttctgtgtattggaacagaaagtaacaaagaggaatgagccaggagaacaaactaattcctttaaataaataaaaaaaaaaaatgcaaatgtccttcaccagtaaagcaagcaaatttttaaaatctctgtttttgaaatctactcgtcaaagagttttcagaggcaatgaaaggggaacagatttttcattgtaatagtggaagttgtgtgatagttaggagatatcaacatgcatttttaatcttttccttagatgaaagagatggcttttggcagtgtgttctaaccagaaagaaaggatttgtattactctccaaatctactgtactgtcagcttcactccacctgagaaaaaagaaaaaaaaattgatagctcaaatgcatgtaattcataaacactgcaaaggagagccacttggtgtctgcagtcctcatattaacagtctgtcacagaatgcagttaaagtattgattggcatatggtaatagagcaaccatagccttaacttacagacctgtgaaataaagggcattttgacctaatacaattaattttctggataactcttaaagagaagtcattttaactgtttttgctactccatatattgtcattcaaaatatattttaacccaaaataagttaaataatttgtgcatgtttgtgtgtgtatatatgcatacacttttttatattaaaattttgaggctatacagccactgtgccctgtggaataaagccatatatataaatgttttatatgtatatgttttatacataaataaaacatttcatctaatatatatatgtgtgtgtgagtatatgtgtgcatgtttagcagatatttgtataaaatataaacactctgttgtcatataggctatatgcgaaattgttaattttaaaataacctcaggccacagacttgtagtaatcatttgaaggcctcacctagtgtccccttggtgacgtatgcagcagctcaaattaaacctttgtgcattgggttatgaataatcttttcttccaaagatggcaaaagcctcggtttgatttgatactaaagaataaatttctctgactttcccagtgaa

SEQ ID NO: 16794 - DNA, 3448 bp, Homo sapiens
  ENST00000298942
agaaaaaagaaatcctctttttagaacatctcttggtggtaccatcagaaatgtcttccttaagtggaaaagtccaaaccgttttgggccttgtagagccaagcaaactgggccgtaccctgacccatgaacacctggccatgacctttgactgctgttactgtccacctcccccgtgccaggaagctatttccaaagaacctatcgtgatgaaaaatttatattggattcagaaaaacgcctattcccataaagaaaaccttcaattaaatcaggagacagaagccataaaggaagaactgttgtattttaaagctaatggtggaggggctttggtggaaaacacaaccactgggattagccgagacacacagacgttgaagaggcttgcagaagagactggcgtccatatcatatctggagccgggttttatgtggatgcaactcactcctcagagaccagggccatgtcagtggagcagcttaccgatgtccttatgaatgaaattctccatggagctgatggaaccagtatcaagtgtggcattattggagaaattggttgctcctggcctttgactgagagtgaaagaaaggttctccaggccacagctcatgcccaggctcagcttggttgtcctgttattatccatcctggacggagctccagggcaccatttcagattatccgaatattgcaagaagcaggcgcagacatctccaaaacagtcatgtcacacctggatagggtgcgtctcctggtggaagagggctgtgaagatcgaattctggtagcacatgacatacatacgaaaacccggctgatgaaatatggaggtcacggctattctcatatactcaccaatgttgttcctaaaatgttgctgagaggcataactgagaatgtgcttgataagattctaatagagaaccctaagcaatggctaactttcaaataggatggttgcttatgaattcacaccttgagtataaaacttgcagagaacattcagcgatttccagtccactgtgagatattaatcagttacctaggactaatgacagatcatttccttctgatgagaactaggagggtttgccttctctgagaccagctattacaactgtgcctctagggagttactcagcctaattgagccctattattttaacttaacaaaataaatacagaagtacctatttctaaacaatgatttaaagtctatatcccctaagcggagttgttgtttttctccctaatctatcagctgcactacttgagaaaatttaaagtgtttctagttaaattatttccttcttgagcgatctaatgtttcttgtaatattgatgatcctactaattatcctgctgttctttaattaatgcttaatgaataatatggcactgtaaaatagcttctgcaacaagggaagttaaattttgagacttttttccccaaaggatactgactgtaatacaattaccaattcacaatgataaaaatattttgaaaggttaattttatactgtccacctatctatatattcttctactgaaatgattttgatatctttggctttccggtatctatttttgccatacattttgctgttttgcaaagtttgtataagaacacataacactactgaattataaaaattcaatcataaaagtcaaaatatattacataatatagtttaatgaatcattacatttataataacaaaggccacaatttaattaattggtaagatataatgcaaaaaaaaaaagagaaatgtttgccttatgtatattccctttatttcctttaccttttgtttttccttggacctaaacagagaaaataatgcttatgtatctgaagaaaaggtcagatctattggaaatgacagcccgatacttgagcctcctctttaaaaggtatccagccctgatattttgtgtaaataaaatgtttttaaaacctgttagttaaaacacttaggtgatgggcactgctgcttataaattcatcttttggttgaatcctcactatgctatttggtacctaaaaatattctccaaacccttgctgccagttcctctttgataaatatatagttaattcgaaataaaatccattgcaattcatttatgagttatcttacatatcacaaagaccaattagaattagtcattattcttgatgaagagtctgtttttaatcataaaaatcatgacagttactcagacccaggcatttcaacagagctaacaccaccttcagataggcacaccatgcataactcttgggaagttgagctttgctaaataaaagatatttctgctgatcaaagatgatcaagctttctgtgtattggaacagaaagtaacaaagaggaatgagccaggagaacaaactaattcctttaaataaataaaaaaaaaaaatgcaaatgtccttcaccagtaaagcaagcaaatttttaaaatctctgtttttgaaatctactcgtcaaagagttttcagaggcaatgaaaggggaacagatttttcattgtaatagtggaagttgtgtgatagttaggagatatcaacatgcatttttaatcttttccttagatgaaagagatggcttttggcagtgtgttctaaccagaaagaaaggatttgtattactctccaaatctactgtactgtcagcttcactccacctgagaaaaaagaaaaaaaaattgatagctcaaatgcatgtaattcataaacactgcaaaggagagccacttggtgtctgcagtcctcatattaacagtctgtcacagaatgcagttaaagtattgattggcatatggtaatagagcaaccatagccttaacttacagacctgtgaaataaagggcattttgacctaatacaattaattttctggataactcttaaagagaagtcattttaactgtttttgctactccatatattgtcattcaaaatatattttaacccaaaataagttaaataatttgtgcatgtttgtgtgtgtatatatgcatacacttttttatattaaaattttgaggctatacagccactgtgccctgtggaataaagccatatatataaatgttttatatgtatatgttttatacataaataaaacatttcatctaatatatatatgtgtgtgtgagtatatgtgtgcatgtttagcagatatttgtataaaatataaacactctgttgtcatataggctatatgcgaaattgttaattttaaaataacctcaggccacagacttgtagtaatcatttgaaggcctcacctagtgtccccttggtgacgtatgcagcagctcaaattaaacctttgtgcattgggttatgaataatcttttcttccaaagatggcaaaagcctcggtttgatttgatactaaagaataaatttctctgactttcccagtgaa

SEQ ID NO: 16795 - DNA, 2939 bp, Homo sapiens
  ENST00000537473
gtgagtgcgacaccccgccgagggaaggtcgccgagtgaggccgaggccgcgttgggggctccctggaagcggccccctagcctttctcgcatcggtggtggcagtcgttcctgcctgggggcgggaggtccaggatccttgttccggttaccgttggcgggtggaggacatttttcctccagatgtctgcttcccccacccctgaaccgttccttggcttccccatgccggaaatcctacttttacccctttggctgtctgggttactcgcctctttcggtaacttcaccctaggccttaagctcccggtagctgctcgccatgcggcgccctgaagcgtgaaccttcgtgggtcgcctctcggctgcttgggcgctccggttctgttgctttgtggtcccggggccaggccctgagtcgagtgcacctgtggtgggtgccgccaggtgcctggcggagctcctgggagagccccacgcggacctcgccgtgagctgcaggtactgctaggcaactagaaggaagccatgcccacgccgcaacatacttccctctccagtgtctgggtttcttgagtgtgggtacttccagtccgcctcctaactccagtctcttgaaaacacgggaggttgccaaaactcagccgcttccctggcagcgaggaggagttaccattgagcaggtagttccgcacgtgtcgactttggaaagatacggacattttctgtgtttcatgttctacttgaggcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgtaagtctaaaaattcttttttctgtttactttcatactattaaatagtaagaaacaacatatttacaaatggttttatatagattcacaattacttcttattttctaaaaaaaaagaaaagggaaaagcaatttttaaaatgtgcccatttttgacgaatgggggtatctattagggaactggttgtaccgtagaccattcctaaatggattagatttccaaagaatcattgtatagagacattatatattaataccgtactcaattataacagtcagtttaggccgggcgaggtggctcatgtctgttatcccagcaggccaggtgggcagagtacgtgaggtcaggagttcgagaccagcctggccaacatggtgaaaccctgtcttaaaaacttagccagacatgatggcaggtgcctgtaatcccagctactggtgagctgaggtgggagaatcgcttgaacctgggaggcggaggttgcagtgagccaagatcacaccattgcactccagtgtgggcagcagagcgaggctccatctcaaaaagaaagaagagagtcagtttataggattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttcttggctgtccttttaagtgtctggcttactgtaatttttatgtatttaccatttactggaatggagtttatttgaggaagaatttgggattattcctctgtttgaaaaaagaggcttgctgtaatgtcacaggaaaccttttaaaagtggatctgtaatagcatattgtagatgcactttgcagcagttggaaaagaaagtgttgtgtgatttgattgaaataaaactaaatgtgttgtcctcctaaatctttgaa

SEQ ID NO: 16796 - DNA, 1920 bp, Homo sapiens
  ENST00000262033
ccagccgccgcccggcctcaccacccctcgtttgcacgcacgcacgttcattctccgtcctcgcgccccttttcctacactttcctcttctccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttcttggctgtccttttaagtgtctggcttactgtaatttttatgtatttaccatttactggaatggagtttatttgaggaagaatttgggattattcctctgtttgaaaaaagaggcttgctgtaatgtcacaggaaaccttttaaaagtggatctgtaatagcatattgtagatgcactttgcagcagttggaaaagaaagtgttgtgtgatttgattgaaataaaactaaatgtgttgtcctcctaaatctttg

SEQ ID NO: 16797 - DNA, 1547 bp, Homo sapiens
  ENST00000414274
ggcctcaccacccctcgtttgcacgcacgcacgttcattctccgtcctcgcgccccttttcctacactttcctcttctccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataa

SEQ ID NO: 16798 - DNA, 941 bp, Homo sapiens
  ENST00000436399
gaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacat

SEQ ID NO: 16799 - DNA, 1017 bp, Homo sapiens
  ENST00000448157
ctcaccacccctcgtttgcacgcacgcacgttcattctccgtcctcgcgccccttttcctacactttcctcttctccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgaggattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtct

SEQ ID NO: 16800 - DNA, 957 bp, Homo sapiens
  ENST00000456859
tagaaagccgcgccggagcccaaaaacaaggactgcgcacgcgcggcggcaaggcccgggcattttgctgcgtcaccagccgccgcccggcctcaccacccctcgtttgcacgcacgcacgttcattctccgtcctcgcgccccttttcctacactttcctcttctccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaa

SEQ ID NO: 16801 - DNA, 2077 bp, Homo sapiens
  ENST00000614328
gctgggaggccccgccctttccgtagatatctctagaaagccgcgccggagcccaaaaacaaggactgcgcacgcgcggcggcaaggcccgggcattttgctgcgtcaccagccgccgcccggcctcaccacccctcgtttgcacgcacgcacgttcattctccgtcctcgcgccccttttcctacactttcctcttctccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatactccattcagaagagagaagaggggagtgactttatgtctttggaaaagcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttcttggctgtccttttaagtgtctggcttactgtaatttttatgtatttaccatttactggaatggagtttatttgaggaagaatttgggattattcctctgtttgaaaaaagaggcttgctgtaatgtcacaggaaaccttttaaaagtggatctgtaatagcatattgtagatgcactttgcagcagttggaaaagaaagtgttgtgtgatttgattgaaataaaactaaatgtgttgtcctcctaaatctttg

SEQ ID NO: 16802 - DNA, 6178 bp, Homo sapiens
  ENST00000393203
gatttatcggctcgcgaggagagcggagcaggcgcgcggcccaggcggaggagcgccgactctggagcagccggagctggaagaggaggaggaggagaggcggcggggaaggaggaggagggggagagtcgctcccgccgggcgagcatggggcgcctggcctcgaggccgctgctgctggcgctcctgtcgttggctctttgccgagggcgtgtggtgagagtccccacagcgaccctggttcgagtggtgggcactgagctggtcatcccctgcaacgtcagtgactatgatggccccagcgagcaaaactttgactggagcttctcatctttggggagcagctttgtggagcttgcaagcacctgggaggtggggttcccagcccagctgtaccaggagcggctgcagaggggcgagatcctgttaaggcggactgccaacgacgccgtggagctccacataaagaacgtccagccttcagaccaaggccactacaaatgttcaacccccagcacagatgccactgtccagggaaactatgaggacacagtgcaggttaaagtgctggccgactccctgcacgtgggccccagcgcgcggcccccgccgagcctgagcctgcgggagggggagcccttcgagctgcgctgcaccgccgcctccgcctcgccgctgcacacgcacctggcgctgctgtgggaggtgcaccgcggcccggccaggcggagcgtcctcgccctgacccacgagggcaggttccacccgggcctggggtacgagcagcgctaccacagtggggacgtgcgcctcgacaccgtgggcagcgacgcctaccgcctctcagtgtcccgggctctgtctgccgaccagggctcctacaggtgtatcgtcagcgagtggatcgccgagcagggcaactggcaggaaatccaagaaaaggccgtggaagttgccaccgtggtgatccagccatcagttctgcgagcagctgtgcccaagaatgtgtctgtggctgaaggaaaggaactggacctgacctgtaacatcacaacagaccgagccgatgacgtccggcccgaggtgacgtggtccttcagcaggatgcctgacagcaccctacctggctcccgcgtgttggcgcggcttgaccgtgattccctggtgcacagctcgcctcatgttgctttgagtcatgtggatgcacgctcctaccatttactggttcgggatgttagcaaagaaaactctggctactattactgccacgtgtccctgtgggcacccggacacaacaggagctggcacaaagtggcagaggccgtgtcttccccagctggtgtgggtgtgacctggctagaaccagactaccaggtgtacctgaatgcttccaaggtccccgggtttgcggatgaccccacagagctggcatgccgggtggtggacacgaagagtggggaggcgaatgtccgattcacggtttcgtggtactacaggatgaaccggcgcagcgacaatgtggtgaccagcgagctgcttgcagtcatggacggggactggacgctaaaatatggagagaggagcaagcagcgggcccaggatggagactttattttttctaaggaacatacagacacgttcaatttccggatccaaaggactacagaggaagacagaggcaattattactgtgttgtgtctgcctggaccaaacagcggaacaacagctgggtgaaaagcaaggatgtcttctccaagcctgttaacatattttgggcattagaagattccgtgcttgtggtgaaggcgaggcagccaaagcctttctttgctgccggaaatacatttgagatgacttgcaaagtatcttccaagaatattaagtcgccacgctactctgttctcatcatggctgagaagcctgtcggcgacctctccagtcccaatgaaacgaagtacatcatctctctggaccaggattctgtggtgaagctggagaattggacagatgcatcacgggtggatggcgttgttttagaaaaagtgcaggaggatgagttccgctatcgaatgtaccagactcaggtctcagacgcagggctgtaccgctgcatggtgacagcctggtctcctgtcaggggcagcctttggcgagaagcagcaaccagtctctccaatcctattgagatagacttccaaacctcaggtcctatatttaatgcttctgtgcattcagacacaccatcagtaattcggggagatctgatcaaattgttctgtatcatcactgtcgagggagcagcactggatccagatgacatggcctttgatgtgtcctggtttgcggtgcactcttttggcctggacaaggctcctgtgctcctgtcttccctggatcggaagggcatcgtgaccacctcccggagggactggaagagcgacctcagcctggagcgcgtgagtgtgctggaattcttgctgcaagtgcatggctccgaggaccaggactttggcaactactactgttccgtgactccatgggtgaagtcaccaacaggttcctggcagaaggaggcagagatccactccaagcccgtttttataactgtgaagatggatgtgctgaacgccttcaagtatcccttgctgatcggcgtcggtctgtccacggtcatcgggctcctgtcctgtctcatcgggtactgcagctcccactggtgttgtaagaaggaggttcaggagacacggcgcgagcgccgcaggctcatgtcgatggagatggactaggctggcccgggaggggagtgacagagggacgttctaggagcaattggggcaagaagaggacagtgatattttaaaacaaagtgtgttacactaaaaaccagtcctctctaatctcaggtgggacttggcgctctctcttttctgcatgtcaagttctgagcgcggacatgtttaccagcacacggctcttcttcccacggcactttctgatgtaacaatcgagtgtgtgttttcccaactgcagctttttaatggttaaccttcatctaattttttttctcccactggtttatagatcctctgacttgtgtgtgtttatagcttttgtttcgcggggttgtggtgaggaaggggtgatggcatgcggagttctttatcttcagtgagaatgtgcctgcccgcctgagagccagcttccgcgttggaggcacgtgttcagagagctgctgagcgccaccctctacccggctgacagacaacacagacctgtgccgaaggctaatttgtggcttttacgaccctaccccaccccctgttttcaggggtttagactacatttgaaatccaaacttggagtatataacttcttattgagcccaactgctttttttttttttttttttgcttctctgccccttttccatttcttttgtatttgttttctgtgagagcactgaaatggcagccctggaatctacaatttggctctccactgagcaccttatcttgccaccttagccttaagaatgaatatgaagaaaaatacacagccacctctgtccagggcagtaagaagggctgcaaggaaggggaggatggggacaaggaaaggatcagatacctgctccagtagttgtgaggccactgtgtctcaggggactccaggaggagcagaagagggatcccacgaagttattcttacgcagctggggccaggagggtcagagtggtgccaggtgcaagttaggctaaagaagccaccactattcctctctcttgcccattgtggggggcaaaggcattggtcaccaagagtcttgcagggggacccacagatatgccatgtccttcacacgtgcttgggctccttaacctgaaggcaaattgctacttgcaagactgactgacttcaaggaatcagaaattacctagaagcaccatgttttttctatgaccttttcagtccttcaggtcattttaaggtccactgcagggggttagtgagaaagggtatactttgtggtatgttttgctttcctaatagggacatgaaggaaacccagcaatttgctgttatgtgaatggcctgtagagcagagtcaagagcggtgtgctttgcccgactgctcccatcaggaataggagagtagacagagatcttccacatcccaggcttctgctgctgctttaaaagctctgtccttggagcctcccgctccctgaagtgtctcgccccctgcacagcactggcctttcggaagcatcccagtagggttttctgaggctcgctggtgactcatgccctaattgcaatcctctgcttttatcttgactttgaaggatctaacactgctctctcttccaaaggggaaaaaaagattcatttgttttgagcaataaactaatacaaaatgatggccattcatgtgcagctctttgtcaccatgggccggatgagttgtgctcctcctggctcaccatttccccctgctcccccacagccggttctgcacttatcaccgagtcgcccctggaagcagattcccattgagttttccccaccaaggggaccatgcacatggtagaaacattagattctgcattgacagtagcctttccttggcccgggcctgtggtgggaagacgggcaacaagtataccccaccagggcctgagtgactagaggaagaggacgaggccttgttggcactagatttgggtattttctgcatgtcataacatatcctaactgctatttcagaagaggcagcttgtaggtgattgtacaagtgagaattaaagagagaacagatatttaaacaggtgctgtattagtaacagccagtgccctttcagcccttgcatctattaaaaggagattcaggattttattggcacaggcccttcttagtaggaagaaagggtgcttagctttggacctgaccgggtgtgtgtaaaaccatggactgagtcacagcagacactcgatggtggtaaatgtgatgggtgcttacacactgtaccttttcctttcatactgatgctgcagttcagggctggagttgttaaggcattgacctccacccacctgccccatgtccactgggctgcccaagctgcatgtcacctgagggctggcaggaaggggcgagaaatcccagggcattgtaccaaggacctagttccttctagggatataaatttccaggaatgtgtatttttaatgtggtgagatgcactcttttgttgtaccaaatagggctccccaccccacccctgcgacaagtgctcttctagaacaggttcctaccagcagcactggtgtgaatgaaagagagacccagccgcgtctcacacaggtggaattgcacttcttaacaaaaaggaactttataaaagtttgggattttttttcctaatcataaaaatagccccagaaagagcctaagctatgttcagatagaagcctcgaaattcctgtaaattgtttactttatgatgtttacatacacgtttcactttgaaaaaaaatgcaaatcgactttttaacaactgttgagatgtttcatgggacagtagaactctgactcaccaactgggctaaattttaatttaaaaatgtatttatttgagtgtctttccccccctcaccctcaccatctgaggggctccctgagatcttggtagaggaggcccctcctgcccagaccttcgtttgtttccccggtggcccttgcttcttgctttgcagactgcctgcagccatgattttgtcactgacatctgtgagccaaagactgagcctttttggcaggaataataagcaatactacacaacttgctactttcagaaaacttttttttagcttcaccgatgacaacagaggaagaagggaactgggatttgggtaagttctcctccactgtttgaccaaattctcagtgataaatatgtgtgcagatccctagaagagaaaacgctgactttctttttaagtgtggcacataaggatctgcagaattttccgtagacaaagaaaggatcttgtgtatttttgtccatatccaatgttatatgaactaattgtattgttttatactgtgaccacaaatattatgcaatgcaccatttgttttttatttcattaaaggaagtttaatttaaattgaa

SEQ ID NO: 16803 - DNA, 553 bp, Homo sapiens
  ENST00000496699
tccagtcccaatgaaacgaagtacatcatctctctggaccaggattctgtggtgaagctggagaattggacagatgcatcacgggtggatggcgttgttttagaaaaagtgcaggaggatgagttccgctatcgaatgtaccagactcaggtctcagacgcagggctgtaccgctgcatggtgacagcctggtctcctgtcaggggcagcctttggcgagaagcagcaaccagtctctccaatcctattgagatagacttccaaacctcaggtcctatatttaatgcttctgtgcattcagacacaccatcagtaattcggggagatctgatcaaattgttctgtatcatcactgtcgagggagcagcactggatccaggtacctcactccatcctcaccccttcaccatgttgctttctgtaaatgtttctcatatcatccgcactgtgttacacagatgtgggttagggataggattatctatttatcccctaactgcctggcccagtactttgtactcattaagtgtttaataaatacatgttgagtgga

SEQ ID NO: 16804 - DNA, 457 bp, Homo sapiens
  ENST00000497385
aaaacaaagtgtgttacactaaaaaccagtcctctctaatctcagactgcctgcagccatgattttgtcactgacatctgtgagccaaagactgagcctttttggcaggaataataagcaatactacacaacttgctactttcagaaaacttttttttagcttcaccgatgacaacagaggaagaagggaactgggatttgggtaagttctcctccactgtttgaccaaattctcagtgataaatatgtgtgcagatccctagaagagaaaacgctgactttctttttaagtgtggcacataaggatctgcagaattttccgtagacaaagaaaggatcttgtgtatttttgtccatatccaatgttatatgaactaattgtattgttttatactgtgaccacaaatattatgcaatgcaccatttgttttttatttcattaaaggaagtttaattt

SEQ ID NO: 16805 - DNA, 4719 bp, Homo sapiens
  ENST00000397501
gcagttcccgcctcctcaggtccgggcgggtccctggccggggtagcacggaagggtctcccaggcggcgtagtagggcttccgtgttactggaaacctacttccggctgcaaatgggaaaaggagcctctaccttaaccaatccccgggaacctcaggcccgcggatgggagaaaccagagatgccaacttcctgcttccgaagtagtggctgggtcttaaagcaccgatgtttctgcattgaatagccctggaagacagaattcttgtctctccaaagatctggcagacttattcccaattataagagatccttgcaaaggaggtgtcttgcttcaccttcaccttccactgtgattgtaagttttctgaggcctcgccagccatgcggaactgaataggactagcaacttcatagacggttgtgaagacaagctagacggcagatgaaagttcttggcacagagtgaacacttgataaactatatggcagggagggctggaacggggcttgtttgaagagcaatatgagccagggttatagacctgagtttggggtaagagtggaacatccaaatggaagagtccagcagctgaaaggacatttgttcaaaggcctttttcattacagttttctccttcttctgatccagccacagcctccggagccgttgcacacctacctgcccggccgacttacctgtacttgccgccgtcccggctcacctggcggtgcccgaggagtagtcgctggagtccgcgcctccctgggactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccgggagatcatcacctccatcctgctgagcgggcggatcgggcccaacatccggttggctgagtgctatgggctgaggctgaagcacatgaagtccgatgagatccactggctgcacccacagatgacggtgggtgaggtgcaggacaagtatgagtgtctgcacgtggaagccgagtggaggtatgaccttcaaatccgctacttgccagaagacttcatggagagcctgaaggaggacaggaccacgctgctctatttttaccaacagctccggaacgactacatgcagcgctacgccagcaaggtcagcgagggcatggccctgcagctgggctgcctggagctcaggcggttcttcaaggatatgccccacaatgcacttgacaagaagtccaacttcgagctcctagaaaaggaagtggggctggacttgtttttcccaaagcagatgcaggagaacttaaagcccaaacagttccggaagatgatccagcagaccttccagcagtacgcctcgctcagggaggaggagtgcgtcatgaagttcttcaacactctcgccggcttcgccaacatcgaccaggagacctaccgctgtgaactcattcaaggatggaacattactgtggacctggtcattggccctaaagggatccgccagctgactagtcaggacgcaaagcccacctgcctggccgagttcaagcagatcaggtccatcaggtgcctcccgctggaggagggccaggcagtacttcagctgggcattgaaggtgccccccaggccttgtccatcaaaacctcatccctagcagaggctgagaacatggctgacctcatagacggctactgccggctgcagggtgagcaccaaggctctctcatcatccatcctaggaaagatggtgagaagcggaacagcctgccccagatccccatgctaaacctggaggcccggcggtcccacctctcagagagctgcagcatagagtcagacatctacgcagagattcccgacgaaaccctgcgaaggcccggaggtccacagtatggcattgcccgtgaagatgtggtcctgaatcgtattcttggggaaggcttttttggggaggtctatgaaggtgtctacacaaatcacaaaggggagaaaatcaatgtagctgtcaagacctgcaagaaagactgcactctggacaacaaggagaagttcatgagcgaggcagtgatcatgaagaacctcgaccacccgcacatcgtgaagctgatcggcatcattgaagaggagcccacctggatcatcatggaattgtatccctatggggagctgggccactacctggagcggaacaagaactccctgaaggtgctcaccctcgtgctgtactcactgcagatatgcaaagccatggcctacctggagagcatcaactgcgtgcacagggacattgctgtccggaacatcctggtggcctcccctgagtgtgtgaagctgggggactttggtctttcccggtacattgaggacgaggactattacaaagcctctgtgactcgtctccccatcaaatggatgtccccagagtccattaacttccgacgcttcacgacagccagtgacgtctggatgttcgccgtgtgcatgtgggagatcctgagctttgggaagcagcccttcttctggctggagaacaaggatgtcatcggggtgctggagaaaggagaccggctgcccaagcctgatctctgtccaccggtcctttataccctcatgacccgctgctgggactacgaccccagtgaccggccccgcttcaccgagctggtgtgcagcctcagtgacgtttatcagatggagaaggacattgccatggagcaagagaggaatgctcgctaccgaacccccaaaatcttggagcccacagccttccaggaacccccacccaagcccagccgacctaagtacagaccccctccgcaaaccaacctcctggctccaaagctgcagttccaggttcctgagggtctgtgtgccagctctcctacgctcaccagccctatggagtatccatctcccgttaactcactgcacaccccacctctccaccggcacaatgtcttcaaacgccacagcatgcgggaggaggacttcatccaacccagcagccgagaagaggcccagcagctgtgggaggctgaaaaggtcaaaatgcggcaaatcctggacaaacagcagaagcagatggtggaggactaccagtggctcaggcaggaggagaagtccctggaccccatggtttatatgaatgataagtccccattgacgccagagaaggaggtcggctacctggagttcacagggcccccacagaagcccccgaggctgggcgcacagtccatccagcccacagctaacctggaccggactgatgacctggtgtacctcaatgtcatggagctggtgcgggccgtgctggagctcaagaatgagctctgtcagctgccccccgagggctacgtggtggtggtgaagaatgtggggctgaccctgcggaagctcatcgggagcgtggatgatctcctgccttccttgccgtcatcttcacggacagagatcgagggcacccagaaactgctcaacaaagacctggcagagctcatcaacaagatgcggctggcacagcagaacgccgtgacctccctaagtgaggagtgcaagaggcagatgctgacggcttcacacaccctggctgtggacgccaagaacctgctcgacgctgtggaccaggccaaggttctggccaatctggcccacccacctgcagagtgacggagggtgggggccacctgcctgcgtcttccgcccctgcctgccatgtacctcccctgccttgctgttggtcatgtgggtcttccagggggaaggccaaggggagtcaccttcccttgccactttgcacgacgccctctccccacccctacccctggctgtactgctcaggctgcagctggacagaggggactctgggctatggacacagggtgacggtgacaaagatggctcagagggggactgctgctgcctggccactgctccctaagccagcctggtccatgcagggggctcctgggggtggggaggtgtcacatggtgcccctagctttatatatggacatggcaggccgatttgggaaccaagctattcctttcccttcctcttcggccctcagatgtcccttgatgcacagagaagctggggaggagctttgttttgggggtcaggcagccagtgagatgagggatgggcctggcattcttgtacagtgtatattgaaatttatttaatgtgagtttggtctggactgacagcatgtgccctcctgagggaggacctggggcacagtccaggaacaagctaattgggagtccaggcacaggatgctgtgttgtcaacaaaccaagcatcagggggaagaagcagagagatgcggccaagataggaccttgggccaaatccgctctcttcctgcccctctttctctttcttcctttactttcccttgcttttccctcttttcttactcctcctctttctctccccaacccccattctcatctgcacccttcttttctcatgtgtttgcataaacattcttttaacttctttctatttgacttgtggttgaattaaaattgtcccatttgctttg

SEQ ID NO: 16806 - DNA, 559 bp, Homo sapiens
  ENST00000519650
gttactggaaacctacttccggctgcaaatgggaaaaggagcctctaccttaaccaatccccgggaacctcaggcccgcggatgggagaaaccagagatgccaacttcctgcttccgaagtagtggctgggtcttaaagcaccgatgtttctgcattgaatagccctggaagacagaattcttgtctctccaaagatctggcagacttattcccaattataagagatccttgcaaaggaggtgtcttgcttcaccttcaccttccactgtgattgtaagttttctgaggcctcgccagccatgcggaactgaataggactagcaacttcatagacggttgtgaagacaagctagacggcagatgaaagttcttggcacagagtgaacacttgataaactatatggcagattaggaaataaaagctcagaaagatggattcgcatgtccaaagtcacaacctcttccctcttgactggatccttcctgtgagcattgaaacctgctctactggctatcatcctaaatgacaaatcagtcctctttcaacccacgaccccc

SEQ ID NO: 16807 - DNA, 539 bp, Homo sapiens
  ENST00000522338
gggaacctcaggcccgcggatgggagaaaccagagatgccaacttcctgcttccgaagtagtggctgggtcttaaagcaccgaataggactagcaacttcatagacggttgtgaagacaagctagacggcagatgaaagttcttggcacagagtgaacacttgataaactatatggcagccacagcctccggagccgttgcacacctacctgcccggccgacttacctgtacttgccgccgtcccggctcacctggcggtgcccgaggagtagtcgctggagtccgcgcctccctgggactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccggg

SEQ ID NO: 16808 - DNA, 554 bp, Homo sapiens
  ENST00000521164
atttgcggccgggggaatggcagagatcgccccccaggtctgcccggcgctcagggaattggtggcagcgtctatttcagagtttatgccacagcctccggagccgttgcacacctacctgcccggccgacttacctgtacttgccgccgtcccggctcacctggcggtgcccgaggagtagtcgctggagtccgcgcctccctgggactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccgggagatcatcacctccatcctgctgagcgggcggatcgggcccaacatccggttggctgagtgctatgggctgaggctgaagcacatgaagtccgatgagatccactg

SEQ ID NO: 16809 - DNA, 4147 bp, Homo sapiens
  ENST00000346049
aaggaagtggggaggagagcagcaggggtgtggttaacaactcagaggaggagggagaatctaacctgtcagcccttttactcagccacagcctccggagccgttgcacacctacctgcccggccgacttacctgtacttgccgccgtcccggctcacctggcggtgcccgaggagtagtcgctggagtccgcgcctccctgggactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccgggagatcatcacctccatcctgctgagcgggcggatcgggcccaacatccggttggctgagtgctatgggctgaggctgaagcacatgaagtccgatgagatccactggctgcacccacagatgacggtgggtgaggtgcaggacaagtatgagtgtctgcacgtggaagccgagtggaggtatgaccttcaaatccgctacttgccagaagacttcatggagagcctgaaggaggacaggaccacgctgctctatttttaccaacagctccggaacgactacatgcagcgctacgccagcaaggtcagcgagggcatggccctgcagctgggctgcctggagctcaggcggttcttcaaggatatgccccacaatgcacttgacaagaagtccaacttcgagctcctagaaaaggaagtggggctggacttgtttttcccaaagcagatgcaggagaacttaaagcccaaacagttccggaagatgatccagcagaccttccagcagtacgcctcgctcagggaggaggagtgcgtcatgaagttcttcaacactctcgccggcttcgccaacatcgaccaggagacctaccgctgtgaactcattcaaggatggaacattactgtggacctggtcattggccctaaagggatccgccagctgactagtcaggacgcaaagcccacctgcctggccgagttcaagcagatcaggtccatcaggtgcctcccgctggaggagggccaggcagtacttcagctgggcattgaaggtgccccccaggccttgtccatcaaaacctcatccctagcagaggctgagaacatggctgacctcatagacggctactgccggctgcagggtgagcaccaaggctctctcatcatccatcctaggaaagatggtgagaagcggaacagcctgccccagatccccatgctaaacctggaggcccggcggtcccacctctcagagagctgcagcatagagtcagacatctacgcagagattcccgacgaaaccctgcgaaggcccggaggtccacagtatggcattgcccgtgaagatgtggtcctgaatcgtattcttggggaaggcttttttggggaggtctatgaaggtgtctacacaaatcacaaaggggagaaaatcaatgtagctgtcaagacctgcaagaaagactgcactctggacaacaaggagaagttcatgagcgaggcagtgatcatgaagaacctcgaccacccgcacatcgtgaagctgatcggcatcattgaagaggagcccacctggatcatcatggaattgtatccctatggggagctgggccactacctggagcggaacaagaactccctgaaggtgctcaccctcgtgctgtactcactgcagatatgcaaagccatggcctacctggagagcatcaactgcgtgcacagggacattgctgtccggaacatcctggtggcctcccctgagtgtgtgaagctgggggactttggtctttcccggtacattgaggacgaggactattacaaagcctctgtgactcgtctccccatcaaatggatgtccccagagtccattaacttccgacgcttcacgacagccagtgacgtctggatgttcgccgtgtgcatgtgggagatcctgagctttgggaagcagcccttcttctggctggagaacaaggatgtcatcggggtgctggagaaaggagaccggctgcccaagcctgatctctgtccaccggtcctttataccctcatgacccgctgctgggactacgaccccagtgaccggccccgcttcaccgagctggtgtgcagcctcagtgacgtttatcagatggagaaggacattgccatggagcaagagaggaatgctcgctaccgaacccccaaaatcttggagcccacagccttccaggaacccccacccaagcccagccgacctaagtacagaccccctccgcaaaccaacctcctggctccaaagctgcagttccaggttcctgagggtctgtgtgccagctctcctacgctcaccagccctatggagtatccatctcccgttaactcactgcacaccccacctctccaccggcacaatgtcttcaaacgccacagcatgcgggaggaggacttcatccaacccagcagccgagaagaggcccagcagctgtgggaggctgaaaaggtcaaaatgcggcaaatcctggacaaacagcagaagcagatggtggaggactaccagtggctcaggcaggaggagaagtccctggaccccatggtttatatgaatgataagtccccattgacgccagagaaggaggtcggctacctggagttcacagggcccccacagaagcccccgaggctgggcgcacagtccatccagcccacagctaacctggaccggactgatgacctggtgtacctcaatgtcatggagctggtgcgggccgtgctggagctcaagaatgagctctgtcagctgccccccgagggctacgtggtggtggtgaagaatgtggggctgaccctgcggaagctcatcgggagcgtggatgatctcctgccttccttgccgtcatcttcacggacagagatcgagggcacccagaaactgctcaacaaagacctggcagagctcatcaacaagatgcggctggcacagcagaacgccgtgacctccctaagtgaggagtgcaagaggcagatgctgacggcttcacacaccctggctgtggacgccaagaacctgctcgacgctgtggaccaggccaaggttctggccaatctggcccacccacctgcagagtgacggagggtgggggccacctgcctgcgtcttccgcccctgcctgccatgtacctcccctgccttgctgttggtcatgtgggtcttccagggggaaggccaaggggagtcaccttcccttgccactttgcacgacgccctctccccacccctacccctggctgtactgctcaggctgcagctggacagaggggactctgggctatggacacagggtgacggtgacaaagatggctcagagggggactgctgctgcctggccactgctccctaagccagcctggtccatgcagggggctcctgggggtggggaggtgtcacatggtgcccctagctttatatatggacatggcaggccgatttgggaaccaagctattcctttcccttcctcttcggccctcagatgtcccttgatgcacagagaagctggggaggagctttgttttgggggtcaggcagccagtgagatgagggatgggcctggcattcttgtacagtgtatattgaaatttatttaatgtgagtttggtctggactgacagcatgtgccctcctgagggaggacctggggcacagtccaggaacaagctaattgggagtccaggcacaggatgctgtgttgtcaacaaaccaagcatcagggggaagaagcagagagatgcggccaagataggaccttgggccaaatccgctctcttcctgcccctctttctctttcttcctttactttcccttgcttttccctcttttcttactcctcctctttctctccccaacccccattctcatctgcacccttcttttctcatgtgtttgcataaacattcttttaacttctttctatttgacttgtggttgaattaaaattgtcccatttgc

SEQ ID NO: 16810 - DNA, 651 bp, Homo sapiens
  ENST00000522517
tccattcaggaggcactcactggcttcccacctgcggccaggtgcaaggtgtggggacaaggactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccgggagatcatcacctccatcctgctgagcgggcggatcgggcccaacatccggttggctgagtgctatgggctgaggctgaagcacatgaagtccgatgagatccactggctgcacccacagatgacggtgggtgaggtgcaggacaagtatgagtgtctgcacgtggaagccgagtggaggtatgaccttcaaatccgctacttgccagaagacttcatggagagcctgaaggaggacaggaccacgctgctctatttttaccaacagctccggaacgactacatgcagcgctacgccagcaaggtcagcgagggcatggccctgcagctgggctgcctggagctcaggt

SEQ ID NO: 16811 - DNA, 818 bp, Homo sapiens
  ENST00000412793
ccaggaagggcctgcctttgagacttgtcactccctgagatccatcgtggcaccaaatgtttgccgagctccgccctgggagggaggcctgcagcctgggaactgggagacctgggtcccagtggagaggcctcaccatgtagactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccgggagatcatcacctccatcctgctgagcgggcggatcgggcccaacatccggttggctgagtgctatgggctgaggctgaagcacatgaagtccgatgagatccactggctgcacccacagatgacggtgggtgaggtgcaggacaagtatgagtgtctgcacgtggaagccgagtggaggtatgaccttcaaatccgctacttgccagaagacttcatggagagcctgaaggaggacaggaccacgctgctctatttttaccaacagctccggaacgactacatgcagcgctacgccagcaaggtcagcgagggcatggccctgcagctgggctgcctggagctcaggcggttcttcaaggatatgccccacaatgcacttgacaagaagtccaacttcgagctcctagaaaaggaagtggggctggacttgttt

SEQ ID NO: 16812 - DNA, 379 bp, Homo sapiens
  ENST00000496920
ggaagggcctgcctttgagacttgtcactccctgagatccatcgtggcaccaaatgtttgccgagctccgccctgggagggaggcctgcagcctgggaactgggagacctgggtcccagtggagaggcctcaccatgtagtcttatgccacattttgctgcccttgtggactctgagcttggtgctgcctgttgtctgcctgcccctgacctgaaggacatgcccagctccttctctcatccttgcctctcttttgcatcttcgtaatacatattcactttttaaaaaaggaatggctctttgaagctaatggctatctaaatctttcttttctattgtccagcacagtgtgaataaatacatacaggctatgattcca

SEQ ID NO: 16813 - DNA, 3914 bp, Homo sapiens
  ENST00000517339
tctgtcttggagctcggtgggtgctgtccctggggccatgaggtatgtgggcctgtgtggggctctttcagggctgaccctctgctgtctctgcaggactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccgggagatcatcacctccatcctgctgagcgggcggatcgggcccaacatccggttggctgagtgctatgggctgaggctgaagcacatgaagtccgatgagatccactggctgcacccacagatgacggtgggtgaggtgcaggacaagtatgagtgtctgcacgtggaagccgagtggaggtatgaccttcaaatccgctacttgccagaagacttcatggagagcctgaaggaggacaggaccacgctgctctatttttaccaacagctccggaacgactacatgcagcgctacgccagcaaggtcagcgagggcatggccctgcagctgggctgcctggagctcaggcggttcttcaaggatatgccccacaatgcacttgacaagaagtccaacttcgagctcctagaaaaggaagtggggctggacttgtttttcccaaagcagatgcaggagaacttaaagcccaaacagttccggaagatgatccagcagaccttccagcagtacgcctcgctcagggaggaggagtgcgtcatgaagttcttcaacactctcgccggcttcgccaacatcgaccaggagacctaccgctgtgaactcattcaaggatggaacattactgtggacctggtcattggccctaaagggatccgccagctgactagtcaggacgcaaagcccacctgcctggccgagttcaagcagatcaggtccatcaggtgcctcccgctggaggagggccaggcagtacttcagctgggcattgaaggtgccccccaggccttgtccatcaaaacctcatccctagcagaggctgagaacatggctgacctcatagacggctactgccggctgcagggtgagcaccaaggctctctcatcatccatcctaggaaagatggtgagaagcggaacagcctgccccagatccccatgctaaacctggaggcccggcggtcccacctctcagagagctgcagcatagagtcagacatctacgcagagattcccgacgaaaccctgcgaaggcccggaggtccacagtatggcattgcccgtgaagatgtggtcctgaatcgtattcttggggaaggcttttttggggaggtctatgaaggtgtctacacaaatcacaaaggggagaaaatcaatgtagctgtcaagacctgcaagaaagactgcactctggacaacaaggagaagttcatgagcgaggcagtgatcatgaagaacctcgaccacccgcacatcgtgaagctgatcggcatcattgaagaggagcccacctggatcatcatggaattgtatccctatggggagctgggccactacctggagcggaacaagaactccctgaaggtgctcaccctcgtgctgtactcactgcagatatgcaaagccatggcctacctggagagcatcaactgcgtgcacagggacattgctgtccggaacatcctggtggcctcccctgagtgtgtgaagctgggggactttggtctttcccggtacattgaggacgaggactattacaaagcctctgtgactcgtctccccatcaaatggatgtccccagagtccattaacttccgacgcttcacgacagccagtgacgtctggatgttcgccgtgtgcatgtgggagatcctgagctttgggaagcagcccttcttctggctggagaacaaggatgtcatcggggtgctggagaaaggagaccggctgcccaagcctgatctctgtccaccggtcctttataccctcatgacccgctgctgggactacgaccccagtgaccggccccgcttcaccgagctggtgtgcagcctcagtgacgtttatcagatggagaaggacattgccatggagcaagagaggaatgctcgctaccgaacccccaaaatcttggagcccacagccttccaggaacccccacccaagcccagccgacctaagtacagaccccctccgcaaaccaacctcctggctccaaagctgcagttccaggaggaggacttcatccaacccagcagccgagaagaggcccagcagctgtgggaggctgaaaaggtcaaaatgcggcaaatcctggacaaacagcagaagcagatggtggaggactaccagtggctcaggcaggaggagaagtccctggaccccatggtttatatgaatgataagtccccattgacgccagagaaggaggtcggctacctggagttcacagggcccccacagaagcccccgaggctgggcgcacagtccatccagcccacagctaacctggaccggactgatgacctggtgtacctcaatgtcatggagctggtgcgggccgtgctggagctcaagaatgagctctgtcagctgccccccgagggctacgtggtggtggtgaagaatgtggggctgaccctgcggaagctcatcgggagcgtggatgatctcctgccttccttgccgtcatcttcacggacagagatcgagggcacccagaaactgctcaacaaagacctggcagagctcatcaacaagatgcggctggcacagcagaacgccgtgacctccctaagtgaggagtgcaagaggcagatgctgacggcttcacacaccctggctgtggacgccaagaacctgctcgacgctgtggaccaggccaaggttctggccaatctggcccacccacctgcagagtgacggagggtgggggccacctgcctgcgtcttccgcccctgcctgccatgtacctcccctgccttgctgttggtcatgtgggtcttccagggggaaggccaaggggagtcaccttcccttgccactttgcacgacgccctctccccacccctacccctggctgtactgctcaggctgcagctggacagaggggactctgggctatggacacagggtgacggtgacaaagatggctcagagggggactgctgctgcctggccactgctccctaagccagcctggtccatgcagggggctcctgggggtggggaggtgtcacatggtgcccctagctttatatatggacatggcaggccgatttgggaaccaagctattcctttcccttcctcttcggccctcagatgtcccttgatgcacagagaagctggggaggagctttgttttgggggtcaggcagccagtgagatgagggatgggcctggcattcttgtacagtgtatattgaaatttatttaatgtgagtttggtctggactgacagcatgtgccctcctgagggaggacctggggcacagtccaggaacaagctaattgggagtccaggcacaggatgctgtgttgtcaacaaaccaagcatcagggggaagaagcagagagatgcggccaagataggaccttgggccaaatccgctctcttcctgcccctctttctctttcttcctttactttcccttgcttttccctcttttcttactcctcctctttctctccccaacccccattctcatctgcacccttcttttctcatgtgtttgcataaacattcttttaacttctttctatttgacttgtggttgaattaaaattgtcccatttgc

SEQ ID NO: 16814 - DNA, 557 bp, Homo sapiens
  ENST00000521000
cctgatgcttgacctttctccccaccagctccggaacgactacatgcagcgctacgccagcaaggtcagcgagggcatggccctgcagctgggctgcctggagctcaggcggttcttcaaggatatgccccacaatgcacttgacaagaagtccaacttcgagctcctagaaaaggaagtggggctggacttgtttttcccaaagcagatgcaggagaacttaaagcccaaacagttccggaagatgatccagcagaccttccagcagtacgcctcgctcagggaggaggagtgcgtcatgaagttcttcaacactctcgccggcttcgccaacatcgaccaggagacctaccgctgtgaactcattgtaatggcgggctctcttgatcctctccctgacctggattccaggcctctcggaaaagggggccaggagggggcagggagaggctgcaatcgctgcagattctcactcaggcagcaggacctcgctgacctgccgtcggtggaagtcaaaagcatccccttgcctgaagcaggcactgaaatgttggcct

SEQ ID NO: 16815 - DNA, 582 bp, Homo sapiens
  ENST00000519512
ccggaagatgatccagcagaccttccagcagtacgcctcgctcagggaggaggagtgcgtcatgaagttcttcaacactctcgccggcttcgccaacatcgaccaggagacctaccgctgtgaactcattcaaggatggaacattactgtggacctggtcattggccctaaagggatccgccagctgactagtcaggacgcaaagcccacctgcctggccgagttcaagcagatcaggtccatcaggtgcctcccgctggaggagggccaggcagtacttcagctgggcattgaaggtgccccccaggccttgtccatcaaaacctcatccctagcagaggctgagaacatggctgacctcatagacggctactgccggctgcaggatggtgagaagcggaacagcctgccccagatccccatgctaaacctggaggcccggcggtcccacctctcagagagctgcagcatagagtcagacatctacgcagagattcccgacgaaaccctgcgaaggcccggaggtccacagtatggcattgcccgtgaagatgtggtcctgaatcgtattcttggggaagg

SEQ ID NO: 16816 - DNA, 3161 bp, Homo sapiens
  ENST00000397497
ccagcagaccttccagcagtacgcctcgctcagggaggaggagtgcgtcatgaagttcttcaacactctcgccggcttcgccaacatcgaccaggagacctaccgctgtgaactcattgtaatggcgggctctcttgatcctctccctgacctggattccaggcctctcggaaaagggggccaggagggggcagggagaggctgcaatcgctgcagattctcactcaggcagcaggacctcgctgacctgccgtcggtggaagtcaaaagcatccccttgcctgaagcaggcactgaaatgttggcctccagctctgggaggtgggcaggacaggcaaggtgtcaggaggggaagatccatatggccagggtttcggtgagaaggagctggagacccaggaaacagtggcttgtgtctagcttagggagcttttcttcaagtttctgaagaatggggaggacagctctggaacaacagtccactctccttttattccagcaaggatggaacattactgtggacctggtcattggccctaaagggatccgccagctgactagtcaggacgcaaagcccacctgcctggccgagttcaagcagatcaggtccatcaggtgcctcccgctggaggagggccaggcagtacttcagctgggcattgaaggtgccccccaggccttgtccatcaaaacctcatccctagcagaggctgagaacatggctgacctcatagacggctactgccggctgcagggtgagcaccaaggctctctcatcatccatcctaggaaagatggtgagaagcggaacagcctgccccagatccccatgctaaacctggaggcccggcggtcccacctctcagagagctgcagcatagagtcagacatctacgcagagattcccgacgaaaccctgcgaaggcccggaggtccacagtatggcattgcccgtgaagatgtggtcctgaatcgtattcttggggaaggcttttttggggaggtctatgaaggtgtctacacaaatcacaaaggggagaaaatcaatgtagctgtcaagacctgcaagaaagactgcactctggacaacaaggagaagttcatgagcgaggcagtgatcatgaagaacctcgaccacccgcacatcgtgaagctgatcggcatcattgaagaggagcccacctggatcatcatggaattgtatccctatggggagctgggccactacctggagcggaacaagaactccctgaaggtgctcaccctcgtgctgtactcactgcagatatgcaaagccatggcctacctggagagcatcaactgcgtgcacagggacattgctgtccggaacatcctggtggcctcccctgagtgtgtgaagctgggggactttggtctttcccggtacattgaggacgaggactattacaaagcctctgtgactcgtctccccatcaaatggatgtccccagagtccattaacttccgacgcttcacgacagccagtgacgtctggatgttcgccgtgtgcatgtgggagatcctgagctttgggaagcagcccttcttctggctggagaacaaggatgtcatcggggtgctggagaaaggagaccggctgcccaagcctgatctctgtccaccggtcctttataccctcatgacccgctgctgggactacgaccccagtgaccggccccgcttcaccgagctggtgtgcagcctcagtgacgtttatcagatggagaaggacattgccatggagcaagagaggaatgctcgctaccgaacccccaaaatcttggagcccacagccttccaggaacccccacccaagcccagccgacctaagtacagaccccctccgcaaaccaacctcctggctccaaagctgcagttccaggaggaggacttcatccaacccagcagccgagaagaggcccagcagctgtgggaggctgaaaaggtcaaaatgcggcaaatcctggacaaacagcagaagcagatggtggaggactaccagtggctcaggcaggaggagaagtccctggaccccatggtttatatgaatgataagtccccattgacgccagagaaggaggtcggctaccgtgagtgttcccgcccttcttcggggggtttcctcttggcaccttgtgcagagccaccatccttgcccaccgcccagggcagggagcagcggagtctgtctgcattccctgcagcatcggccatgatttaattcagagcatgtggggcaggccagcttcccctccgctccctccaccccattcctctccctgcctagcaccctgcccttctctctctcagtggccacatccttaggcccctcctcagatcatccccctcctgcattagtttggaggagctggaaattctctcttcctcatttcctgctctgttggaagctcccgtgggaaaagttaagcagtgccacctgcctgtcccagttcagattcatcttctgtaggcctgagggacagaggagagaaagtgagaggggcagctgagccctcaggctctctccagaagaccctgttgcaggcagggagggaagagccagcagtaagcccggggcctggaggggtggcattgaggaggaggatgatgacagccatcacagagaactggacacaagtcaggcatgggcctgggaccatttattatcttctgaggcacagggtgattaggtaacttgtccaaattcacacagctaataattggcaaagttcagatttgaacccaagccttctgactttagggtcccttctgagctcaccctcttatcttacaaatgaaaattaaggctcggaatgtgagctgcctagagtggtcacagagctctttggcggcagaggtgagaatagaaggccaggtgtggtggctcacacctgtaatcccagcactttgggaggctgaggtgggagggtcacttgatcccaggagtttgagactggcttgggcaacatagcaagaccccatctctacaaaagattaagaaaattaggcctggtgatgcatgcctgcaagcccagcggctcaggaggccgaggcaggaggattgcctgagcctagaaggtgaggctacagtgagctgtgatcacgccactgtgctccagcctcggtgcaagccctgcctc

SEQ ID NO: 16817 - DNA, 427 bp, Homo sapiens
  ENST00000461615
ctagaggatccttctagccttaatagtgtttgattctctcttcatctcccagagaaactcccagttcctcctcaccccggctcccccatactgaccaatctgcatggcctagtcctggtagtgggatggtctgaagctcccccttcttttcccacagcccacctgcctggccgagttcaagcagatcaggtccatcaggtgcctcccgctggaggagggccaggcagtacttcagctgggcattgaaggtgccccccaggccttgtccatcaaaacctcatccctagcagaggctgagaacatggctgacctcatagacggctactgccggctgcagggtgagcaccaaggctctctcatcatccatcctaggaaagatggtgagaagcggaacagcctgccccagatccccatgctaaacctggag

SEQ ID NO: 16818 - DNA, 270 bp, Homo sapiens
  ENST00000495097
gagcccacctggatcatcatggaattgtatccctatggggagctgggccactacctggagcggaacaagaactccctgaaggtgctcaccctcgtgctgtactcactgcagatatgcaaagccatggcctacctggagagcatcaactgcgtgcacaggtaggggtggagggagtggccagcggtatggaagccaggccttcaccagatcctcaaggcctctgggtagaagcagggcttgtgggtgacacagagcagtgttggaatccca

SEQ ID NO: 16819 - DNA, 499 bp, Homo sapiens
  ENST00000482543
gcaccactgcaatccccccatcttgctgggactttgcctttttcttcctataaaagggacaacagtgctgtccctgactactgcaaaaccagggagaccaggaggttccttcccctgcccgcttcctggattcagagttaatttccctgaagtctcctggtggtagaggggaaggggctcatttgatgtcagcaggtacgaagggaagggttggagtgctgagaactgccccccacttgctgttctttttattgcagtggagttcacagggcccccacagaagcccccgaggctgggcgcacagtccatccagcccacagctaacctggaccggactgatgacctggtgtacctcaatgtcatggagctggtgcgggccgtgctggagctcaagaatgagctctgtcagctgccccccgagggctacgtggtggtggtgaagaatgtggggctgaccctgcggaagctcatcgggagcgtggatgatctcctgccttcc

SEQ ID NO: 16820 - DNA, 762 bp, Homo sapiens
  ENST00000522245
aaagaagagtcctttccaatcgggctggtggtggagttggccacagtggtgcctgcccaggaaagaatcattccgtgcccctggctctccccaactcactggccacctgcgtcttcccctcagtccatccagcccacagctaacctggaccggactgatgacctggtgtacctcaatgtcatggagctggtgcgggccgtgctggagctcaagaatgagctctgtcagctgccccccgagggctacgtggtggtggtgaaggtgagagcagggctgggttggggaggtggaggcggctcaagtccgccctggaaggaaaggggactgcgcttcctgttggctggcccagcagatcctcttagagcaagctgggccaggggaattgagtcccaggccactcgcgggggacaagcaccaccccaggagagctcttcccaggggaaacctggctctctccaatagctaggagtggcggccatcctgcccctttctccccccagaatgtggggctgaccctgcggaagctcatcgggagcgtggatgatctcctgccttccttgccgtcatcttcacggacagagatcgagggcacccagaaactgctcaacaaagacctggcagagctcatcaacaagatgcggctggcacagcagaacgccgtgacctccctaagtgaggagtgcaagaggcagatgctgacggcttcacacaccctggctgtggacgccaagaacctgctcgacgctgtggaccaggccaagg

SEQ ID NO: 16821 - DNA, 3941 bp, Homo sapiens
  ENST00000420218
ccacagcctccggagccgttgcacacctacctgcccggccgacttacctgtacttgccgccgtcccggctcacctggcggtgcccgaggagtagtcgctggagtccgcgcctccctgggactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccgggagatcatcacctccatcctgctgagcgggcggatcgggcccaacatccggttggctgagtgctatgggctgaggctgaagcacatgaagtccgatgagatccactggctgcacccacagatgacggtgggtgaggtgcaggacaagtatgagtgtctgcacgtggaagccgagtggaggtatgaccttcaaatccgctacttgccagaagacttcatggagagcctgaaggaggacaggaccacgctgctctatttttaccaacagctccggaacgactacatgcagcgctacgccagcaaggtcagcgagggcatggccctgcagctgggctgcctggagctcaggcggttcttcaaggatatgccccacaatgcacttgacaagaagtccaacttcgagctcctagaaaaggaagtggggctggacttgtttttcccaaagcagatgcaggagaacttaaagcccaaacagttccggaagatgatccagcagaccttccagcagtacgcctcgctcagggaggaggagtgcgtcatgaagttcttcaacactctcgccggcttcgccaacatcgaccaggagacctaccgctgtgaactcattcaaggatggaacattactgtggacctggtcattggccctaaagggatccgccagctgactagtcaggacgcaaagcccacctgcctggccgagttcaagcagatcaggtccatcaggtgcctcccgctggaggagggccaggcagtacttcagctgggcattgaaggtgccccccaggccttgtccatcaaaacctcatccctagcagaggctgagaacatggctgacctcatagacggctactgccggctgcagggtgagcaccaaggctctctcatcatccatcctaggaaagatggtgagaagcggaacagcctgccccagatccccatgctaaacctggaggcccggcggtcccacctctcagagagctgcagcatagagtcagacatctacgcagagattcccgacgaaaccctgcgaaggcccggaggtccacagtatggcattgcccgtgaagatgtggtcctgaatcgtattcttggggaaggcttttttggggaggtctatgaaggtgtctacacaaatcacaaaggggagaaaatcaatgtagctgtcaagacctgcaagaaagactgcactctggacaacaaggagaagttcatgagcgaggcagtgatcatgaagaacctcgaccacccgcacatcgtgaagctgatcggcatcattgaagaggagcccacctggatcatcatggaattgtatccctatggggagctgggccactacctggagcggaacaagaactccctgaaggtgctcaccctcgtgctgtactcactgcagatatgcaaagccatggcctacctggagagcatcaactgcgtgcacagggacattgctgtccggaacatcctggtggcctcccctgagtgtgtgaagctgggggactttggtctttcccggtacattgaggacgaggactattacaaagcctctgtgactcgtctccccatcaaatggatgtccccagagtccattaacttccgacgcttcacgacagccagtgacgtctggatgttcgccgtgtgcatgtgggagatcctgagctttgggaagcagcccttcttctggctggagaacaaggatgtcatcggggtgctggagaaaggagaccggctgcccaagcctgatctctgtccaccggtcctttataccctcatgacccgctgctgggactacgaccccagtgaccggccccgcttcaccgagctggtgtgcagcctcagtgacgtttatcagatggagaaggacattgccatggagcaagagaggaatgctcgctaccgaacccccaaaatcttggagcccacagccttccaggaacccccacccaagcccagccgacctaagtacagaccccctccgcaaaccaacctcctggctccaaagctgcagttccaggaggaggacttcatccaacccagcagccgagaagaggcccagcagctgtgggaggctgaaaaggtcaaaatgcggcaaatcctggacaaacagcagaagcagatggtggaggactaccagtggctcaggcaggaggagaagtccctggaccccatggtttatatgaatgataagtccccattgacgccagagaaggaggtcggctacctggagttcacagggcccccacagaagcccccgaggctgggcgcacagtccatccagcccacagctaacctggaccggactgatgacctggtgtacctcaatgtcatggagctggtgcgggccgtgctggagctcaagaatgagctctgtcagctgccccccgagggctacgtggtggtggtgaagaatgtggggctgaccctgcggaagctcatcgggagcgtggatgatctcctgccttccttgccgtcatcttcacggacagagatcgagggcacccagaaactgctcaacaaagacctggcagagctcatcaacaagatgcggctggcacagcagaacgccgtgacctccctaagtgaggagtgcaagaggcagatgctgacggcttcacacaccctggctgtggacgccaagaacctgctcgacgctgtggaccaggccaaggttctggccaatctggcccacccacctgcagagtgacggagggtgggggccacctgcctgcgtcttccgcccctgcctgccatgtacctcccctgccttgctgttggtcatgtgggtcttccagggggaaggccaaggggagtcaccttcccttgccactttgcacgacgccctctccccacccctacccctggctgtactgctcaggctgcagctggacagaggggactctgggctatggacacagggtgacggtgacaaagatggctcagagggggactgctgctgcctggccactgctccctaagccagcctggtccatgcagggggctcctgggggtggggaggtgtcacatggtgcccctagctttatatatggacatggcaggccgatttgggaaccaagctattcctttcccttcctcttcggccctcagatgtcccttgatgcacagagaagctggggaggagctttgttttgggggtcaggcagccagtgagatgagggatgggcctggcattcttgtacagtgtatattgaaatttatttaatgtgagtttggtctggactgacagcatgtgccctcctgagggaggacctggggcacagtccaggaacaagctaattgggagtccaggcacaggatgctgtgttgtcaacaaaccaagcatcagggggaagaagcagagagatgcggccaagataggaccttgggccaaatccgctctcttcctgcccctctttctctttcttcctttactttcccttgcttttccctcttttcttactcctcctctttctctccccaacccccattctcatctgcacccttcttttctcatgtgtttgcataaacattcttttaacttctttctatttgacttgtggttgaattaaaattgtcccatttgctttgc

SEQ ID NO: 16822 - DNA, 4272 bp, Homo sapiens
  ENST00000230419
ggcggggcttggcggcggcggcggcggcgcgcggggactcggaggtactgggcgcgcgcggctccggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaacctg

SEQ ID NO: 16823 - DNA, 902 bp, Homo sapiens
  ENST00000476760
cggaggtactgggcgcgcgcggctccggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatgtgagagccaggggggctgtgcccagtccccctgtcagaccctcaatgactgaggcctgggggatccctcccttacctcagcttctcccatttccagttaaacgggccaggcagaatgcatttatcatcagctttttttgctcatgtggataagaggaaattaaaagttatattttttccaaaattttttccttcaagtctgggacccatttatctgctgcatgcttgtgcaaatggaaagggcggccgagcccttggccaagtgtcagacttgacctgccagggaccaggcaggcacttagtatctggtaactgtagccccagcctcagcctccagggcttccttgtgtctg

SEQ ID NO: 16824 - DNA, 4016 bp, Homo sapiens
  ENST00000470019
ggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaacctg

SEQ ID NO: 16825 - DNA, 2412 bp, Homo sapiens
  ENST00000471863
ggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccagtgagcacctttgccctgaaggtcaaggagaggtggaggggaacacaggtctgggtgtgatggacagaggcttccctggtactcacctgaggtcctctcagttctgggccctgcaggcttgggaatcagttcactactgggagtcggtgtagacagtagagagccaggcacaggggttagggtgggtgctccagaggaaatagtgacagccctcacagaaaaatggtcctctgggtacagaggaaagagcaatagactaggaatctagagacctgggtcccactatgctcccaatgcacagagtgacgatggtagcaaatcacccaccttactggggttcagtctcctcatccataaaatggagccagtaatctactacctaccccacaaggtggttggaaaggtcaaatgaagtagatgaaaatgatttttctttttttcttttttgggaggtaatagtggacaaaattataggtgatttttaatttgttttagtttgttatgctttccaaatttctttactaaacatattacttatgaaaaaaaagagggggagaaaagcaagacatatgactgaaagtacacatgataaaccctttatatcaggctgggcgcggtggctcatgcctgtaatcccagcactttgggaggccgagccgggcggatcacaaggtcaggagttggagaccagcctgaccaacatggtgaaaccccatctctactaaaaatacaaaaattagctgggcgtggtggggcacacctgtaatcccagctactcaggaggctgagggaggaaaattgcttgaacccaggaggcagaggttgcaatgagctgagatcgcaccgttgctcttcagcccgggcaacagagtgagactccatctcaaaacaaaacaaaacaaaccttatatcctcactacaggcatagggatttatttgtttacttatttctttataccatgccttgttccaaaccttttgtggtagtttaaaaggatacacaataaaaattacaatatgcacacagagacaca

SEQ ID NO: 16826 - DNA, 3801 bp, Homo sapiens
  ENST00000349241
cgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccaatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagcctttttta

SEQ ID NO: 16827 - DNA, 4023 bp, Homo sapiens
  ENST00000352931
cgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaagacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagcctttttta

SEQ ID NO: 16828 - DNA, 4071 bp, Homo sapiens
  ENST00000345201
cgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagcctttttta

SEQ ID NO: 16829 - DNA, 3958 bp, Homo sapiens
  ENST00000230418
cgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagcctttttta

SEQ ID NO: 16830 - DNA, 5282 bp, Homo sapiens
  ENST00000487673
ccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtgggtatgggctggggagggttatgctgcacaggaagtggtgggcccagacgtttgtcaccttgtactcagcccctgtgtacagaacatggcacagaagccatttttgtggcagcggtggggattcggccgtctcaccatgctgctgcacagtcttagagtccttgctcagagccgggctgtcgtttatttaacatccaacggtcggtgtgtgtgtgtgtgtgttgtgggggagtgggggggtgttctcttcctacaatgctgcctcccaggttcctgcagcagccacacatatctctgggtggctggggaggaggaccaggtcagaatgcagtaggacaaggttcttttctccaggaggcccagagaggatgatgggtcaggtaaaaggccctgcacttaactctctgcccctgggagacttatttctcctctggggacttgtttctgcatccacaggtgaaagtggtttaaatgagaagctcttaaactttcttggtttggcagcagagttatttttctagacaaagtataatgtgaaagtttaaatggatgaaaatgaactgaggaggcccccttggtgggagccactggggtgtgtgtggcagttgggggatcctgcatggtctcccttcattcccctaatgcctcttgaggcccctcagtgtgggccattaaaaggcccctagaccagcagatcccttctacagatctgcttattgaaaaacctgctctgtgccaggcagtgcctggaattctaaacctgaagctcccaaatgctgctctccggggcctggctcacattatcaagtcacttgggaagcttaacaaataacgtgggtttgtggtagctccttgacaggtgtgcttatccgtgtcgcctgtcttggcttccgatgcaaagccagcttgggaacccctggcctcatctccttcagagtcttcgtttgaccttggtggggcatgaggacctgctggcccttgttaaagccagtgaaggtggtgaccctcccgggccatctgttaagttgccctgttgatggggttgggaggagttagtagagaagcagggcttcttttgcttagcagcccctgcccagacccatctgtgtgtctctcagacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttac

SEQ ID NO: 16831 - DNA, 3436 bp, Homo sapiens
  ENST00000481273
cctgagtttttctggtctgagccgagagtttgctcgagaactgccgagagttgctggctctcgggcccagatggggagtttcttgtcgggggagaaaagaccatccgcacccaccgtggggagcgcgatggagaaaaaggaattccccaccccacccggcagggtcggcccaggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctga

SEQ ID NO: 16832 - DNA, 807 bp, Homo sapiens
  ENST00000481946
ttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccagtgagcacctttgccctgaaggtcaaggagaggtggaggggaacacaggtctgggtgtgatggacagaggcttccctgctgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatc

SEQ ID NO: 16833 - DNA, 582 bp, Homo sapiens
  ENST00000490710
aagatgagatttgagtggggacacagccaaaccatatcactctctctcgcacctgcattgccatttgcctcattgcttcccgagctgatctcctgtagttggaacacacacctgcacgtgcacctgagcaagtgtatgcaggcacacacaccagtctggagtgtcagcttccttctctctgccctgttcctggtcgattccttactacatttccgactttgcaggaaaggggttcccttgcattcctttccagaactaggcctattggccactttctccaaattgcactctcccctctgcagccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgccc

SEQ ID NO: 16834 - DNA, 1935 bp, Homo sapiens
  ENST00000489707
gggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaacctg

SEQ ID NO: 16835 - DNA, 854 bp, Homo sapiens
  ENST00000470471
tgggaggctgaggtgggaaaaatcacttgagcctatgagttcgagactgtagtgagccataattgtgtcactctactccagcctgggtgacagagtgagaacctgtcttaaaagaaaaaaaattttaaaaaaggtgctggcacctgggtcttccgtaaagggaaactcctgccatctgaggagcatggggcttctgaactcagggcctagaatggtagtaggatttcttggagatggatcctttagttttggagacctgtgaagcagccttcactgtttccttcctgtctgtctagctgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaag

SEQ ID NO: 16836 - DNA, 2987 bp, Homo sapiens
  ENST00000493339
gtttgtcaccttgtactcagcccctgtgtacagaacatggcacagaagccatttttgtggcagcggtggggattcggccgtctcaccatgctgctgcacagtcttagagtccttgctcagagccgggctgtcgtttatttaacatccaacggtcggtgtgtgtgtgtgtgtgttgtgggggagtgggggggtgttctcttcctacaatgctgcctcccaggttcctgcagcagccacacatatctctgggtggctggggaggaggaccaggtcagaatgcagtaggacaaggttcttttctccaggaggcccagagaggatgatgggtcaggtaaaaggccctgcacttaactctctgcccctgggagacttatttctcctctggggacttgtttctgcatccacaggtgaaagtggtttaaatgagaagctcttaaactttcttggtttggcagcagagttatttttctagacaaagtataatgtgaaagtttaaatggatgaaaatgaactgaggaggcccccttggtgggagccactggggtgtgtgtggcagttgggggatcctgcatggtctcccttcattcccctaatgcctcttgaggcccctcagtgtgggccattaaaaggcccctagaccagcagatcccttctacagatctgcttattgaaaaacctgctctgtgccaggcagtgcctggaattctaaacctgaagctcccaaatgctgctctccggggcctggctcacattatcaagtcacttgggaagcttaacaaataacgtgggtttgtggtagctccttgacaggtgtgcttatccgtgtcgcctgtcttggcttccgatgcaaagccagcttgggaacccctggcctcatctccttcagagtcttcgtttgaccttggtggggcatgaggacctgctggcccttgttaaagccagtgaaggtggtgaccctcccgggccatctgttaagttgccctgttgatggggttgggaggagttagtagagaagcagggcttcttttgcttagcagcccctgcccagacccatctgtgtgtctctcagacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctgggtatgttgccttgactacagctgcccctgcctaactacaagtcacccgctgtgtcttgaggctgggtacgggctagtgttctgaagtccctgaaacctagaatgttagaggtggagggaagcataggtagagatctagcccagtgtggccccagagcctgttattcactgcccttcgtgcagattttgtcattcctgtgtactacctgtagtattatttacttgatgttttatttaaattgactctttaaaaaaaaaaactaagttaccattgttctaggaaaaaatatgagaaatcatgggtttgtcatagttacgttttttcctagcatacgttaagacatgtttaccatgagccaccaaaaattctcatgcgagtcaccctttggaaaatgctgaatattagtcccacccttttattttgttgctgcagacactgaagcctaaggagggagggggtcacagcagaaccgggtctcgtgcccagcccaggtgggtgggtccccactgtgggagaggctaggcccctcccccaggtcaggagctgcctcggcctgggtgaaggtggctggctgactcagactgtacccacagggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctggtatgctgttggcaggggacgtgggggtctcgggtagggagggcagtgtcctacaaaggtgggagtcagtggttggagcaccgtgaaaaccttgtctcgtgcagtctcagccgagacctcacctgcctgctgttacactttgcccaccttatgatgctcagcttctgccttccctgctcttggatgcctgctttccctttatcagcacccagtctttccatctgtatctcaggggcgttggtcctaagtttttctgggacttctcactgtcacactgcagggatgccttccaggtcatcttctctgactcttgttttctttggtttgttattttttcctccccaaaagcttgtccccacttgagaataaatatatcagaacccactttgcctccctccttcctagcaccacttgtgacatgagtgttaccccagccaccagccttctcctctccactcagggtgtcattcccagagctgcgccttcctcttcattccccagctggtccttgccctcaccccatggtcctcaaactgctgcttctcaaatccctagttctggggcaagagcgggcaggagtcctatcagtctttccattaacaagtacttacgcggctgggcacagtggctcacacttgtaatcccagcactttgggagactgaggcaggaggatcgcctgaggccaggagtccgagaccagcctgggcaacatagcaagactctgtctctac

SEQ ID NO: 16837 - DNA, 546 bp, Homo sapiens
  ENST00000461100
acagaacatggcacagaagccatttttgtggcagcggtggggattcggccgtctcaccatgctgctgcacagtcttagagtccttgctcagagccgggctgtcgtttatttaacatccaacggtcgacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtgg

SEQ ID NO: 16838 - DNA, 576 bp, Homo sapiens
  ENST00000494146
acagaacatggcacagaagccatttttgtggcagcggtggggattcggccgtctcaccatgctgctgcacagtcttagagtccttgctcagagccgggctgtcgtttatttaacatccaacgcccctgcccagacccatctgtgtgtctctcagacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggca

SEQ ID NO: 16839 - DNA, 713 bp, Homo sapiens
  ENST00000497957
agaacatggcacagaagccatttttgtggcagcggtggggattcggccgtctcaccatgctgctgcacagtcttagagtccttgctcagagccgggctgtcgtttatttaacatccaacgacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctg

SEQ ID NO: 16840 - DNA, 870 bp, Homo sapiens
  ENST00000473339
attatttcatcatttgggcttgccctttcatgtggagcactgtgattggacccaagttggcaagagtggaagaccaggggacagaacagaaatccccatggtggccagagtgtcaggtctcatcgtgacgctcttgtcctcctccttcccaggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctg

SEQ ID NO: 16841 - DNA, 1035 bp, Homo sapiens
  ENST00000461389
ttatttcatcatttgggcttgccctttcatgtggagcactgtgattggacccaagttggcaagagtggaagaccaggggacagaacagaaatccccatggtggccagagtgtcaggtctcatcgtgacgctcttgtcctcctccttcccaggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcct

SEQ ID NO: 16842 - DNA, 820 bp, Homo sapiens
  ENST00000540667
ggagaagaggtgagagaagaatgggagcgattcgagttataattggttgtgaaggaggggtctaggtacagatgactgaggacggatgaagagaaatagaaggaccaggcgaataaaagtgaggacctgaaggagaagaaggagaaggtggaggagaaggcaagccggaaagagcgaaagaaagaagtggtggaggaggaggagaacggggctgaggaggaagaagaagaaactgccgaggatggagaggaggaagatgaaggggaagaagaagatgaggaagaagaagaagaggatgatgaagggcccgcgctgaagagagctgccgaagaggaggatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggg

SEQ ID NO: 16843 - DNA, 773 bp, Homo sapiens
  ENST00000389462
gcggcagctctgctggtgcgggggcggcgagcccgggatcgagctaccgcggccgagcgcgccggccaccgcctgcaccgcccttccgcccgccctccggacggccgcagccctgcgggtctccgctccagacccacccccgccccaccccgcgcgcctctgccgcctcttccagagacccagcttgccgagcggccgccgctgccgctgtcgccgccgccgccgccaccgcgccaggttccggccgcggccaccctccgccgtccagggcccctccgtctcggccccgggaccccggctccccgccagccccggccccggccccggcaccatgtcggagaaaagcgtggaggcagcggccgagttgagcgccaaggacctgaaggagaagaaggagaaggtggaggagaaggcaagccggaaagagcgaaagaaagaagtggtggaggctccagtcccattggtggtgatggtgggcaaggcatgcagccagcctgaggctactccctctcctggtccccacaggaggaggagaacggggctgaggaggaagaagaagaaactgccgaggatggagaggaggaagatgaaggggaagaagaagatgaggaagaagaagaagaggatgatgaagggcccgcgctgaagagagctgccgaagaggaggatgaagcggatcccaaacggcagaagacagaaaatggggcatcggcgtgagcccctgccaacaggctggggttgggaggcctctctgggcctggaggtgggggtgg

SEQ ID NO: 16844 - DNA, 501 bp, Homo sapiens
  ENST00000540874
cggcagctctgctggtgcgggggcggcgagcccgggatcgagctaccgcggccgagcgcgccggccaccgcctgcaccgcccttccgcccgccctccggacggccgcagccctgcgggtctccgctccagacccacccccgccccaccccgcgcgcctctgccgcctcttccagagacccagcttgccgagcggccgccgctgccgctgtcgccgccgccgccgccaccgcgccaggttccggccgcggccaccctccgccgtccagggcccctccgtctcggccccgggaccccggctccccgccagccccggccccggccccggcaccatgtcggagaaaagcgtggaggcagcggccgagttgagcgccaaggacctgaaggagaagaaggagaaggtggaggagaaggcaagccggaaagagcgaaagaaagaagtggtggaggctccagtcccattggtggtgatggtgggcaaggcatgcagccagcctgaggct

SEQ ID NO: 16845 - DNA, 1139 bp, Homo sapiens
  ENST00000309083
ggcagctctgctggtgcgggggcggcgagcccgggatcgagctaccgcggccgagcgcgccggccaccgcctgcaccgcccttccgcccgccctccggacggccgcagccctgcgggtctccgctccagacccacccccgccccaccccgcgcgcctctgccgcctcttccagagacccagcttgccgagcggccgccgctgccgctgtcgccgccgccgccgccaccgcgccaggttccggccgcggccaccctccgccgtccagggcccctccgtctcggccccgggaccccggctccccgccagccccggccccggccccggcaccatgtcggagaaaagcgtggaggcagcggccgagttgagcgccaaggacctgaaggagaagaaggagaaggtggaggagaaggcaagccggaaagagcgaaagaaagaagtggtggaggaggaggagaacggggctgaggaggaagaagaagaaactgccgaggatggagaggaggaagatgaaggggaagaagaagatgaggaagaagaagaagaggatgatgaagggcccgcgctgaagagagctgccgaagaggaggatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttc

SEQ ID NO: 16846 - DNA, 644 bp, Homo sapiens
  ENST00000540828
cggccgagttgagcgccaaggacctgaaggagaagaaggagaaggtggaggagaaggcaagccggaaagagcgaaagaaagaagtggtggaggaggaggagaacggggctgaggaggaagaagaagaaactgccgaggatggagaggaggaagatgaaggggaagaagaagatgaggaagaagaagaagaggatgatgaagggcccgcgctgaagagagctgccgaagaggaggatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcc

SEQ ID NO: 16847 - DNA, 976 bp, Homo sapiens
  ENST00000538057
gtttggccaagtaggggcctgaggattagggagacacagatggagagaaacaaagaccttagaagctgaaggggaagctgggagggatgcccaggagagagagtcctcaggaaaaggccccagaggacctgaaggagaagaaggagaaggtggaggagaaggcaagccggaaagagcgaaagaaagaagtggtggaggctccagtcccattggtggtgatggtgggcaaggcatgcagccagcctgaggctactccctctcctggtccccacaggaggaggagaacggggctgaggaggaagaagaagaaactgccgaggatggagaggaggaagatgaaggggaagaagaagatgaggaagaagaagaagaggatgatgaagggcccgcgctgaagagagctgccgaagaggaggatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaa

SEQ ID NO: 16848 - DNA, 1150 bp, Homo sapiens
  ENST00000619580
gcggcagctctgctggtgcgggggcggcgagcccgggatcgagctaccgcggccgagcgcgccggccaccgcctgcaccgcccttccgcccgccctccggacggccgcagccctgcgggtctccgctccagacccacccccgccccaccccgcgcgcctctgccgcctcttccagagacccagcttgccgagcggccgccgctgccgctgtcgccgccgccgccgccaccgcgccaggttccggccgcggccaccctccgccgtccagggcccctccgtctcggccccgggaccccggctccccgccagccccggccccggccccggcaccatgtcggagaaaagcgtggaggcagcggccgagttgagcgccaaggacctgaaggagaagaaggagaaggtggaggagaaggcaagccggaaagagcgaaagaaagaagtggtggaggaggaggagaacggggctgaggaggaagaagaagaaactgccgaggatggagaggaggaagatgaaggggaagaagaagatgaggaagaagaagaagaggatgatgaagggcccgcgctgaagagagctgccgaagaggaggatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaa

SEQ ID NO: 16849 - DNA, 1614 bp, Homo sapiens
  ENST00000348225
ttgctccgcagggagagactgcccctggagtattctgcttttaataagcttcccaatcagctctcgagtgcaaagcgctctccctccctcgcccagccttcgtcctcctggcccgctcctctcatccctcccattctccatttcccttccgttccctccctgtcagggcgtaattgagtcaaaggcaggatcaggttccccgccttccagtccaaaaatcccgccaagagagccccagagcagaggaaaatccaaagtggagagaggggaagaaagagaccagtgagtcatccgtccagaaggcggggagagcagcagcggcccaagcaggagctgcagcgagccgggtacctggactcagcggtagcaacctcgccccttgcaacaaaggcagactgagcgccagagaggacgtttccaactcaaaaatgcaggctcaacagtaccagcagcagcgtcgaaaatttgcagctgccttcttggcattcattttcatactggcagctgtggatactgctgaagcagggaagaaagagaaaccagaaaaaaaagtgaagaagtctgactgtggagaatggcagtggagtgtgtgtgtgcccaccagtggagactgtgggctgggcacacgggagggcactcggactggagctgagtgcaagcaaaccatgaagacccagagatgtaagatcccctgcaactggaagaagcaatttggcgcggagtgcaaataccagttccaggcctggggagaatgtgacctgaacacagccctgaagaccagaactggaagtctgaagcgagccctgcacaatgccgaatgccagaagactgtcaccatctccaagccctgtggcaaactgaccaagcccaaacctcaagcagaatctaagaagaagaaaaaggaaggcaagaaacaggagaagatgctggattaaaagatgtcacctgtggaacataaaaaggacatcagcaaacaggatcagttaactattgcatttatatgtaccgtaggctttgtattcaaaaattatctatagctaagtacacaataagcaaaaacaaaaagaaaagaaaatttttgtagtagcgttttttaaatgtatactatagtaccagtaggggcttataataaaggactgtaatcttatttaggaagttgacttatagtacatgataaatgatagacaattgaggtaagttttttgaaattatgtgacattttacattaaattttttttacattttttgggcagcaatttaaatgttatgactatgtaaactacttctcttgttaggtaatttttttcacctagatttttttcccaattgagaaaaatatatactaaacaaaatagcaataaaacataatcactctatttgaagaaaatatcttgttttctgccaatagattttttaaaatgtagtcagcaaaatgggggtggggaagcagagcatgtcctagttcaatgttgactttttttttttttaaagaaaagcattaagacataaaattctttcactttggcagaagcatttgttttcttgatgaaattatttttccatctgaggaaaaaaatactaggaaaataaatcaaggtgatgctgaaaaaaaaa

SEQ ID NO: 16850 - DNA, 1599 bp, Homo sapiens
  ENST00000393083
cccagccttcgtcctcctggcccgctcctctcatccctcccattctccatttcccttccgttccctccctgtcagggcgtaattgagtcaaaggcaggatcaggttccccgccttccagtccaaaaatcccgccaagagagccccagagcagaggaaaatccaaagtggagagaggggaagaaagagaccagtgagtcatccgtccagaaggcggggagagcagcagcggcccaagcaggagctgcagcgagccgggtacctggactcagcggtagcaacctcgccccttgcaacaaaggcagactgagcgccagagaggacgtttccaactcaaaaatgcaggctcaacagtaccagcagcagcgtcgaaaatttgcagctgccttcttggcattcattttcatactggcagctgtggatactgctgaagcagggaagaaagagaaaccagaaaaaaaagtgaagaagtctgactgtggagaatggcagtggagtgtgtgtgtgcccaccagtggagactgtgggctgggcacacgggagggcactcggactggagctgagtgcaagcaaaccatgaagacccagagatgtaagatcccctgcaactggaagaagcaatttggcgcggagtgcaaataccagttccaggcctggggagaatgtgacctgaacacagccctgaagaccagaactggaagtctgaagcgagccctgcacaatgccgaatgccagaagactgtcaccatctccaagccctgtggcaaactgaccaagcccaaacctcaagagaagggaaaatggagacacaggagtggggagagtttgagaagatggtagagaggagtgtttgggtgaagggagatggattcgtctactgatgcaactgcagaatctaagaagaagaaaaaggaaggcaagaaacaggagaagatgctggattaaaagatgtcacctgtggaacataaaaaggacatcagcaaacaggatcagttaactattgcatttatatgtaccgtaggctttgtattcaaaaattatctatagctaagtacacaataagcaaaaacaaaaagaaaagaaaatttttgtagtagcgttttttaaatgtatactatagtaccagtaggggcttataataaaggactgtaatcttatttaggaagttgacttatagtacatgataaatgatagacaattgaggtaagttttttgaaattatgtgacattttacattaaattttttttacattttttgggcagcaatttaaatgttatgactatgtaaactacttctcttgttaggtaatttttttcacctagatttttttcccaattgagaaaaatatatactaaacaaaatagcaataaaacataatcactctatttgaagaaaatatcttgttttctgccaatagattttttaaaatgtagtcagcaaaatgggggtggggaagcagagcatgtcctagttcaatgttgactttttttttttttaaagaaaagcattaagacataaaattctttcactttggcagaagcatttgttttcttgatgaaattatttttccatctgaggaaaaaaatactaggaaaataaa

SEQ ID NO: 16851 - DNA, 532 bp, Homo sapiens
  ENST00000639568
gacttgagttgccttgtctggtatccttatgcagaatgaactgaaataatcatcaatctgaaaagctactcttaaacagagacttgcttcaacaccaggaagaacatgaaagggtgactcataattcccagcagcagtgccagttcatgtgctgggattctgaccacaagcctaacaatcaggtcagggagtcagatttctgttggatttagaaaagcatctatgtgtttatgaaagaaacccactggatttttaatagttctgcagctcttggaggctctacatctaccctttctccccagccaagagcatggctatgggagaaggaaggcaggcagcaggcagggcagtgtgcccgccctctctttctggagtataaaaggagttgtgagaggcttgggtcaccatttggtgagctgagggtgaagctacaaaggttgaagcgttcttcagacgactctacctgagggtgaagctacaaaaattgaagcgttcttcagacgactctacctgaagaaagaaccctgctaca

SEQ ID NO: 16852 - DNA, 479 bp, Homo sapiens
  ENST00000470661
ttgtctggtatccttatgcagaatgaactgaaataatcatcaatctgaaaagctactcttaaacagagacttgcttcaacaccaggaagaacatgaaagggtgactcataattcccagcagcagtgccagttcatgtgctgggattctgaccacaagcctaacaatcaggtcagggagtcagatttctgttggatttagaaaagcatctatgtgtttatgaaagaaacccactggatttttaatagttctgcagctcttggaggctctacatctaccctttctccccagccaagagcatggctatgggagaaggaaggcaggcagcaggcagcaattctgtggtgttcttggtcacacatttatggagtttctgaagggcagtggagattactgccaggcacagcacgacctctatgcagacaagtgaactgtagaaactgattactgctccaccaagaagcccccataagagtggtta

SEQ ID NO: 16853 - DNA, 5088 bp, Homo sapiens
  ENST00000370651
aaagatgaccgtggttaaggcagtagaaagcaggctcgacactgagacgcggttccagccctagaaggattgcattttacgattcaggcaaacttcgagtctcctcatgtgacatgtgtgcactcctggaccgttttaattatgagaaacgtggtttgcagcatgattccttccagtcgataaatcggaatctctctcgctcccaccccttcttaacttcaggcttcctgcatcccggagcactcccggcagccccttccctcccccgccccggggatgctccgactcggcgcttagccattcatcaaccggttcacaccggcggcggccgccgcggagtgacgtccggagggggcgggcctccgcccccgcctgtcggctcctggcccgcggttccaggccgcgattggtggctggagggttgcacgtcgcgccggctataaaggggagggcttgtgacgcaagggcgcctcggcgcgtgtattggctccttcggctgcgggccggctcggctacgcgctctgctccgagccgctcactgcatggtagagtctggtgcccccgccgccgcctgcatcgccgccaccgccgctccgccacgaccaccgccgcctcctgccctgcagccaccgccaccgcctgtgtcgccgccgcctcgggaccggctgtatgattaggccacaatcttcaatgagtaaacatattcctcaattctgtggtgttcttggtcacacatttatggagtttctgaagggcagtggagattactgccaggcacagcacgacctctatgcagacaagtgaactgtagaaactgattactgctccaccaagaagcccccataagagtggttatcctggacacagaagtgttgaattgaaatccacagagcattttacaagagttctgacctggatggggtaaacctcagtgcacttcttttctgttggcctcagtattactggattgaagaattgctgcttcttgttaggaggttcatttcacttatcattacttacaacttcatactcaaagcactgagaatttcaagtggagtatattgaagtagacttcagtttctttgcatcatttctgtattcaatttttttaattatttcataaccctattgagtgttttttaactaaattaacatggctcgaatgaaccgcccagctcctgtggaagtcacatacaagaacatgagatttcttattacacacaatccaaccaatgcgaccttaaacaaatttatagaggaacttaagaagtatggagttaccacaatagtaagagtatgtgaagcaacttatgacactactcttgtggagaaagaaggtatccatgttcttgattggccttttgatgatggtgcaccaccatccaaccagattgttgatgactggttaagtcttgtgaaaattaagtttcgtgaagaacctggttgttgtattgctgttcattgcgttgcaggccttgggagagctccagtacttgttgccctagcattaattgaaggtggaatgaaatacgaagatgcagtacaattcataagacaaaagcggcgtggagcttttaacagcaagcaacttctgtatttggagaagtatcgtcctaaaatgcggctgcgtttcaaagattccaacggtcatagaaacaactgttgcattcaataaaattggggtgcctaatgctactggaagtggaacttgagatagggcctaatttgttatacatattagccaacatgttggcttagtaagtctaatgaagcttccataggagtattgaaaggcagttttaccaggcctcaagctagacagatttggcaacctctgtatttgggttacagtcaacctatttggatacttggcaaaagattcttgctgtcagcatataaaatgtgcttgtcatttgtatcaattgacctttccccaaatcatgcagtattgagttatgacttgttaaatctattcccatgccagaatcttatcaatacataagaaatttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggttatttgcctgctcactttatgtttacatctcccacattcataccaatatacgtcaggtttgcttaaccattgatttttttttttttttaccaagtcttacagtgattattttacgtgtttccatgtatctcactttgtgctgtattaaaaaaacctccattttgaaaatctacgttgtacagaagcacatgtctttaatgtcttcagacaaaaaagccttacattaatttaatgtttgcactctgaggtgcaacttaacagggagggcctgagaaaagaatgggagggggctattaattatttttagcaaaatgttgcctttgtcttgtgcaaacatgtagaatatgctctttaatttagtaaaatatttttttaaaaggtagagatgctttgttattgtaatcataaacttcctgaaattcttgtaatttttttcccatacttatcagaagtgtgtttaccaacttatttttgtttgaaagtgtgattttttttttccttcccaacctctcttgcaaaaaaagaaatgggtttctgctaatgaattgagcagacatctaatattttatatgccttttgagctgtgtaacttaatatttggatacttgacaatttgttttattatgtaattgataaaatggtgatgtgtattaatgttagttcaaccatatatttatactgtctggggatgtgtggttatagttctgtgggagaaataattttgtcagtgttcaccagcttgtaaaaacttagtgcgagagctgaaacatctaaataaataatgacatgcatttatcatcattgagattggtttgcttaaaattaacttattttgtagaagacaaaatgaattgcacttcacttaatgtgtgtcctcatctttttacaaataaatgaaggattataaatgatgtcagcattttagtaaacttttagacaaaatttgttagggtcattcatgaaaactttaatactaaaagcactttccattatatactttttaaaggtctagataattttgaaccaatttattattgtgtactgaggagaaataatgtatagtagaggacagccttggtttgtaaagctcagttccactagttcatggttttgtgcaacttctgagcctcagttttctcctttgcaaattaataattacatacctttatagattttgaaattaatttaaatattagtatttggtacatgaaggcttaatgttaagtttcctttaatgatccacaataatccctttgatcacgttaatctaaatctagatgtctttgtctaattttttttgaatagcagttataaatgtaaaggactcaaagtttaagtaaaaagtgatactccaccttgtgtttcaaagaatttagttccacctcttcataccagtttaacacttaatatatttcattggattttagacagggcaaaaggaagaacaggggcctctggaggcccttggttatttaaatcttggattatttgtgatagtaatcacaaatttttggctaatttttaacctgaggttttgttttttttttaaaggaaatgcagcctagtcttgagaacataattttatataatcaattactaaatgttaaactattaccacacagcccataaaacagcatttgcgtttattgagagagaggatgtgccatcatgattaatgaaaactatcttttgagtttgaaaagaaattaatttgcagtgtttggattgtatatatggtgctaaaaataaattaatttactttataaaccttatctgtacattatacgatgtgatgaaatttgctttttatccaaatattttgtatcttgtaaatatggctaattataggaatgcctataatacatcttagattccttatatctaataagagttcaaagagttatgagttgaagtcttgaatgcaggaaactatctgatagtgttctaaaatttggttacttgggtttggatacccttagtgggatgatgtaaatagaggctagctacctaggcttgtctatagcaaccataatgttgatgtaagtaatgcggttactgaatcataagaaaatgccatctctttttagttgaaggaaaactctggaagtaggtgccattggtcattctgcagtgcactgcaaccattgtttcccctagtgccctcttttccctagggcattgctctcctattcccacgccttaacacagctctatacctagaagcagccagcccaggcatgcagtcacatttaatcacatcccccttctagagtgcttcaaaatgatgtagtccctcaacttggctaaagaatctcaatctcttgaaatttatttttttaatgtcatattcatctggtaaatatctactgtttgccaggcatttaagaatatggcaaagaacataaaagatggtgtcaccagattttggtcaccaatgagtacccgacccgttgccatgattaagagagaatgctttctattggagtttcaggaaatataatttgagaatactttaaagggaagtggaagtataagtgaatgatatttttcttttacatgtaaacaatgaagttatttcaaagttaagttttaaacaaaatacatgaagtagtgtctgccatacatgttaatattctacattcttgcttccttaaattaatatgtttgtgtgtatatatgtgcctcacacctgaattgaaaattaaagactggtttaaaagtggtttaaaagtgacatttaatgtttctccattacgtttggggtaaccagcctaagtggaatcttggaaggaaagtaagggaaaaacttgtatttgccttcaatgaattaaaccagtgatatgtgttaacgtatgaatgaaaggattgatggtgattttataattatatatattgccgcagtaaccagttaataaattgatagctaccattt

SEQ ID NO: 16854 - DNA, 135 bp, Homo sapiens
  ENST00000578299
atgattaggccacaatcttcaatgagtaaacatattcctcaattctgtggtgttcttggtcacacatttatggagtttctgaagggcagtggagattactgccaggcacagcacgacctctatgcagacaagtga

SEQ ID NO: 16855 - DNA, 638 bp, Homo sapiens
  ENST00000473334
actgcggagccggatacggggagggcgcggcggtggcgggttcgcctccagatccgggcgggcgtggggtaggccggacagccaggcacgggtggtaacgatctggttccagagcttctcggagctccggggtgggcgcgggacagccactgggtgcagctacactcttgtgctcgacggccgggacccgagcctcagacaaaatggcctcggcgcccgcgcctgactgaaggcgcggcgcgaacccgtgattgcggcgcggagagggggcgcagcgggcgtgctcgggcgcacacagccgcgtgcgcggggcggcggccctctggggcattccgcgagctgcacccctgcccgggccagagtggggttctgctagcaattctgtggtgttcttggtcacacatttatggagtttctgaagggcagtggagattactgccaggcacagcacgacctctatgcagacaagtgaactgtagaaactgattactgctccaccaagaagcccccataagagtggttatcctggacacagaagtgttgaattgaaatccacagagcattttacaagagttctgacctggatggggtaaacctcagtgcacttcttttctgttggcctcagtattactggattg

SEQ ID NO: 16856 - DNA, 2203 bp, Homo sapiens
  ENST00000626021
gagattactgccaggcacagcacgacctctatgcagacaagtgaactgtagaaactgattactgctccaccaagaagcccccataagagtggttatcctggacacagaagtgttgaattgaaatccacagagcattttacaagagttctgacctggatggggtaaacctcagtgcacttcttttctgttggcctcagtattactggattgaagaattgctgcttcttgttaggaggttcatttcacttatcattacttacaacttcatactcaaagcactgagaatttcaagtggagtatattgaagtagacttcagtttctttgcatcatttctgtattcaatttttttaattatttcataaccctattgagtgttttttaactaaattaacatggctcgaatgaaccgcccagctcctgtggaagtcacatacaagaacatgagatttcttattacacacaatccaaccaatgcgaccttaaacaaatttatagaggaacttaagaagtatggagttaccacaatagtaagagtatgtgaagcaacttatgacactactcttgtggagaaagaaggtatccatgttcttgattggccttttgatgatggtgcaccaccatccaaccagattgttgatgactggttaagtcttgtgaaaattaagtttcgtgaagaacctggttgttgtattgctgttcattgcgttgcaggccttgggagagctccagtacttgttgccctagcattaattgaaggtggaatgaaatacgaagatgcagtacaattcataagacaaaagcggcgtggagcttttaacagcaagcaacttctgtatttggagaagtatcgtcctaaaatgcggctgcgtttcaaagattccaacggtcatagaaacaactgttgcattcaataaaattggggtgcctaatgctactggaagtggaacttgagatagggcctaatttgttatacatattagccaacatgttggcttagtaagtctaatgaagcttccataggagtattgaaaggcagttttaccaggcctcaagctagacagatttggcaacctctgtatttgggttacagtcaacctatttggatacttggcaaaagattcttgctgtcagcatataaaatgtgcttgtcatttgtatcaattgacctttccccaaatcatgcagtattgagttatgacttgttaaatctattcccatgccagaatcttatcaatacataagaaatttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggttatttgcctgctcactttatgtttacatctcccacattcataccaatatacgtcaggtttgcttaaccattgatttttttttttttttaccaagtcttacagtgattattttacgtgtttccatgtatctcactttgtgctgtattaaaaaaacctccattttgaaaatctacgttgtacagaagcacatgtctttaatgtcttcagacaaaaaagccttacattaatttaatgtttgcactctgaggtgcaacttaacagggagggcctgagaaaagaatgggagggggctattaattatttttagcaaaatgttgcctttgtcttgtgcaaacatgtagaatatgctctttaatttagtaaaatatttttttaaaaggtagagatgctttgttattgtaatcataaacttcctgaaattcttgtaatttttttcccatacttatcagaagtgtgtttaccaacttatttttgtttgaaagtgtgattttttttttccttcccaacctctcttgcaaaaaaagaaatgggtttctgctaatgaattgagcagacatctaatattttatatgccttttgagctgtgtaacttaatatttggatacttgacaatttgttttattatgtaattgataaaatggtgatgtgtattaatgttagttcaaccatatatttatactgtctggggatgtgtggttatagttctgtgggagaaataattttgtcagtgttcaccagcttgtaaaaacttagtgcgagagctgaaacatctaaataaataatgacatgcatttatcatcattgaga

SEQ ID NO: 16857 - DNA, 447 bp, Homo sapiens
  ENST00000627002
atggctcgaatgaaccgcccagctcctgtggaagtcacatacaagaacatgagatttcttattacacacaatccaaccaatgcgaccttaaacaaatttatagaggaacttaagaagtatggagttaccacaatagtaagagtatgtgaagcaacttatgacactactcttgtggagaaagaaggtatccatgttcttgattggccttttgatgatggtgcaccaccatccaaccagattgttgatgactggttaagtcttgtgaaaattaagtttcgtgaagaacctggttgttgtattgctgttcattgcgttgcaggccttgggagaaagcggcgtggagcttttaacagcaagcaacttctgtatttggagaagtatcgtcctaaaatgcggctgcgtttcaaagattccaacggtcatagaaacaactgttgcattcaataa

SEQ ID NO: 16858 - DNA, 1717 bp, Homo sapiens
  ENST00000633518
ctaagccggtggagccgcggccgcgcctgtgcgcgagggcgcgcgcgtcccgagccctccacccgtcgtgccggcgccgcccggaccgccagatgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtaacgtgacacaggccccacacgtcagaggccgctgtccccacggccactgcccgtgacccctggcccaaggcagctggagttggttcagttcaagttcattcttcctctggcccttgggggcttggggcccacctctgagtgaagggggctgtctgcccatccaccaatgtggagagggcgcccccggtgtggggtccagctctggacactgcttggcggccgggttcactttgagtttttaagttttctttgctgagcttttttggttgttctttttattttttgcctctttatgactatccagctctgagagacgggagtttggagttgcccgctttactttggttgggttggggggggcggcgggctgttttgttccttttcttttttaagagttgggttttcttttttaattatccaaacagtgggcagcttcctcccccacacccaagtatttgcacaatatttgtgcggggtatgggggtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggacctgaagaagtacggggctaccactgtggtgcgtgtgtgtgaagtgacctatgacaaaacgccgctggagaaggatggcatcaccgttgtggactggccgtttgacgatggggcgcccccgcccggcaaggtagtggaagactggctgagcctggtgaaggccaagttctgtgaggcccccggcagctgcgtggctgtgcactgcgtggcgggcctgggccgggctccagtccttgtggcgctggcccttattgagagcgggatgaagtacgaggacgccatccagttcatccgccagaagcgccgcggagccatcaacagcaagcagctcacctacctggagaaataccggcccaaacagaggctgcggttcaaagacccacacacgcacaagacccggtgctgcgttatgtagctcaggaccttggctgggcctggtcgtcatgtaggtcaggaccttggctggacctggaggccctgcccagccctgctctgcccagcccagcaggggctccaggccttggctggccccacatcgccttttcctccccgacacctccgtgcacttgtgtccgaggagcgaggagcccctcgggccctgggtggcctctgggccctttctcctgtctccgccactccctctggcggcgctggccgtggctctg

SEQ ID NO: 16859 - DNA, 1866 bp, Homo sapiens
  ENST00000633621
aagccggtggagccgcggccgcgcctgtgcgcgagggcgcgcgcgtcccgagccctccacccgtcgtgccggcgccgcccggaccgccagatgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtaacgtgacacaggccccacacgtcagaggccgctgtccccacggccactgcccgtgacccctggcccaaggcagctggagttggttcagttcaagttcattcttcctctggcccttgggggcttggggcccacctctgagtgaagggggctgtctgcccatccaccaatgtggagagggcgcccccggtgtggggtccagctctggacactgcttggcggccgggttcactttgagtttttaagttttctttgctgagcttttttggttgttctttttattttttgcctctttatgactatccagctctgagagacgggagtttggagttgcccgctttactttggttgggttggggggggcggcgggctgttttgttccttttcttttttaagagttgggttttcttttttaattatccaaacagtgggcagcttcctcccccacacccaagtatttgcacaatatttgtgcggggtatgggggtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggacctgaagaagtacggggctaccactgtggtgcgtgtgtgtgaagtgacctatgacaaaacgccgctggagaaggatggcatcaccgttgtggactggccgtttgacgatggggcgcccccgcccggcaaggtagtggaagactggctgagcctggtgaaggccaagttctgtgaggcccccggcagctgcgtggctgtgcactgcgtggcgggcctgggccggaagcgccgcggagccatcaacagcaagcagctcacctacctggagaaataccggcccaaacagaggctgcggttcaaagacccacacacgcacaagacccggtgctgcgttatgtagctcaggaccttggctgggcctggtcgtcatgtaggtcaggaccttggctggacctggaggccctgcccagccctgctctgcccagcccagcaggggctccaggccttggctggccccacatcgccttttcctccccgacacctccgtgcacttgtgtccgaggagcgaggagcccctcgggccctgggtggcctctgggccctttctcctgtctccgccactccctctggcggcgctggccgtggctctgtctctctgaggtgggtcgggcgccctctgcccgccccctcccacaccagccaggctggtctcctctagcctgtttgttgtggggtgggggtatattttgtaaccactgggcccccagcccctcttttgcgaccccttgtcctgacctgttctcggcaccttaaattattagaccccggggcagtcaggtgctccggacacccgaaggcaataaaacaggagccgtg

SEQ ID NO: 16860 - DNA, 558 bp, Homo sapiens
  ENST00000633262
gtgcgcgagggcgcgcgcgtcccgagccctccacccgtcgtgccggcgccgcccggaccgccagatgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggacctgaagaagtacggggctaccactgtggtgcgtgtgtgtgaagtgacctatgacaaaacgccgctggagaaggatggcatcaccgttgtggactggccgtttg

SEQ ID NO: 16861 - DNA, 514 bp, Homo sapiens
  ENST00000633366
gaatgaaactccatgccctccgggacaccatgcccacttctgggtactggccttcaggggccttggatgtgggtggcatggcactggctaaatggggcccaggaggaaggcagcaggaccgtgggcatgcaggcctaatgccagggccagggcaggcttcatgtgggcttcctcctgtctggaatcctggagccgcacaatttccgacccaacaccccgtactccagagcgactggctcttaacggaagctgctgctggcagatgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtaacgtgacacaggccccacacgtcaga

SEQ ID NO: 16862 - DNA, 542 bp, Homo sapiens
  ENST00000634147
ctctggccgggaccagggtgcccgccgcagccctgggaccctgcggccccggtccctattcgaggccccagccggagcgttccgggatccttcgggggagtgcccagccccgcgcccccgcctcccacatgactccggatgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtaacgtgacacaggccccacacgtcagaggccgctgtccccacggccactgcccgtgacccctggcccaaggcagctggagttggttcagttcaagttcattcttcctctggcccttgggggcttggggcccacctctgagtgaagggggctgtctgcccatccaccaatgtggagaggg

SEQ ID NO: 16863 - DNA, 575 bp, Homo sapiens
  ENST00000632997
gggagggccggcgcaggcggggataaagcccgcggcgcggctcggctgactcggagcgcggaggaccggcctgccggatgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtaacgtgacacaggccccacacgtcagaggccgctgtccccacggccactgcccgtgacccctggcccaaggcagctggagttggttcagttcaagttcattcttcctctggcccttgggggcttggggcccacctctgagtgaagggggctgtctgcccatccaccaatgtggagagggcgcccccggtgtggggtccagctctggacactgcttggcggccgggttcactttgagtttttaagttttctttgctgagcttttttggttgttc

SEQ ID NO: 16864 - DNA, 606 bp, Homo sapiens
  ENST00000633470
ggcagcgcctggagccggctccgcggcggaggggcggcgccccgacccaggcccagcaccgtgggcaccgccaggccggcgcgtatggaggcggtgggacgcctgcggcgcggatgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtaacgtgacacaggccccacacgtcagaggccgctgtccccacggccactgcccgtgacccctggcccaaggcagctggagttggttcagttcaagttcattcttcctctggcccttgggggcttggggcccacctctgagtgaagggggctgtctgcccatccaccaatgtggagagggcgcccccggtgtggggtccagctctggacactgcttggcggccgggttcactttgagtttttaagttttctttgctgagcttttttggt

SEQ ID NO: 16865 - DNA, 576 bp, Homo sapiens
  ENST00000632834
agcgcctggagccggctccgcggcggaggggcggcgccccgacccaggcccagcaccgtgggcaccgccaggccggcgcgtatggaggcggtgggacgcctgcggcgcgggtgagcctggcagatgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtaacgtgacacaggccccacacgtcagaggccgctgtccccacggccactgcccgtgacccctggcccaaggcagctggagttggttcagttcaagttcattcttcctctggcccttgggggcttggggcccacctctgagtgaagggggctgtctgcccatccaccaatgtggagagggcgcccccggtgtggggtccagctctggacactgcttggcggccgggttc

SEQ ID NO: 16866 - DNA, 547 bp, Homo sapiens
  ENST00000633677
cgcggcggaggggcggcgccccgacccaggcccagcaccgtgggcaccgccaggccggcgcgtatggaggcggtgggacgcctgcggcgcggggcgctgcgtgttgttcctgcctcctagatttgagccagagagaacccagttaactggacgcctgatgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtaacgtgacacaggccccacacgtcagaggccgctgtccccacggccactgcccgtgacccctggcccaaggcagctggagttggttcagttcaagttcattcttcctctggcccttgggggcttggggcccacctctgagtgaagggggctgtctgcccatccac

SEQ ID NO: 16867 - DNA, 2710 bp, Homo sapiens
  ENST00000614325
atgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtaacgtgacacaggccccacacgtcagaggccgctgtccccacggccactgcccgtgacccctggcccaaggcagctggagttggttcagttcaagttcattcttcctctggcccttgggggcttggggcccacctctgagtgaagggggctgtctgcccatccaccaatgtggagagggcgcccccggtgtggggtccagctctggacactgcttggcggccgggttcactttgagtttttaagttttctttgctgagcttttttggttgttctttttattttttgcctctttatgactatccagctctgagagacgggagtttggagttgcccgctttactttggttgggttggggggggcggcgggctgttttgttccttttcttttttaagagttgggttttcttttttaattatccaaacagtgggcagcttcctcccccacacccaagtatttgcacaatatttgtgcggggtatgggggtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggacctgaagaagtacggggctaccactgtggtgcgtgtgtgtgaagtgacctatgacaaaacgccgctggagaaggatggcatcaccgttgtggactggccgtttgacgatggggcgcccccgcccggcaaggtagtggaagactggctgagcctggtgaaggccaagttctgtgaggcccccggcagctgcgtggctgtgcactgcgtggcgggcctgggccggaagcgccgcggagccatcaacagcaagcagctcacctacctggagaaataccggcccaaacagaggctgcggttcaaagacccacacacgcacaagacccggtgctgcgttatgtagctcaggaccttggctgggcctggtcgtcatgtaggtcaggaccttggctggacctggaggccctgcccagccctgctctgcccagcccagcaggggctccaggccttggctggccccacatcgccttttcctccccgacacctccgtgcacttgtgtccgaggagcgaggagcccctcgggccctgggtggcctctgggccctttctcctgtctccgccactccctctggcggcgctggccgtggctctgtctctctgaggtgggtcgggcgccctctgcccgccccctcccacaccagccaggctggtctcctctagcctgtttgttgtggggtgggggtatattttgtaaccactgggcccccagcccctcttttgcgaccccttgtcctgacctgttctcggcaccttaaattattagaccccggggcagtcaggtgctccggacacccgaaggcaataaaacaggagccgtggccgtgtgtgtggagtgggctacagcgtcaggcggggcgggctggtggcctgggggccccagaggctgctgtctggatcctgggctggtgcccaggatggggctcccgcgtgctcttgcgctgccctctggtggccgctctgggtccttgcaccccgacccaggggccagcctgccctgtcctgtcctgataccgaggtgggagccctgccttggccagggtggccgtgttgacggttcttgggactgtgacattggaaggcgaggcaggtcaccagcactgtcctctgcaggatgggctgggattcatttggcagcttctcagggcctgtgtccggctggttggtccctgtgctgcccaaaccaggtgtccacatttccggctccgaggcgcagagaagggggcaggtggtggcttgggtggaggaagtcaccatccatcagcccagggagggagggtgccacctgggcacctggggctggatgtgagaggcctggaccagggcccgccggagggcgtggaccagatgctcatgtgttcctgggtgcagtgtctgtgttgggggctggccccaccctgggccggggtgcatggagggcatggccccagcggggaggaaggtgggcctagggctggctccagggtgtggagagcctgggagtggtctccgtcctggggccccaggaggttcccgcaaggagcgactggggcaggtgctggaggaggtcagtggacaagatggggagatgtggaaaccccaaaagccccttctcaggcagccctgcccccaagaccgacagatggctaagggggccgcagacctggctcccccagctcctgtgtggagaaagggcaacagctgtcccggatggttattctctcctttcctcaaacacatttggaactcaagtaaatccaatgcatgttgggtgaa

SEQ ID NO: 16868 - DNA, 2785 bp, Homo sapiens
  ENST00000622569
atgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtaacgtgacacaggccccacacgtcagaggccgctgtccccacggccactgcccgtgacccctggcccaaggcagctggagttggttcagttcaagttcattcttcctctggcccttgggggcttggggcccacctctgagtgaagggggctgtctgcccatccaccaatgtggagagggcgcccccggtgtggggtccagctctggacactgcttggcggccgggttcactttgagtttttaagttttctttgctgagcttttttggttgttctttttattttttgcctctttatgactatccagctctgagagacgggagtttggagttgcccgctttactttggttgggttggggggggcggcgggctgttttgttccttttcttttttaagagttgggttttcttttttaattatccaaacagtgggcagcttcctcccccacacccaagtatttgcacaatatttgtgcggggtatgggggtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggacctgaagaagtacggggctaccactgtggtgcgtgtgtgtgaagtgacctatgacaaaacgccgctggagaaggatggcatcaccgttgtggactggccgtttgacgatggggcgcccccgcccggcaaggtagtggaagactggctgagcctggtgaaggccaagttctgtgaggcccccggcagctgcgtggctgtgcactgcgtggcgggcctgggccgggctccagtccttgtggcgctggcccttattgagagcgggatgaagtacgaggacgccatccagttcatccgccagaagcgccgcggagccatcaacagcaagcagctcacctacctggagaaataccggcccaaacagaggctgcggttcaaagacccacacacgcacaagacccggtgctgcgttatgtagctcaggaccttggctgggcctggtcgtcatgtaggtcaggaccttggctggacctggaggccctgcccagccctgctctgcccagcccagcaggggctccaggccttggctggccccacatcgccttttcctccccgacacctccgtgcacttgtgtccgaggagcgaggagcccctcgggccctgggtggcctctgggccctttctcctgtctccgccactccctctggcggcgctggccgtggctctgtctctctgaggtgggtcgggcgccctctgcccgccccctcccacaccagccaggctggtctcctctagcctgtttgttgtggggtgggggtatattttgtaaccactgggcccccagcccctcttttgcgaccccttgtcctgacctgttctcggcaccttaaattattagaccccggggcagtcaggtgctccggacacccgaaggcaataaaacaggagccgtggccgtgtgtgtggagtgggctacagcgtcaggcggggcgggctggtggcctgggggccccagaggctgctgtctggatcctgggctggtgcccaggatggggctcccgcgtgctcttgcgctgccctctggtggccgctctgggtccttgcaccccgacccaggggccagcctgccctgtcctgtcctgataccgaggtgggagccctgccttggccagggtggccgtgttgacggttcttgggactgtgacattggaaggcgaggcaggtcaccagcactgtcctctgcaggatgggctgggattcatttggcagcttctcagggcctgtgtccggctggttggtccctgtgctgcccaaaccaggtgtccacatttccggctccgaggcgcagagaagggggcaggtggtggcttgggtggaggaagtcaccatccatcagcccagggagggagggtgccacctgggcacctggggctggatgtgagaggcctggaccagggcccgccggagggcgtggaccagatgctcatgtgttcctgggtgcagtgtctgtgttgggggctggccccaccctgggccggggtgcatggagggcatggccccagcggggaggaaggtgggcctagggctggctccagggtgtggagagcctgggagtggtctccgtcctggggccccaggaggttcccgcaaggagcgactggggcaggtgctggaggaggtcagtggacaagatggggagatgtggaaaccccaaaagccccttctcaggcagccctgcccccaagaccgacagatggctaagggggccgcagacctggctcccccagctcctgtgtggagaaagggcaacagctgtcccggatggttattctctcctttcctcaaacacatttggaactcaagtaaatccaatgcatgttgggtgaa

SEQ ID NO: 16869 - DNA, 1717 bp, Homo sapiens; identical to SEQ ID NO: 16858
  ENST00000521578

SEQ ID NO: 16870 - DNA, 1866 bp, Homo sapiens; identical to SEQ ID NO: 16859
  ENST00000520105

SEQ ID NO: 16871 - DNA, 558 bp, Homo sapiens; identical to SEQ ID NO: 16860
  ENST00000523147

SEQ ID NO: 16872 - DNA, 963 bp, Homo sapiens
  ENST00000524028
cttttttaattatccaaacagtgggcagcttcctcccccacacccaagtatttgcacaatatttgtgcggggtatgggggtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgagagcgggatgaagtacgaggacgccatccagttcatccgccagaagcgccgcggagccatcaacagcaagcagctcacctacctggagaaataccggcccaaacagaggctgcggttcaaagacccacacacgcacaagacccggtgctgcgttatgtagctcaggaccttggctgggcctggtcgtcatgtaggtcaggaccttggctggacctggaggccctgcccagccctgctctgcccagcccagcaggggctccaggccttggctggccccacatcgccttttcctccccgacacctccgtgcacttgtgtccgaggagcgaggagcccctcgggccctgggtggcctctgggccctttctcctgtctccgccactccctctggcggcgctggccgtggctctgtctctctgaggtgggtcgggcgccctctgcccgccccctcccacaccagccaggctggtctcctctagcctgtttgttgtggggtgggggtatattttgtaaccactgggcccccagcccctcttttgcgaccccttgtcctgacctgttctcggcaccttaaattattagaccccggggcagtcaggtgctccggacacccgaaggcaataaaacaggagccgtg

SEQ ID NO: 16873 - DNA, 2785 bp, Homo sapiens; identical to SEQ ID NO: 16868
  ENST00000329397

SEQ ID NO: 16874 - DNA, 2710 bp, Homo sapiens; identical to SEQ ID NO: 16867
  ENST00000349124

SEQ ID NO: 16875 - DNA, 12985 bp, Homo sapiens
  ENST00000366956
ccgcgcgggactccggggcgccacgggggccatgtaagcagctatcttccagagggccacactgggcatggacacccttttccctgcctggaggagcacaggtgatagtgtaattttccagtcacgaaactgctaaggccatctcaggggcgtgtgcgccaggataggcgggcggcgtccgaggaccacatagccatgccttttggtctgaagctccgccggacacggcgctacaacgtcctgagcaagaactgctttgtcacacggattcgcctgctggacagcaatgttatcgagtgcacgctgtcggtggaaagcacagggcaagaatgcctggaggctgtggcccagaggctggagctgcgagagacgcactactttggcctttggtttctcagcaagagccagcaagcacgatgggtggagctggagaaacctctgaagaaacatctggacaaattcgctaatgagcctttgcttttctttggagtcatgttctatgtgccaaatgtgtcatggcttcagcaagaggccacaagatatcagtattacctgcaagtcaaaaaagatgtgcttgaagggcgattacgatgtacattggaccaggtgattcggctagccggcctagctgtgcaagctgattttggagactataatcagtttgattctcaagatttcctcagagagtatgtgctatttcctatggatttggccctggaagaggctgttctggaggagctgacccagaaggtagcccaagaacacaaagcccacagtggaatcctgccagcagaagctgaactgatgtacatcaatgaagttgaacgtttggatggatttggacaggaaatcttccctgtaaaggacaatcatggaaactgtgtacaccttggcattttctttatggggattttcgtgaggaacagaattggaagacaagcggtaatatacaggtggaatgacatggggaatatcactcataacaagtcgaccattctagtggagctcatcaacaaagaagagactgccctctttcacacggatgatatcgaaaatgccaagtatatttctcggttgtttgccacacgacacaagttttacaaacaaaacaaaatctgcactgaacagtcaaattctccaccccccatcagacgccagcccacctggagccgatcctctctgcccaggcagcagccgtacatcctgcctcccgttcacgtccagtgtggtgagcactactcggaaacgcacacctcgcaagacagcatttttcatgggaatgaagaagccttgtattgcaactctcacaacagcctggacttaaattatttaaatggcactgtcaccaatggcagcgtgtgtagcgttcacagcgtcaactccctcaactgctcgcaaagtttcatccaggcctcccctgtatcctccaacctcagtatccctgggagtgacatcatgcgggccgactacatcccgagccaccggcacagcgcgatcatcgtgccctcgtacaggccaacccccgattatgagacagtcatgcgccagatgaagagggggatcctgcatacagacagccagagccagtctctgagaaacctcaacattatcaacacccatgcctacaaccagccagaggatctggtgtacagccaaccggagatgcgggagaggcacccctacactgtcccttatgggccacagggggtctacagcaacaaacttgtcagtccatctgaccagaggaacccaaagaataatgtggtaccaagcaagccgggggcaagcgccatctcgcacacggtgagcaccccagagctggccaacatgcagctgcagggcagccataactacagcacggcccacatgcttaagaactatctcttcaggccaccgcccccctacccacggccacgacctgccaccagcaccccagacctggccagccaccgccacaagtacgtcagcggcagcagcccggacctggtgacccggaaggtgcagctctcggtgaagaccttccaagaggacagctctccggtggttcatcagtctctccaggaggtgagcgagcccctcacggccaccaagcaccacggcactgtgaacaagcgccacagcctggaggtgatgaacagcatggtgcggggcatggaggccatgacgctcaagtcgctccacctccccatggctcgccgcaacacgctccgggagcagggaccgcccgaggaggggtcaggcagccacgaggtcccccagctccctcagtatcaccacaagaagaccttctctgatgccactatgctaatccacagcagcgagagtgaggaggaggaggaggaggctccagaatcggtgccccagatccccatgctccgggagaagatggagtacagtgcccagctgcaggcggccctggcccgcatccccaacaagcccccgcctgagtaccccggtccaaggaagagtgtgagcaatggggctctgaggcaggaccaagccagccttcctcccgccatggccagagccagggtgctgaggcatgggccagccaaggccatcagcatgtctcggactgacccgccggctgtcaacggggcctctctcggcccatccatctcggaacccgacctgactagtgtgaaggagcgggtcaaaaaagagcctgtgaaggagagacctgtgtctgaaatgttttccctggaagacagcattatagagagagagatgatgatcaggaatctagagaagcagaagatggcaggcctggaggcacagaagaggccgctgatgttggcagcattgaatgggctctcggtggctcgagtctcagggcgggaagagaatcgagttgatgccacccgggttcccatggacgagaggttcagaaccctgaagaagaaactagaagagggaatggtgttcacagaatatgagcaaattccaaagaaaaaggcgaatggcattttcagcacagcagctctgccagaaaacgccgagcgcagccgaatccgtgaagttgtcccctatgaggagaatcgagtagagctgataccaaccaaagaaaataacacaggatacattaatgcctcccacatcaaggtggtggttggcggggcagaatggcactacatagccacccaggggcccctgccacacacgtgccacgacttctggcagatggtgtgggagcagggagtgaatgtgattgccatggtcactgcagaggaggagggtggacgaaccaaaagccaccgatactggcccaaactaggttcaaagcacagctcagccacctatggcaagttcaaggtcaccacgaagtttcgaacggattctgtttgctatgcaaccacgggcttgaaggtcaagcaccttttgtctgggcaagaaaggacggtgtggcatttacaatatactgactggccagatcacggctgtccagaagatgtccaaggatttttatcctacttggaggagatccagtcggtccgtcgccataccaacagcatgctggaaggcaccaagaaccggcacccgcccatcgtggtccactgtagtgctggggtgggaaggaccggcgtgctcattctttctgagctgatgatctactgcttggaacataacgaaaaggtggaagtgcccatgatgctgaggctcctcagggagcagaggatgttcatgatccagactatcgctcagtacaagtttgtctaccaagtcctcatccagttcctccaaaactccagactcatttaatcaccccaatccagctcctggaggagggacccagctccatcgcgctggaggagagtcacctccagacaacatctgctccccccacaggggtgcaggtggctggcagcaaacaggctctctgaagacagtagccaagattattcacacataccatgtattattttatatgagataatttatttttttcccctttggaataacttttgtgaattattataatgcagtttccctagtaatatagtacttttcatttgaaccacatcttgactgatctgtattgtaatatatgtcagcaggtaaggttgcctgctggatcattttgaggacagaggcatgagggagcacatctcttgtgaagttgcagccagatttgtaaccaaccctgaaattcatcagcttaattcatttatcagcttgattcattcatcattcattgcttatatccaaagcaaagacggtaagaaaatgaattcatcctgaaatataaagaaaagggtctgaaggaacaaacacgattctcttatattttggggctcatgagccttgatagacagtttcctctcgtcttcatttccacccctcatcctcagtagtctcctctcccccacgccccaccccaacttcccccccaagcttgagttaaagacagaatagctaaagacagtgctgcctttacaatgcagtaattgccatctttggggccgaaagacaagctctgtgttgtgcttttcttgaccaccccttatcctgggctctggagcttgtgtttccctgctggcgactgtaccttgggtatttgttgctacctctcctgtttgctcagtaggaccctgtctggtggcattgaggctctggaccagaccatctgtgcagttaaggctctaccctgattgagagaggatagcagacctagaaagagaaaggagttgggcagggcctttgaggattgtgtttttcaggcagggccttgatgatcattgttttttatttaaataagatgtgtgtgctggacagagacctaaaagttgaggtcactaagtcattggaaaggccatcaaggaaacagatggggaagctgatttatgggagctgtaaggcatttagctacataacaggggtcctggccaggaaacacatcaaatgtgacccccgctgtgctgatatcatcttcaggctttggtctgcaagatcagaattaatcccactcgggaccccatagtccaaacttggggccacttgatgaacgatggtagaattgtcattggcagagccctgtgcttctttccttttcttcataaaatccactcgctggtcagttatcttcactttgaagcccagttcttagtttcttcctatggcttcattggtcagtgtccttctgaatttccaaggatggtacacaataaatcatgttttgtacttttttcctcttactgcattttgggggatttatcattctatgtctaccttttcttgagtacagctttgatatgcacctgttgttacgtggtgatgggaagtcacaggcgtgctctttctagttaatttgatgccacatcttccttgtcttttcagcttgggaaaaaggcggcagtggaggaaggcatggaatgcccacagtggtcagttcaaagaacaaacgtgcaattaaaaaactgtagtcagccaggcacggtggttcacacctgtaatcccagcactttgaaaggccaaggcgggcagattgcttgagctaaggagttcgagaccagcctgagcaacatgatgaaaccccgtctctacaaaaagtacaaaaattagccaggcgtggtggtatgccctggtagtcccagctgctcgggaggctgaggcaggaggatcacctgattctaagaattcgagactgcagtgagccgtgatcttgccactgtagtccaggctgggctacggagagaccctgcctccaaaaaaaaaaaaaaaaaaggaaaaaaggttgtcaagaaaaactagatgttaggagaaaggaaaatttaattgcagttttttttcttagaattgactgctgtgagagttccatatgcctttcttcattgctgcttttgtcccccgtgagctaaaaagatggagtgacatcaaatcaaccagaaaaagtatgcctttgtgacatcccatcaccacatgccaacaggtatatattccccattaagttcttcggaataggaatcctctgtttcaacctggccaggtgttgtggtggctgtactctagttagactcggaatatctggggatggagggcttcccctgtgtcttctacttcaaggtctgaaggctcagtgaaggagtataatctgctgatctttgtagattctggagttttgttgtatgtcctggaaagaaacccattagtattacatgtattttcagtgaacagagcttataacccttattataagaagctcatcaataagcaaaaagatacttgtttcctttccttggaggtttttccatccttgggatattctgctgttagggatgttttagcaagtggtctcagttactggtttattgcgtgatgaacaacatcagtatttatcttttatctctaagccccaaggtgggcactgttagaatatgtctcatgtggacagcatatagatctggtgcgtctttgaggtcgtcagagctcatgggcttccctgaaattcatccactgtccctgccgtatgctacgggaatattcattagtgtacaaaatgcagggaggaagtaggtttaatattcaactttctagccaaagtttatattgaaacccaaaagaaaacatttaagagttgttccacatatttcacttttaaaaacaaatgcctttggttctttagcacattttgcattccttttcacatctccagtaaatgccaacatatctcctgttaaattagcagcagccatttaaagtcctttcggtggcatctgcataataattgcccagagatgctttatatctgggaagcaagccaaggaataaaccttgaagcaaagtgtattaaattagttatctagttagagcttttggaatgatttcctgatgatgtatcaagtctgaagctggagctgtcagtgtctattgctgcagtttggatttgaagggagaaaatgtaaaatggaggaaaaaaaagttaccatctcacaacaaagccatcaaacattttccagccgctgttttcgaggttttccagttgaactgtttggtttctttcatccacactcatttggatacattgacccgaggtattcatccttgtttactgtggtccctgaatcatgggggctgaatttgatgtcttcatccttgagatgagcctgctggcttagctgaggaatgtcctgctgaggtttcttaggtttccttgggttctaaggatatactggatataccatcttttagcaagagtatctggtagcatttacagatagcatagacattggtatgcacttctttccccagataggaagtaaaggaggatttagttgcatgaaaaaaggatgttaaacattgattacataggagtaaagatgaatgagctgcaatattcagtcggagctaaacaataagatcagggaaggtaaaaatacctatgtggaatattttgaatcgtaagcttttgaggagcttaaattgagagaattttacttttaattttgtagattgagaagaggaaccgctttttaaaattatagctaaactgtcattgttttcctaagagtcacttggccatctctggccccctctttcatcagcctgaagagagggtctttgtagactgctgagggtgggccttgtaggacttgaccatggcttacacctacttaacctttatcctgctttctttcagcttgtgcttttcagttataaactccagtgggtacagcaggctggccttttcatccagctgattatttttccagcttaatatagattgacccatatgaaatttccaataatggaccatattttctgcaaatagacagtactcgcatggatcacctatatcttccccctgatacactgtgggtcccaacaccagatgtcatttctccagagcagtgctaatgaacacaaaaggtataccctgggtggcccagctcttttcacgaacgtgctgccctgctcatagtgatccttgcatcacttggtgaatgggccatctcctgggacatggaagttgcagaggtagatagtgcactgcagcttctcttaagccggattggccatcaggcatatcactctggagtttttagctgctgtcctttcccgatgaacagtctgtattagctgacctcagcctacttgttacgtgacgtatgggtcccaaaagtgtcctttgtcaaaaagcagaatgtgccttctagtctccctttccccatctaatggtgtattcgatggtgaagatgagtacagttgaccacccctatctgtgggttccacatccctatattcaaccaagtacagattgaaaaatatttggggaagaggggaaacccacaaagttccaaaaagcaaaagttgaatttgccacatgctgaatactacattgaattcacacaaatgaagtgatgtgtaggcattgagttaggtattgtaaataatctagagatgatttaaagtatgcaagagatgtgcataggttatatgcaaatactgtgctattttatataaaagacttgaacatccatggattctggtattctcagagggtccttgattgccccctttggtaaaggacaactatttcgttactgattttcgtttggggaagatctgtcaatcccttgaggtgcgggggttggggggatggagggtacagggcattctaggatgtgtgccagggagcacagattcaagggatgggattgagtcagacctgtgttcttactcagtgtcagaaataactctgtggagctcctagagtaagacatttccggaagcaccacataattactgttgggctcttagggtagcccttttagggaattgagcattcccatgttttaccaacaattattctgctgctgtgttttattatattgccaatggttttgagacactcatcatgctcttatttagtgatttcttttcatgagcagagcaacagctcatccagcatggtttccaaatggagaaatttgggtcttctgtagaaaccacacaaattctccaatggcctacagccttatggttggcacactagttggccctatagggtggaaataaagctgtaagatgttaaactgcatttgatacttctcttgaacgctgagcaaggaagcaaaatagttcttgtctttacttaagcttctaagacattttggggcaaaggaccttacagatggcgtctgttgaaagtaacagcaacgtgccagggagaaatgtgggggaaatctcatcaaattctgccacctcaaatgtgttgtccagaagtcagtgttattcagggggccctgtgaaacttgaccaccagcttgcgccatcaacactcagcctttatccagcctgctctcagcttttgtgtttctgttagaaactcagataggtaagtatttttattcagtagactacctttcttatcttttcagcttaatatagctgcatcttctttctcaaagccaaactaagatattctctattaaaatgtccatgagcctagcattgagtgtctggcatccatcaatttcatagactggaaaatgattgttgtttggtacagtaaagaagaggatgtgcatcagttcctaccgtttgcagctttgtttttagccttcccattttaaaaataaattcaaggacattgagttacaaggcaggagggctggagctactgggcagcctgaatatgacaagcatttgtgtggaaagtcattgctccttctgccacactttgggccatcaggatcattctttcccagaagtgccataaacttgctcaaaagtttctataaatgggaagagggagaggaaggatttttgcatcagtcctgaagttgctatccaaaagttctctgtttcacaaataattttctgaactctggaatgcctctcctactccctgcctccctttctgtaatgtcagagtgatggaaaccaccaagtggcatgctagggaaagcctgcagcagtgttggagtctatttcaccctagctcatagttttaaactgtcttcactgttgaggtagagcttgatgaatgtcatggattatgatgtgtggtttatcatatttgcctggatttgctgatcaaaagcaccatcttccctcgcctgctgctggcagcctttccttgccttgcttgttagcagagcattctgcttacccatgtggctcccagagttagcagccccggctcttggatttcttgattcttctcccctgtgatctcagaggtgctgcagaggacattcccctttagagcaagtcatgtttctattcaggccacaaaactgggatgtacatgcagtgactttggtgttccttgtcttgttcaggggaacgggtgggactgttgtgtgctgtcaccctcttcattccatgagcaccttgttcacttagggtctgctgcctttttttttttctttttctttttttttttttttttagtttttgagatcgtgtctcactcctgttgcgcaggctggagtgcagcctccaaagtagctgggattataggcgtgcaccaccacacccggctaatttttatatttttagtagagacggggttttgccatgttggccagactggtctcaaacctctgacctcgtgatgacccccctcggcctcccaaagtgctgggattacacccagcctctgctgccttttcatatttccccatctgctttatggatcaactctcaacagtacactttttcttttctttacctaccctatgagtgcaacccagatgtaagagttaatcctcgtcagagaatcattgccttaaacctctcagaaatatgtaattaggaaatcttattttaattttttaaaaattgcttgtatagtttcaaagaataagatctggcaaatggccagatgtggtggctcacacctgtaatcaaaccagcactttgggaggctgaggcaggcagatcacctgaggtcaggcgttcaagaccagcctggccaacatggtgaaatcccgtctctactaaaaatacaaaaaaaaaaaaaaaaaaaaaaattagccaggcatggtggcacatgcctgtaatcccagctactcaggaggctgaggcaggataattgcttgaacccgggaggtggaggttgcagtgagccgagatcatgccactgcactccagcctgggcaacagagtgagactttgtctcaaaaaaaaaaaaaaaaaaaaaaaaagatctggcggatgaaaataaccagaatgaaaatagctagaaaactcagcaagcaggaagctccctttctcacccttttgttcccttgccgatagaatcagtcactattagaaaaaatgaaagacgctctgtttaaaacaatgatgacagcagtacttaatatgtatttcgaggtgaacttatatagattgagagaggctgcatttggcagactgatgtataggaagacccatttgtttctagcttctccctgcagggaaaatgctttcgtcattatagcctctttacacagactggccattctagtgaaacaggtggtaaacctttgggctgcccagaaacattttatctgttttcacttacctaggaaggggaaagattagcgggtcatccaaaatctgtatgtaagctatcttcattttcttccccaaccttctcctcctgggaaacacaaatgctatctcatctgacaaaaggttttagaggataaagctgaaaagattggattgggatctttttgtggcttggggcggagccttttgctaaaatctcaagaatgctgctttgagtttagctagggtggctctcagaactggggtgcctggcattctcagcatttctcaggggcctcccacctctgacaactgcagtgttagctaatacataccttgagcatagaactgaatgctgtaattcagagccattttttttttcaacttgaacattgtacaattttactgcaatttcctttgaactttcttgccactgtttggaatcttaaaaattcattagccttctcctttctgacataaagctactcttcatcagagatgagttcctatgtatgtcctttgttccttcaatagctaattaatgtgcttgaggatacttcagtggaaaaaaaggtttaaatatgcaaattactaataaatgtgtaaccttatgtaacttgtgttacatcaagtaacaagctaatctagtttgtttcactggactaggcttgtgctccctacttcagtattttgatgctttccttgatctttgtttcacaaaatgttgtgaattttggtatcattcaaaacaaatgacatttattaggtttcattttgaaacgatgtacagacaagtccccaacttagaaaccggtttgttcttaaggttcttgcgtcagcccatagaagcccactgacctccaccacagcccaaatggagggctgtgatagccagatctggttggcttttgtgggctgacccagacatttaatcaccatctcttatgttgttgccgtaagaaatgcattccaggttgggacttgggatcctgagagcacattcgccccctgtggtggccgcttgccaccttgcaagatggaagcccagtctccttactaccaaactgtagttgtaagcagagggaggggtgagatgtttataggacattccctaagctggggagtgatttttatcactattcatgtcaactgtactttggtatagactccctatcaatttaataatatgaaaagcctaaaataaaactatgcatgctattctatgtgctattttatatcagtaaataagcttatgcttgccagttgtatacacagttatgaggtgtatagaactgactttgacagtattttttgcactgtttcctatctgtttttataaagtcttatttagatattggaccttgttgatgttctcactgcccttgtgcttgctataaaatgtttcatatgtgcctttacaaatgtgagatctttattctaacctttttttgtaaaagatatctattgatttccatatgcaataaacctttttttcagagaaaagtta

SEQ ID NO: 16876 - DNA, 442 bp, Homo sapiens
  ENST00000473261
gaatggtgttcacagaatatgagcaaattccaaagaaaaaggcgaatggcattttcagcacagcagctctgccagaaaacgccgagcgcagccgaatccgtgaagttgtcccctatgaggagaatcgagtagagctgataccaaccaaagaaaataacacaggatacattaatgcctcccacatcaaggtggtggttggcggggcagaatggcactacatagccacccaggggcccctgccacacacgtgccacgacttctggcagatggtgtgggagcagggagtgaatgtgattgccatggtcactgcagaggagtgatctttccactggaatttgggagtctcaggctgctctgggcaaatcgacatagacgcccaactccaggcacccagctccacatgccatcatccttatcagctgaaaagagaccagaagccgtt

SEQ ID NO: 16877 - DNA, 487 bp, Homo sapiens
  ENST00000486173
gacattttccaactctcagcacacaggctgctttttatcattcctacggggcgggagggggcagggagagaaggctaagacaccgggtccagtacccagagattctagggagagatctctgagattgcctacttgtcactggaatcaattccgtggggaatcggctccgccgccgcgaaggacagcctttccgcgcgggactccggggcgccacgggggccatgtaagcagctatcttccagagggccacactgggcatggacacccttttccctgcctggaggagcacaggtgatagtgtaattttccagtcacgaaactgctaaggccatctcaggggcgtgtgcgccaggataggcgggcggcgtccgaggaccacatagccatgccttttggtctgaagctccgccggacacggcgctacaacgtcctgagcaagaactgctttgtcacacggattcgcctgctggacagcaatgttatcgag

SEQ ID NO: 16878 - DNA, 5552 bp, Homo sapiens
  ENST00000491277
ctttccaactttttctcggcggagtgagcgcagcgggcgcagactcgggggcaggttgctgtgcttctccgggctcagccgcctgctctcctggctcaggtcctcggggagccctagacagacatcaagtggccactggcgctccttcccctcccagctgagccatcctccccggcctcctcgggcgggacagccccgtgcttaggtttttctccttttctcccccggtgcgcctctgctcggactctcgcgccgggatcgcggcggaaacctccctcccctttcgcctcctgcggctccttcccttcgcccctcctccgccagtcactggaatcaattccgtggggaatcggctccgccgccgcgaaggacagcctttccgcgcgggactccggggcgccacgggggccatgtaagcaggtggtggtcttttgaatggtttgcgtggagttgctgctgtccatcaccaagattgaagattgaagtcctcaccgtcttccagcaggcagcggtaggtggtgaccctagcctccagcttggccttgatgttcagcagggcctcgcactcctgggcttggtgttgcgcctcttcctgggtctgggccagccctgacgccaggtgcagcaggatctcgttgagctgctccatctgcagggtgtagcggacctccacctccctcaggctgttctccaagctggccttcagatttttcatggagtccaggtcgatctccaaggactggaccgtacgtcccagctccgtgagtgtcatctcagcagctccaacctgggcggactgggtggtgaccactgtggtgctctcctcagtccgctcagaccagcacttgtccagctcctctcggttcttccgagccagcttgtcatattgggcccagatgtctgccatgatcgtggcgaggtcctgagatttgggggcatcaacctccatggtcaacccagagctggcaatctgggcttgtaggccttttagttcatctttgtggttcttcatgaagagcagctcctccttgagagcctcgatctctgtctccagctgtggccaagtgacattggtgtcatcagtgaccttgcagagcccgtaatgctgctctccacagactggcgcctgagagtctgtctcatacttgactctaaagtcatcagcagcaagatgggcattgtcagtctgcagaacgatgcaggcattgtccacagtatttgctaagatctgagccctcaggtcctcgatgatcttgaagtaatggcccccagtctctgacctggggtcccttcttctccaggtgctcccagattttgctctccagcctccagttctcgatctccaggctcctcagtctgtccaggtaggaggccaggtggtctttcaggctttgcatggtctccttctcgttctggatgcctcctattcctgccaggcccccagccatccctgcggccaggccccgggaccccaagccatcccagaagctggtgtagcaggacacggagatctggaaaccagagcccctggcacgtgcataggctctggccacgctgttgaccagctgggcggctggacagagcccagggaccagtaattggtggagaagttggagcaagtggtgaaactcatgctgtctggggaggagaacgagaggacaggacccaggctttgccaacgacctcagtatactactacttcaatacatatttattctgacattaaaataagacagtgaaaaagtaaaaacaaaacatacttgatacaaggttttataacttttatctcaatcaaatcatagtaattatcactacagaattgaacaagtggtcaaacctgctcagattgctgagttttgtttcatattttaaagtcttaggagggaatttatttattgccctgttgcctaatattggatggctttaattccatggttttcagaattgcctattgccatatggtttacatacaaaataccacctgaaacataagaacgggtctttcctacggctttccccccacaaactgtaaatgaaaactttttattactgactgtatcctctcatttggtttaacttacaagtgtcatgttgcctgctgttacacttgtctttggcgtctgctcagaaataatggtgtctagacagacccataaatatcctgggttatagttcctcatttaaggctctgagacttcacagcaggggcaagaagacttgcagggcagatacgagaaatcttcaggccacttaattcagagtccattggcagaataggcagagaatgtgtgtgtgtgtgtgtgtgtgtgtgtgtgtgtgtgtgtgtgttaggctgggttgtagagatgggttttggaaatgatagttgggtcttgaaactactattggagtgcaaatgcctcctccctcatttggcggagaaacgtcaaaaatcctcagaacggaagaatccattctctttattttgggacacagcctggtaaaacttgtaagaaattatgacagctctgtgggaagcaagtgcaagtgtgggagaagcaagttgatgtgtgaagcagacatcagtgtgtgaaccagagtttatttgaacagtagtagttgctggtggcagaatgttaaaaatgtgagtattaagagtattaatgatgtgactattaagacttggattagtgttgaagaaatgtgaacttgaatagatttgctatgaaagtcttcggattttttttcctgtaatggattttatttcaatttcagttcactttatatgagtctccctggaattcattgcaaatttcttttgaaaggtaaggacccgtttgtttatgaagttttgattttttaggaggtaaatatttgaggcaaagttggtactgaggttcagagtaaatgggaatgaggatgttttatattaatatagaagttaagtaattacagagaaaagcttttaaaaattagtgcagtaaaatagggtgcttgtttatattgaattgttagatatcttggctgaatttataaaaagaaggttactactgaactcttaaaaggttatcgtactcgtcgtaaatattttcgtaaactgctaatagttttgacaacaaaaggagtgcttatctttggaatatattctccttcactgaattatttattttggaagagttgaggctaagggtgtaaaatatattatagagccaggcatcatggtgcacgcctgtgattccagcacttagggaggtcagtgtgggtggattgcttgagcccaggagttcgagaccagcctgggcaacatggtgaaaccccgtctctacaaaaaatacaaaaagtagccaggcatggtggtgcacccctgtagtcccagcttctttggagactgaggtgggaggattgcttgagccttggaggcagaggttgctataagctgagatcctaccactgatgcacaccagcctgggtgaccgaaggagaccctgtctcaaaaaaaaaaaaaaaaaaagaaaagaaaagaaaaaagaaagtattatagatttttagagctttttggttaggggttgatcacttatgggaccccacactgtgttgccctcaaagagttactgttaccatgttcactccctaatactttctccttgcattttccttccattccttttttcttccctcctagcctgaatgttggcctactagtgaaatctgcttatggcctaacctgatgggtaattaacagacaatatgttgtagttgttgacctaagaaggcctgagactattagtctgttttaacatacctgcatctatgaggtatctgtagtcagctctgtttttcttaagtagaggtttatccattaccaacagtgaatgttcaatgcaaggaatagctttttaaaacatatggcaaatttgtggttctttagaatccattgtcatatagtggttaatatatatatatatttttttgagacacactctttcgcccaggctagagtgcagtggtgccacttcggctcactgcaacctccacctcccaggttcaagcgattctcatgcttcagccttccaagtagttgagactacaggcatgtgccaccatgcccggctaatttttatattcttagtagagatggggttttgccatgttggccaggctggtctcaaactcctggcgtcaagtgatctgcctgcctcagtctcccaaagtgctgggactacaggcatgagccaccgtccccagcacatgtttgttgatgtccacaagttgttagaggttgtttataaggaggatggtagccaaaactgttaatttctcccatgtctctgtagaaggaaaacctgtgcagcacgctctattttgctagtgtactcagttgtcaaatagatagccaacttgtgtgtgaccaatcgtcttttctccttcactctgctgctttgaagaccttggtctctgaaacacatacttttggtcaggtatctatgaccatagagattaggacccatcttcttgactttttttggcagagagacagtgtctcactctgtcatgcccaggctagagtatagtggtgtgatcacagttcactgcagcctcaaactcctgggcttaagtgatcctcccacctcagcttcctgtgtatctggggctacagacatgcgccaccacacacagctaaattttttaattttaatttttattttttggtagagatgaagatcttgctatatccccaggctggtctcaaactcctggcttcaagtaattttcccaccttggcctcccaaagtcttagagctacaggtgtgagccaccatacccggccccatcttcttgacttacataggctgtgggtatcatcaagctaaagcccattttttaaaacaaccatacctcaattcttttttttttttttgagatggagtcttgctctgtcacccaggctggagtgcagtggcatgatctcggctcactgcaacctccacctcccagatttaagtgattcttgtgcctcagtctcctgagtagctgggattataggcatataccaccatgcctggctaatttttgtatttttagtagagatggagtttcaccatattggccaaactggtcttgaactcctgacttccagtgatccgcccacctcggcctctcaaagtgctggcattagaggcgtgagccactgcgcccagcccccatacctcagttcttaaagtatctcaagaatattaaaaccaattaccctaccactcaagtatatccactgtgtttttatatattatttctaaactttctattaattatataactgtaatcatgttatatatttagaataatagtcacatagagcaatatattgtgagaatactttttctgcttttcttcccatttatctttttagtcacacttttctctgttgccacatattcttaatatacttagaatgttaatggatgtatagctcattgagtagtatgttataattaacaatttccatttgttgactatttgggttatttccaggtgtttgtttggctactataaataaaataccattaacgtctttg

SEQ ID NO: 16879 - DNA, 3842 bp, Homo sapiens
  ENST00000543945
ccgcgcgggactccggggcgccacgggggccatgtaagcagctatcttccagagggccacactgggcatggacacccttttccctgcctggaggagcacaggtgatagtgtaattttccagtcacgaaactgctaaggccatctcaggggcgtgtgcgccaggataggcgggcggcgtccgaggaccacatagccatgccttttggtctgaagctccgccggacacggcgctacaacgtcctgagcaagaactgctttgtcacacggattcgcctgctggacagcaatgttatcgagtgcacgctgtcggtggaaagcacagggcaagaatgcctggaggctgtggcccagaggctggagctgcgagagacgcactactttggcctttggtttctcagcaagagccagcaagcacgatgggtggagctggagaaacctctgaagaaacatctggacaaattcgctaatgagcctttgcttttctttggagtcatgttctatgtgccaaatgtgtcatggcttcagcaagaggccacaagatatcagtattacctgcaagtcaaaaaagatgtgcttgaagggcgattacgatgtacattggaccaggtgattcggctagccggcctagctgtgcaagctgattttggagactataatcagtttgattctcaagatttcctcagagagtatgtgctatttcctatggatttggccctggaagaggctgttctggaggagctgacccagaaggtagcccaagaacacaaagcccacaggacaatcatggaaactgtgtacaccttggcattttctttatggggattttcgtgaggaacagaattggaagacaagcggtaatatacaggtggaatgacatggggaatatcactcataacaagtcgaccattctagtggagctcatcaacaaagaagagactgccctctttcacacggatgatatcgaaaatgccaagtatatttctcggttgtttgccacacgacacaagttttacaaacaaaacaaaatctgcactgaacagtcaaattctccaccccccatcagacgccagcccacctggagccgatcctctctgcccaggcagcagccgtacatcctgcctcccgttcacgtccagtgtggtgagcactactcggaaacgcacacctcgcaagacagcatttttcatgggaatgaagaagccttgtattgcaactctcacaacagcctggacttaaattatttaaatggcactgtcaccaatggcagcgtgtgtagcgttcacagcgtcaactccctcaactgctcgcaaagtttcatccaggcctcccctgtatcctccaacctcagtatccctgggagtgacatcatgcgggccgactacatcccgagccaccggcacagcgcgatcatcgtgccctcgtacaggccaacccccgattatgagacagtcatgcgccagatgaagagggggatcctgcatacagacagccagagccagtctctgagaaacctcaacattatcaacacccatgcctacaaccagccagaggatctggtgtacagccaaccggagatgcgggagaggcacccctacactgtcccttatgggccacagggggtctacagcaacaaacttgtcagtccatctgaccagaggaacccaaagaataatgtggtaccaagcaagccgggggcaagcgccatctcgcacacggtgagcaccccagagctggccaacatgcagctgcagggcagccataactacagcacggcccacatgcttaagaactatctcttcaggccaccgcccccctacccacggccacgacctgccaccagcaccccagacctggccagccaccgccacaagtacgtcagcggcagcagcccggacctggtgacccggaaggtgcagctctcggtgaagaccttccaagaggacagctctccggtggttcatcagtctctccaggaggtgagcgagcccctcacggccaccaagcaccacggcactgtgaacaagcgccacagcctggaggtgatgaacagcatggtgcggggcatggaggccatgacgctcaagtcgctccacctccccatggctcgccgcaacacgctccgggagcagggaccgcccgaggaggggtcaggcagccacgaggtcccccagctccctcagtatcaccacaagaagaccttctctgatgccactatgctaatccacagcagcgagagtgaggaggaggaggaggaggctccagaatcggtgccccagatccccatgctccgggagaagatggagtacagtgcccagctgcaggcggccctggcccgcatccccaacaagcccccgcctgagtaccccggtccaaggaagagtgtgagcaatggggctctgaggcaggaccaagccagccttcctcccgccatggccagagccagggtgctgaggcatgggccagccaaggccatcagcatgtctcggactgacccgccggctgtcaacggggcctctctcggcccatccatctcggaacccgacctgactagtgtgaaggagcgggtcaaaaaagagcctgtgaaggagagacctgtgtctgaaatgttttccctggaagacagcattatagagagagagatgatgatcaggaatctagagaagcagaagatggcaggcctggaggcacagaagaggccgctgatgttggcagcattgaatgggctctcggtggctcgagtctcagggcgggaagagaatcgagttgatgccacccgggttcccatggacgagaggttcagaaccctgaagaagaaactagaagagggaatggtgttcacagaatatgagcaaattccaaagaaaaaggcgaatggcattttcagcacagcagctctgccagaaaacgccgagcgcagccgaatccgtgaagttgtcccctatgaggagaatcgagtagagctgataccaaccaaagaaaataacacaggatacattaatgcctcccacatcaaggtggtggttggcggggcagaatggcactacatagccacccaggggcccctgccacacacgtgccacgacttctggcagatggtgtgggagcagggagtgaatgtgattgccatggtcactgcagaggaggagggtggacgaaccaaaagccaccgatactggcccaaactaggttcaaagcacagctcagccacctatggcaagttcaaggtcaccacgaagtttcgaacggattctgtttgctatgcaaccacgggcttgaaggtcaagcaccttttgtctgggcaagaaaggacggtgtggcatttacaatatactgactggccagatcacggctgtccagaagatgtccaaggatttttatcctacttggaggagatccagtcggtccgtcgccataccaacagcatgctggaaggcaccaagaaccggcacccgcccatcgtggtccactgtagtgctggggtgggaaggaccggcgtgctcattctttctgagctgatgatctactgcttggaacataacgaaaaggtggaagtgcccatgatgctgaggctcctcagggagcagaggatgttcatgatccagactatcgctcagtacaagtttgtctaccaagtcctcatccagttcctccaaaactccagactcatttaatcaccccaatccagctcctggaggagggacccagctccatcgcgctggaggagagtcacctccagacaacatctgctccccccacaggggtgcaggtggctggcagcaaacaggctctctgaagacagtagccaagattattcacacataccatgtattattttatatgag

SEQ ID NO: 16880 - DNA, 1794 bp, Homo sapiens
  ENST00000460620
agtggctttttggaggtgtctcggccatgacacacatttgacatgccctccctcaacctacttatagactatttttcttgctctgcagcatggaccaaagagaaattctgcagaagttcctggatgaggcccaaagcaagaaaattactaaagaggagtttgccaatgaatttctgaagctgaaaaggcaatctaccaagtacaaggcagacaaaacctatcctacaactgtggctgagaagcccaagaatatcaagaaaaacagatataaggatattttgccctatgattatagccgggtagaactatccctgataacctctgatgaggattccagctacatcaatgccaacttcattaagggagtttatggacccaaggcttatattgccacccagggtcctttatctacaaccctcctggacttctggaggatgatttgggaatatagtgtccttatcattgttatggcatgcatggagtatgaaatgggaaaggaagctgaaaaaaggaaatctgattatataatcaggactctaaaagttaagttcaatagtgtatctgtaattcttgcccaccaaacaagcctgcagaatctgttcagtcaaataactccagctcatttctgaattttggttttgcaaaccgtttttcaaaacccaaaggaccaaggaatccaccaccaacttggaatatttaataaaactccagatttataataatatgggctgcaagtacacctgcaaataaaactactagaatactgctagttaaaataagtgctctatatgcataatatcaaatatgaagatatgctaatgtgttaatagcttttaaaagaaaagcaaaatgccaataagtgccagttttgcattttcatatcatttgcattgagttgaaaactgcaaataaaagtttgtcacttgagcttatgtacagaatgctatatgagaaacacttttagaatggatttatttttcatttttgccagttatttttattttcttttacttttctacataaacataaacttcaaaaggtttgtaagatttggatctcaactaatttctacattgccagaatatactataaaaagttaaaaaaaaaacttactttgtgggttgcaatacaaactgctcttgacaatgactattccctgacagttatttttgcctaaatggagtataccttgtaaatcttcccaaatgttgtggaaaactggaatattaagaaaatgagaaattatatttattagaataaaatgtgcaaataatgacaattatttgaatgtaacaaggaattcaactgaaatcctgataagttttaaccaaagtcattaaattaccaattctagaaaagtaatcaatgaaatataatagctatcttttggtagcaaaagatataaattgtatatgtttatacaggatctttcagatcatgtgcaatttttatctaaccaatcagaaatactagtttaaaatgaatttctatatgaatatggatctgccataagaaaatctagttcaactctaattttatgtagtaaataaattggcaggtaattgtttttacaaagaatccacctgacttcccctaatgcattaaaaatatttttatttaaataactttatttataacttttagaaacatgtagtattgtttaaacatcatttgttcttcagtatttttcatttggaagtccaatagggcaaattgaatgaagtattattatctgtctcttgtagtacaatgtatccaacagacactcaataaactttttggttgttaaactga

SEQ ID NO: 16881 - DNA, 3654 bp, Homo sapiens
  ENST00000359785
gaagtcagtaaaccacagccttcagcatgctctgctcaggcggcagcagtggctttttggaggtgtctcggccatgacacacatttgacatgccctccctcaacctacttatagactatttttcttgctctgcagcatggaccaaagagaaattctgcagaagttcctggatgaggcccaaagcaagaaaattactaaagaggagtttgccaatgaatttctgaagctgaaaaggcaatctaccaagtacaaggcagacaaaacctatcctacaactgtggctgagaagcccaagaatatcaagaaaaacagatataaggatattttgccctatgattatagccgggtagaactatccctgataacctctgatgaggattccagctacatcaatgccaacttcattaagggagtttatggacccaaggcttatattgccacccagggtcctttatctacaaccctcctggacttctggaggatgatttgggaatatagtgtccttatcattgttatggcatgcatggagtatgaaatgggaaagaaaaagtgtgagcgctactgggctgagccaggagagatgcagctggaatttggccctttctctgtatcctgtgaagctgaaaaaaggaaatctgattatataatcaggactctaaaagttaagttcaatagtgaaactcgaactatctaccagtttcattacaagaattggccagaccatgatgtaccttcatctatagaccctattcttgagctcatctgggatgtacgttgttaccaagaggatgacagtgttcccatatgcattcactgcagtgctggctgtggaaggactggtgttatttgtgctattgattatacatggatgttgctaaaagatgggataattcctgagaacttcagtgttttcagtttgatccgggaaatgcggacacagaggccttcattagttcaaacgcaggaacaatatgaactggtctacaatgctgtattagaactatttaagagacagatggatgttatcagagataaacattctggaacagagagtcaagcaaagcattgtattcctgagaaaaatcacactctccaagcagactcttattctcctaatttaccaaaaagtaccacaaaagcagcaaaaatgatgaaccaacaaaggacaaaaatggaaatcaaagaatcttcttcctttgactttaggacttctgaaataagtgcaaaagaagagctagttttgcaccctgctaaatcaagcacttcttttgactttctggagctaaattacagttttgacaaaaatgctgacacaaccatgaaatggcagacaaaggcatttccaatagttggggagcctcttcagaagcatcaaagtttggatttgggctctcttttgtttgagggatgttctaattctaaacctgtaaatgcagcaggaagatattttaattcaaaggtgccaataacacggaccaaatcaactccttttgaattgatacagcagagagaaaccaaggaggtggacagcaaggaaaacttttcttatttggaatctcaaccacatgattcttgttttgtagagatgcaggctcaaaaagtaatgcatgtttcttcagcagaactgaattattcactgccatatgactctaaacaccaaatacgtaatgcctctaatgtaaagcaccatgactctagtgctcttggtgtatattcttacatacctttagtggaaaatccttatttttcatcatggcctccaagtggtaccagttctaagatgtctcttgatttacctgagaagcaagatggaactgtttttccttcttctctgttgccaacatcctctacatccctcttctcttattacaattcacatgattctttatcactgaattctccaaccaatatttcctcactattgaaccaggagtcagctgtactagcaactgctccaaggatagatgatgaaatcccccctccacttcctgtatggacacctgaatcatttattgtggttgaggaagctggagaattctcaccaaatgttcccaaatccttatcctcagctgtgaaggtaaaaattggaacatcactggaatggggtggaacatctgaaccaaagaaatttgatgactctgtgatacttagaccaagcaagagtgtaaaactccgaagtcctaaatcagaactacatcaagatcgttcttctcccccacctcctctcccagaaagaactctagagtccttctttcttgccgatgaagattgtatgcaggcccaatctatagaaacatattctactagctatcctgacaccatggaaaattcaacatcttcaaaacagacactgaagactcctggaaaaagtttcacaaggagtaagagtttgaaaattttgcgaaacatgaaaaagagtatctgtaattcttgcccaccaaacaagcctgcagaatctgttcagtcaaataactccagctcatttctgaattttggttttgcaaaccgtttttcaaaacccaaaggaccaaggaatccaccaccaacttggaatatttaataaaactccagatttataataatatgggctgcaagtacacctgcaaataaaactactagaatactgctagttaaaataagtgctctatatgcataatatcaaatatgaagatatgctaatgtgttaatagcttttaaaagaaaagcaaaatgccaataagtgccagttttgcattttcatatcatttgcattgagttgaaaactgcaaataaaagtttgtcacttgagcttatgtacagaatgctatatgagaaacacttttagaatggatttatttttcatttttgccagttatttttattttcttttacttttctacataaacataaacttcaaaaggtttgtaagatttggatctcaactaatttctacattgccagaatatactataaaaagttaaaaaaaaaacttactttgtgggttgcaatacaaactgctcttgacaatgactattccctgacagttatttttgcctaaatggagtataccttgtaaatcttcccaaatgttgtggaaaactggaatattaagaaaatgagaaattatatttattagaataaaatgtgcaaataatgacaattatttgaatgtaacaaggaattcaactgaaatcctgataagttttaaccaaagtcattaaattaccaattctagaaaagtaatcaatgaaatataatagctatcttttggtagcaaaagatataaattgtatatgtttatacaggatctttcagatcatgtgcaatttttatctaaccaatcagaaatactagtttaaaatgaatttctatatgaatatggatctgccataagaaaatctagttcaactctaattttatgtagtaaataaattggcaggtaattgtttttacaaagaatccacctgacttcccctaatgcattaaaaatatttttatttaaataactttatttataacttttagaaacatgtagtattgtttaaacatcatttgttcttcagtatttttcatttggaagtccaatagggcaaattgaatgaagtattattatctgtctcttgtagtacaatgtatccaacagacactcaataaactttttggttgttaaactga

SEQ ID NO: 16882 - DNA, 3424 bp, Homo sapiens
  ENST00000528414
ggtgtctcggccatgacacacatttgacatgccctccctcaacctacttatagactatttttcttgctctgcagcatggaccaaagagaaattctgcagaagttcctggatgaggcccaaagcaagaaaattactaaagaggagtttgccaatgaatttctgaagctgaaaaggcaatctaccaagtacaaggcagacaaaacctatcctacaactgtggctgagaagcccaagaatatcaagaaaaacagatataaggatattttgccctatgattatagccgggtagaactatccctgataacctctgatgaggattccagctacatcaatgccaacttcattaagggagtttatggacccaaggcttatattgccacccagggtcctttatctacaaccctcctggacttctggaggatgatttgggaatatagtgtccttatcattgttatggcatgcatggagtatgaaatgggaaagaaaaagtgtgagcgctactgggctgagccaggagagatgcagctggaatttggccctttctctgtatcctgtgaagctgaaaaaaggaaatctgattatataatcaggactctaaaagttaagttcaatagtgaaactcgaactatctaccagtttcattacaagaattggccagaccatgatgtaccttcatctatagaccctattcttgagctcatctgggatgtacgttgttaccaagaggatgacagtgttcccatatgcattcactgcagtgctggctgtggaaggactggtgttatttgtgctattgattatacatggatgttgctaaaagatgggagtcaagcaaagcattgtattcctgagaaaaatcacactctccaagcagactcttattctcctaatttaccaaaaagtaccacaaaagcagcaaaaatgatgaaccaacaaaggacaaaaatggaaatcaaagaatcttcttcctttgactttaggacttctgaaataagtgcaaaagaagagctagttttgcaccctgctaaatcaagcacttcttttgactttctggagctaaattacagttttgacaaaaatgctgacacaaccatgaaatggcagacaaaggcatttccaatagttggggagcctcttcagaagcatcaaagtttggatttgggctctcttttgtttgagggatgttctaattctaaacctgtaaatgcagcaggaagatattttaattcaaaggtgccaataacacggaccaaatcaactccttttgaattgatacagcagagagaaaccaaggaggtggacagcaaggaaaacttttcttatttggaatctcaaccacatgattcttgttttgtagagatgcaggctcaaaaagtaatgcatgtttcttcagcagaactgaattattcactgccatatgactctaaacaccaaatacgtaatgcctctaatgtaaagcaccatgactctagtgctcttggtgtatattcttacatacctttagtggaaaatccttatttttcatcatggcctccaagtggtaccagttctaagatgtctcttgatttacctgagaagcaagatggaactgtttttccttcttctctgttgccaacatcctctacatccctcttctcttattacaattcacatgattctttatcactgaattctccaaccaatatttcctcactattgaaccaggagtcagctgtactagcaactgctccaaggatagatgatgaaatcccccctccacttcctgtatggacacctgaatcatttattgtggttgaggaagctggagaattctcaccaaatgttcccaaatccttatcctcagctgtgaaggtaaaaattggaacatcactggaatggggtggaacatctgaaccaaagaaatttgatgactctgtgatacttagaccaagcaagagtgtaaaactccgaagtcctaaatcagaactacatcaagatcgttcttctcccccacctcctctcccagaaagaactctagagtccttctttcttgccgatgaagattgtatgcaggcccaatctatagaaacatattctactagctatcctgacaccatggaaaattcaacatcttcaaaacagacactgaagactcctggaaaaagtttcacaaggagtaagagtttgaaaattttgcgaaacatgaaaaagagtatctgtaattcttgcccaccaaacaagcctgcagaatctgttcagtcaaataactccagctcatttctgaattttggttttgcaaaccgtttttcaaaacccaaaggaccaaggaatccaccaccaacttggaatatttaataaaactccagatttataataatatgggctgcaagtacacctgcaaataaaactactagaatactgctagttaaaataagtgctctatatgcataatatcaaatatgaagatatgctaatgtgttaatagcttttaaaagaaaagcaaaatgccaataagtgccagttttgcattttcatatcatttgcattgagttgaaaactgcaaataaaagtttgtcacttgagcttatgtacagaatgctatatgagaaacacttttagaatggatttatttttcatttttgccagttatttttattttcttttacttttctacataaacataaacttcaaaaggtttgtaagatttggatctcaactaatttctacattgccagaatatactataaaaagttaaaaaaaaaacttactttgtgggttgcaatacaaactgctcttgacaatgactattccctgacagttatttttgcctaaatggagtataccttgtaaatcttcccaaatgttgtggaaaactggaatattaagaaaatgagaaattatatttattagaataaaatgtgcaaataatgacaattatttgaatgtaacaaggaattcaactgaaatcctgataagttttaaccaaagtcattaaattaccaattctagaaaagtaatcaatgaaatataatagctatcttttggtagcaaaagatataaattgtatatgtttatacaggatctttcagatcatgtgcaatttttatctaaccaatcagaaatactagtttaaaatgaatttctatatgaatatggatctgccataagaaaatctagttcaactctaattttatgtagtaaataaattggcaggtaattgtttttacaaagaatccacctgacttcccctaatgcattaaaaatatttttatttaaataactttatttataacttttagaaacatgtagtattgtttaaacatcatttgttcttcagtatttttcatttggaagtccaatagggcaaattgaatgaagtattattatctgtctcttgtagtacaatgtatccaacagacactcaataaactttttggttgttaaa

SEQ ID NO: 16883 - DNA, 562 bp, Homo sapiens
  ENST00000469077
tacaaatgagaatattatagtgtcaacccatttgtaagcacctacattttgttaacatttgacagtgatatgtttatttgggattattaattactcttaacaattatatgtgatctgatcaacagtcatctgagtctgtctttagtctttcccttatatttttttcttttgattctaggtatctgtaattcttgcccaccaaacaagcctgcagaatctgttcagtcaaataactccagctcatttctgaattttggttttgcaaaccgtttttcaaaacccaaaggaccaaggaatccaccaccaacttggaatatttaataaaactccagatttataataatatgggctgcaagtacacctgcaaataaaactactagaatactgctagttaaaataagtgctctatatgcataatatcaaatatgaagatatgctaatgtgttaatagcttttaaaagaaaagcaaaatgccaataagtgccagttttgcattttcatatcatttgcattgagttgaaaactgcaaataaaagtttgtcacttgagcttatgtacagaa

SEQ ID NO: 16884 - DNA, 2421 bp, Homo sapiens
  ENST00000532224
gctttttggaggtgtctcggccatgacacacatttgacatgccctccctcaacctacttatagactatttttcttgctctgcagcatggaccaaagagaaattctgcagaagttcctggatgaggcccaaagcaagaaaattactaaagaggagtttgccaatgaatttctgaagctgaaaaggcaatctaccaagtacaaggcagacaaaacctatcctacaactgtggctgagaagcccaagaatatcaagaaaaacagatataaggatattttgccctatgattatagccgggtagaactatccctgataacctctgatgaggattccagctacatcaatgccaacttcattaagggagtttatggacccaaggcttatattgccacccagggtcctttatctacaaccctcctggacttctggaggatgatttgggaatatagtgtcctttgctggctgtggaaggactggtgttatttgtgctattgattatacatggatgttgctaaaagatgggataattcctgagaacttcagtgttttcagtttgatccgggaaatgcggacacagaggccttcattagttcaaacgcaggaacaatatgaactggtctacaatgctgtattagaactatttaagagacagatggatgttatcagagataaacattctggaacagagagtcaagcaaagcattgtattcctgagaaaaatcacactctccaagcagactcttattctcctaatttaccaaaaagtaccacaaaagcagcaaaaatgatgaaccaacaaaggacaaaaatggaaatcaaagaatcttcttcctttgactttaggacttctgaaataagtgcaaaagaagagctagttttgcaccctgctaaatcaagcacttcttttgactttctggagctaaattacagttttgacaaaaatgctgacacaaccatgaaatggcagacaaaggcatttccaatagttggggagcctcttcagaagcatcaaagtttggatttgggctctcttttgtttgagggatgttctaattctaaacctgtaaatgcagcaggaagatattttaattcaaaggtgccaataacacggaccaaatcaactccttttgaattgatacagcagagagaaaccaaggaggtggacagcaaggaaaacttttcttatttggaatctcaaccacatgattcttgttttgtagagatgcaggctcaaaaagtaatgcatgtttcttcagcagaactgaattattcactgccatatgactctaaacaccaaatacgtaatgcctctaatgtaaagcaccatgactctagtgctcttggtgtatattcttacatacctttagtggaaaatccttatttttcatcatggcctccaagtggtaccagttctaagatgtctcttgatttacctgagaagcaagatggaactgtttttccttcttctctgttgccaacatcctctacatccctcttctcttattacaattcacatgattctttatcactgaattctccaaccaatatttcctcactattgaaccaggagtcagctgtactagcaactgctccaaggatagatgatgaaatcccccctccacttcctgtatggacacctgaatcatttattgtggttgaggaagctggagaattctcaccaaatgttcccaaatccttatcctcagctgtgaaggtaaaaattggaacatcactggaatggggtggaacatctgaaccaaagaaatttgatgactctgtgatacttagaccaagcaagagtgtaaaactccgaagtcctaaatcagaactacatcaagatcgttcttctcccccacctcctctcccagaaagaactctagagtccttctttcttgccgatgaagattgtatgcaggcccaatctatagaaacatattctactagctatcctgacaccatggaaaattcaacatcttcaaaacagacactgaagactcctggaaaaagtttcacaaggagtaagagtttgaaaattttgcgaaacatgaaaaagagtatctgtaattcttgcccaccaaacaagcctgcagaatctgttcagtcaaataactccagctcatttctgaattttggttttgcaaaccgtttttcaaaacccaaaggaccaaggaatccaccaccaacttggaatatttaataaaactccagatttataataatatgggctgcaagtacacctgcaaataaaactactagaatactgctagttaaaataagtgctctatatgcataatatcaaatatgaagatatgctaatgtgttaatagcttttaaaagaaaagcaaaatgccaataagtgccagttttgcattttcatatcatttgcattgagttgaaaactgcaaataaaagtttgtcacttg

SEQ ID NO: 16885 - DNA, 2726 bp, Homo sapiens
  ENST00000420377
agtggctttttggaggtgtctcggccatgacacacatttgacatgccctccctcaacctacttatagactatttttcttgctctgcagcatggaccaaagagaaattctgcagaagttcctggatgaggcccaaagcaagaaaattactaaagaggagtttgccaatgaatttctgaagctgaaaaggcaatctaccaagtacaaggcagacaaaacctatcctacaactgtggctgagaagcccaagaatatcaagaaaaacagatataaggatattttgccctatgattatagccgggtagaactatccctgataacctctgatgaggattccagctacatcaatgccaacttcattaagggagtttatggacccaaggcttatattgccacccagggtcctttatctacaaccctcctggacttctggaggatgatttgggaatatagtgtccttatcattgttatggcatgcatggagtatgaaatgggaaagaaaaagtgtgagcgctactgggctgagccaggagagatgcagctggaatttggccctttctctgtatcctgtgaagctgaaaaaaggaaatctgattatataatcaggactctaaaagttaagttcaatagtgaaactcgaactatctaccagtttcattacaagaattggccagaccatgatgtaccttcatctatagaccctattcttgagctcatctgggatgtacgttgttaccaagaggatgacagtgttcccatatgcattcactgcagtgctggctgtggaaggactggtgttatttgtgctattgattatacatggatgttgctaaaagatgggataattcctgagaacttcagtgttttcagtttgatccgggaaatgcggacacagaggccttcattagttcaaacgcaggaacaatatgaactggtctacaatgctgtattagaactatttaagagacagatggatgttatcagagataaacattctggaacagagagtcaagcaaagcattgtattcctgagaaaaatcacactctccaagcagactcttattctcctaatttaccaaaaagtaccacaaaagcagcaaaaatgatgaaccaacaaaggacaaaaatggaaatcaaagaatcttcttcctttgactttaggacttctgaaataagtgcaaaagaagagctagttttgcaccctgctaaatcaagcacttcttttgactttctggagctaaattacagttttgacaaaaatgctgacacaaccatgaaatggcagacaaaggcatttccaatagttggggagcctcttcagaagcatcaaagtttggatttgggctctcttttgtttgagggatgttctaattctaaacctgtaaatgcagcaggaagatattttaattcaaaggtgccaataacacggaccaaatcaactccttttgaattgatacagcagagagaaaccaaggaggtggacagcaaggaaaacttttcttatttggaatctcaaccacatgattcttgttttgtagagatgcaggctcaaaaagtaatgcatgtttcttcagcagaactgaattattcactgccatatgactctaaacaccaaatacgtaatgcctctaatgtaaagcaccatgactctagtgctcttggtgtatattcttacatacctttagtggaaaatccttatttttcatcatggcctccaagtggtaccagttctaagatgtctcttgatttacctgagaagcaagatggaactgtttttccttcttctctgttgccaacatcctctacatccctcttctcttattacaattcacatgattctttatcactgaattctccaaccaatatttcctcactattgaaccaggagtcagctgtactagcaactgctccaaggatagatgatgaaatcccccctccacttcctgtatggacacctgaatcatttattgtggttgaggaagctggagaattctcaccaaatgttcccaaatccttatcctcagctgtgaaggtaaaaattggaacatcactggaatggggtggaacatctgaaccaaagaaatttgatgactctgtgatacttagaccaagcaagagtgtaaaactccgaagtcctaaatcagaactacatcaagatcgttcttctcccccacctcctctcccagaaagaactctagagtccttctttcttgccgatgaagattgtatgcaggcccaatctatagaaacatattctactagctatcctgacaccatggaaaattcaacatcttcaaaacagacactgaagactcctggaaaaagtttcacaaggagtaagagtttgaaaattttgcgaaacatgaaaaagagtatctgtaattcttgcccaccaaacaagcctgcagaatctgttcagtcaaataactccagctcatttctgaattttggtatgtgtgttattttactgaagagttaaaaaaattacctaaattactcatttacagtataactgattcaactttaaatatgattttaggttgcatgtataggtccttatgtttatattcttttccatgcaatttatctttttatttttaaccttaactacctcttaacatctcacacagaactaaattatctagtatatgtggaaaataaagctaggtaaccaaattattgtgttggcatgtagtaaataaatatgactatccaaatggagaaattg

SEQ ID NO: 16886 - DNA, 2118 bp, Homo sapiens
  ENST00000525799
agtggctttttggaggtgtctcggccatgacacacatttgacatgccctccctcaacctacttatagactatttttcttgctctgcagcatggaccaaagagaaattctgcagaagttcctggatgaggcccaaagcaagaaaattactaaagaggagtttgccaatgaatttctgaagctgaaaaggcaatctaccaagtacaaggcagacaaaacctatcctacaactgtggctgagaagcccaagaatatcaagaaaaacagatataaggatattttgccctatgattatagccgggtagaactatccctgataacctctgatgaggattccagctacatcaatgccaacttcattaagggagtttatggacccaaggcttatattgccacccagggtcctttatctacaaccctcctggacttctggaggatgatttgggaatatagtgtccttataattcctgagaacttcagtgttttcagtttgatccgggaaatgcggacacagaggccttcattagttcaaacgcaggaacaatatgaactggtctacaatgctgtattagaactatttaagagacagatggatgttatcagagataaacattctggaacagagagtcaagcaaagcattgtattcctgagaaaaatcacactctccaagcagactcttattctcctaatttaccaaaaagtaccacaaaagcagcaaaaatgatgaaccaacaaaggacaaaaatggaaatcaaagaatcttcttcctttgactttaggacttctgaaataagtgcaaaagaagagctagttttgcaccctgctaaatcaagcacttcttttgactttctggagctaaattacagttttgacaaaaatgctgacacaaccatgaaatggcagacaaaggcatttccaatagttggggagcctcttcagaagcatcaaagtttggatttgggctctcttttgtttgagggatgttctaattctaaacctgtaaatgcagcaggaagatattttaattcaaaggtgccaataacacggaccaaatcaactccttttgaattgatacagcagagagaaaccaaggaggtggacagcaaggaaaacttttcttatttggaatctcaaccacatgattcttgttttgtagagatgcaggctcaaaaagtaatgcatgtttcttcagcagaactgaattattcactgccatatgactctaaacaccaaatacgtaatgcctctaatgtaaagcaccatgactctagtgctcttggtgtatattcttacatacctttagtggaaaatccttatttttcatcatggcctccaagtggtaccagttctaagatgtctcttgatttacctgagaagcaagatggaactgtttttccttcttctctgttgccaacatcctctacatccctcttctcttattacaattcacatgattctttatcactgaattctccaaccaatatttcctcactattgaaccaggagtcagctgtactagcaactgctccaaggatagatgatgaaatcccccctccacttcctgtatggacacctgaatcatttattgtggttgaggaagctggagaattctcaccaaatgttcccaaatccttatcctcagctgtgaaggtaaaaattggaacatcactggaatggggtggaacatctgaaccaaagaaatttgatgactctgtgatacttagaccaagcaagagtgtaaaactccgaagtcctaaatcagaactacatcaagatcgttcttctcccccacctcctctcccagaaagaactctagagtccttctttcttgccgatgaagattgtatgcaggcccaatctatagaaacatattctactagctatcctgacaccatggaaaattcaacatcttcaaaacagacactgaagactcctggaaaaagtttcacaaggagtaagagtttgaaaattttgcgaaacatgaaaaagagtatctgtaattcttgcccaccaaacaagcctgcagaatctgttcagtcaaataactccagctcatttctgaattttggtatgtgtgttattttactgaagagttaaaaaaattacctaaattactcat

SEQ ID NO: 16887 - DNA, 2258 bp, Homo sapiens
  ENST00000484147
tccctcaacctacttatagactatttttcttgctctgcagcatggaccaaagagaaattctgcagaagttcctggatgaggcccaaagcaagaaaattactaaagaggagtttgccaatgaatttctgaagctgaaaaggcaatctaccaagtacaaggcagacaaaacctatcctacaactgtggctgagaagcccaagaatatcaagaaaaacagatataaggatattttgccctatgattatagccgggtagaactatccctgataacctctgatgaggattccagctacatcaatgccaacttcattaagggagtttatggacccaaggcttatattgccacccagggtcctttatctacaaccctcctggacttctggaggatgatttgggaatatagtgtccttatcattgttatggcatgcatggagtatgaaatgggaaagaaaaagtgtgagcgctactgggctgagccaggagagatgcagctggaatttggccctttctctgtatcctgtgaagctgaaaaaaggaaatctgattatataatcaggactctaaaagttaagttcaatagtgaaactcgaactatctaccagtttcattacaagaattggccagaccatgatgtaccttcatctatagaccctattcttgagctcatctgggatgtacgttgttaccaagaggatgacagtgttcccatatgcattcactgcagtgctggctgtggaaggactggtgttatttgtgctattgattatacatggatgttgctaaaagatgggataattcctgagaacttcagtgttttcagtttgatccgggaaatgcggacacagaggccttcattagttcaaacgcaggaacaatatgaactggtctacaatgctgtattagaactatttaagagacagatggatgttatcagagataaacattctggaacagagagtcaagcaaagcattgtattcctgagaaaaatcacactctccaagcagactcttattctcctaatttaccaaaaagtaccacaaaagcagcaaaaatgatgaaccaacaaaggacaaaaatggaaatcaaagaatcttcttcctttgactttaggacttctgaaataagtgcaaaagaagagctagttttgcaccctgctaaatcaagcacttcttttgactttctggagctaaattacagttttgacaaaaatgctgacacaaccatgaaatggcagacaaaggcatttccaatagttggggagcctcttcagaagcatcaaagtttggatttgggctctcttttgtttgagggatgttctaattctaaacctgtaaatgcagcaggaagatattttaattcaaaggtgccaataacacggaccaaatcaactccttttgaattgatacagcagagagaaaccaaggaggtggacagcaaggaaaacttttcttatttggaatctcaaccacatgattcttgttttgtagagatgcaggctcaaaaagtaatgcatgtttcttcagcagaactgaattattcactgccatatgactctaaacaccaaatacgtaatgcctctaatgtaaagcaccatgactctagtgctcttggtgtatattcttacatacctttagtggaaaatccttatttttcatcatggcctccaagtggtaccagttctaagatgtctcttgatttacctgagaagcaagatggaactgtttttccttcttctctgttgccaacatcctctacatccctcttctcttattacaattcacatgattctttatcactgaattctccaaccaatatttcctcactattgaaccaggagtcagctgtactagcaactgctccaaggatagatgatgaaatcccccctccacttcctgtatggacacctgaatcatttattgtggttgaggaagctggagaattctcaccaaatgttcccaaatccttatcctcagctgtgaaggtaaaaattggaacatcactggaatggggtggaacatctgaaccaaagaaatttgatgactctgtgatacttagaccaagcaagagtgtaaaactccgaagtcctaaatcaggtaaaaatttctcttggctttagatgacatttagccctaagattggaagaatggttcgttaagtttagagtaattcacttcaggaagttacttggttcccataatagcttccagtattcattgatttatttctggctttcccagactagaaattttgtaaagag

SEQ ID NO: 16888 - DNA, 565 bp, Homo sapiens
  ENST00000534519
agcatgctctgctcaggcggcagcagtggctttttggaggtgtctcggccatgacacacatttgacatgccctccctcaacctacttatagactatttttcttgctctgcagcatggaccaaagagaaattctgcagaagttcctggatgaggcccaaagcaagaaaattactaaagaggagtttgccaatgaatttctgaagctgaaaaggcaatctaccaagtacaaggcagacaaaacctatcctacaactgtggctgagaagcccaagaatatcaagaaaaacagatataaggatattttgccctatgattatagccgggtagaactatccctgataacctctgatgaggattccagctacatcaatgccaacttcattaagggagtttatggacccaaggcttatattgccacccagggtcctttatctacaaccctcctggacttctggaggatgatttgggaatatagtgtccttatcattgttatggcatgcatggagtatgaaatgggaaagactcccaggaagtctgtaatttatatatcctttaatgtttgttt

SEQ ID NO: 16889 - DNA, 527 bp, Homo sapiens
  ENST00000529045
agtaaaccacagccttcagcatgctctgctcaggcggcagcagtggctttttggaggtgtctcggccatgacacacatttgacatgccctccctcaacctacttatagactatttttcttgctctgcagcatggaccaaagagaaattctgcagaagttcctggatgaggcccaaagcaagaaaattactaaagaggagtttgccaatgaatttctgggtcttgctctgtcacccaggctggagtgccgtggcttgatcatagctcactgcagacttgacttcctggactcaagtgatcctccagcctcagcctcccaaagtgctgagattacaaccatgagccaccacacctggccagagaaagctttctggacctctttgaatagatcaaatcttctattaagctgaaaaggcaatctaccaagtacaaggcagacaaaacctatcctacaactgtggctgagaagcccaagaatatcaagaaaaacagatataaggatattttgccctatgattatagccgggt

SEQ ID NO: 16890 - DNA, 3575 bp, Homo sapiens
  ENST00000538253
agtaaaccacagccttcagcatgctctgctcaggcggcagcagtggctttttggaggtgtctcggccatgacacacatttgacatgccctccctcaacctacttatagactatttttcttgctctgcagcatggaccaaagagaaattctgcagaagttcctggatgaggcccaaagcaagaaaattactaaagaggagtttgccaatgaatttctgaagctgaaaaggcaatctaccaagtacaaggcagacaaaacctatcctacaactgtggctgagaagcccaagaatatcaagaaaaacagatataaggatattttgccctatgattatagccgggtagaactatccctgataacctctgatgaggattccagctacatcaatgccaacttcattaagggagtttatggacccaaggcttatattgccacccagggtcctttatctacaaccctcctggacttctggaggatgatttgggaatatagtgtccttatcattgttatggcatgcatggagtatgaaatgggaaaggaagctgaaaaaaggaaatctgattatataatcaggactctaaaagttaagttcaatagtgaaactcgaactatctaccagtttcattacaagaattggccagaccatgatgtaccttcatctatagaccctattcttgagctcatctgggatgtacgttgttaccaagaggatgacagtgttcccatatgcattcactgcagtgctggctgtggaaggactggtgttatttgtgctattgattatacatggatgttgctaaaagatgggataattcctgagaacttcagtgttttcagtttgatccgggaaatgcggacacagaggccttcattagttcaaacgcaggaacaatatgaactggtctacaatgctgtattagaactatttaagagacagatggatgttatcagagataaacattctggaacagagagtcaagcaaagcattgtattcctgagaaaaatcacactctccaagcagactcttattctcctaatttaccaaaaagtaccacaaaagcagcaaaaatgatgaaccaacaaaggacaaaaatggaaatcaaagaatcttcttcctttgactttaggacttctgaaataagtgcaaaagaagagctagttttgcaccctgctaaatcaagcacttcttttgactttctggagctaaattacagttttgacaaaaatgctgacacaaccatgaaatggcagacaaaggcatttccaatagttggggagcctcttcagaagcatcaaagtttggatttgggctctcttttgtttgagggatgttctaattctaaacctgtaaatgcagcaggaagatattttaattcaaaggtgccaataacacggaccaaatcaactccttttgaattgatacagcagagagaaaccaaggaggtggacagcaaggaaaacttttcttatttggaatctcaaccacatgattcttgttttgtagagatgcaggctcaaaaagtaatgcatgtttcttcagcagaactgaattattcactgccatatgactctaaacaccaaatacgtaatgcctctaatgtaaagcaccatgactctagtgctcttggtgtatattcttacatacctttagtggaaaatccttatttttcatcatggcctccaagtggtaccagttctaagatgtctcttgatttacctgagaagcaagatggaactgtttttccttcttctctgttgccaacatcctctacatccctcttctcttattacaattcacatgattctttatcactgaattctccaaccaatatttcctcactattgaaccaggagtcagctgtactagcaactgctccaaggatagatgatgaaatcccccctccacttcctgtatggacacctgaatcatttattgtggttgaggaagctggagaattctcaccaaatgttcccaaatccttatcctcagctgtgaaggtaaaaattggaacatcactggaatggggtggaacatctgaaccaaagaaatttgatgactctgtgatacttagaccaagcaagagtgtaaaactccgaagtcctaaatcagaactacatcaagatcgttcttctcccccacctcctctcccagaaagaactctagagtccttctttcttgccgatgaagattgtatgcaggcccaatctatagaaacatattctactagctatcctgacaccatggaaaattcaacatcttcaaaacagacactgaagactcctggaaaaagtttcacaaggagtaagagtttgaaaattttgcgaaacatgaaaaagagtatctgtaattcttgcccaccaaacaagcctgcagaatctgttcagtcaaataactccagctcatttctgaattttggttttgcaaaccgtttttcaaaacccaaaggaccaaggaatccaccaccaacttggaatatttaataaaactccagatttataataatatgggctgcaagtacacctgcaaataaaactactagaatactgctagttaaaataagtgctctatatgcataatatcaaatatgaagatatgctaatgtgttaatagcttttaaaagaaaagcaaaatgccaataagtgccagttttgcattttcatatcatttgcattgagttgaaaactgcaaataaaagtttgtcacttgagcttatgtacagaatgctatatgagaaacacttttagaatggatttatttttcatttttgccagttatttttattttcttttacttttctacataaacataaacttcaaaaggtttgtaagatttggatctcaactaatttctacattgccagaatatactataaaaagttaaaaaaaaaacttactttgtgggttgcaatacaaactgctcttgacaatgactattccctgacagttatttttgcctaaatggagtataccttgtaaatcttcccaaatgttgtggaaaactggaatattaagaaaatgagaaattatatttattagaataaaatgtgcaaataatgacaattatttgaatgtaacaaggaattcaactgaaatcctgataagttttaaccaaagtcattaaattaccaattctagaaaagtaatcaatgaaatataatagctatcttttggtagcaaaagatataaattgtatatgtttatacaggatctttcagatcatgtgcaatttttatctaaccaatcagaaatactagtttaaaatgaatttctatatgaatatggatctgccataagaaaatctagttcaactctaattttatgtagtaaataaattggcaggtaattgtttttacaaagaatccacctgacttcccctaatgcattaaaaatatttttatttaaataactttatttataacttttagaaacatgtagtattgtttaaacatcatttgttcttcagtatttttcatttggaagtccaatagggcaaattgaatgaagtattattatctgtctcttgtagtacaatgtatccaacagacactcaataaactttttggttgttaaactg

SEQ ID NO: 16891 - DNA, 587 bp, Homo sapiens
  ENST00000447271
tcccagcgacttccaatattcatgtttctgagaattgtgtccctcttcaggttccctcttggtgcctaacctggattagtaatgtgcattcaggtgaattttcagctgaggctctgagaactggtactctcagtgtgttctggtcatcttgtggcttagttgtagaagcaggtgtgtctcttgcctctgcttgcctcctactgcacactcagcacccaggactggaatcaccgactactgaatctcctacatgtattgctgctacttcaagctcctccacttgaaaccttatgattttcccaaggggagatgggacagtgtcatctaaatattccgaatgtttggccttctgagaaaagagcttctagtaattgaaccatgggaaacccagcttctggagggttggccgtggggctgtgtacatgtgtgtgcccagggaaatcaactcttttggaggagagtgctctctgctcatctccaccttccctctggtcaggagcatgaactcccatcttggccttgtcctggggtattagtccattctcatgctgctaataaagacatacctgagactgggtaatttatga

SEQ ID NO: 16892 - DNA, 6703 bp, Homo sapiens
  ENST00000374541
gacggcggccaggtcgcgccgcgagcgagcttccgcgccgcccgcacgcgcgacctacctgggcgctccgcgcccccggatgctgcaggttattcagcgatagttatgacctcccggttacgtgcgttgggtggaagaattaataatatacgcacctcggagttacccaaagagaaaactcgatcagaagtcatttgcagcatccactttttagatggcgtggtacagacctttaaagttactaaacaagacactggccaggttcttctggatatggtgcacaaccacctgggtgtgactgaaaaggaatattttggtttacagcatgatgacgactccgtggactctcctagatggctggaagcaagcaaagccatcaggaagcagttaaaaggaggtttcccctgtaccctgcattttcgagtaagattttttatacctgatcccaacacactgcagcaagaacaaaccaggcacttgtatttcttacaactgaagatggatatttgcgaaggaaggttaacctgccctcttaactcagcagtggttctagcgtcctatgccgtacaatctcattttggagactataattcttccatacatcatccaggctatctttccgatagtcactttatacccgatcaaaatgaggactttttaacaaaagtcgaatctctgcatgagcagcacagtgggctaaaacaatcagaagcagaatcctgctatatcaacatagcgcggaccctcgacttctatggagtagaactgcacagtggtagggatctgcacaatttagacctaatgattggaattgcttccgcgggtgttgctgtgtaccgaaaatacatttgcacaagtttctatccttgggtgaacattctcaaaatttctttcaaaaggaaaaagttcttcatacatcagcgacagaaacaggctgaatccagggaacatattgtggccttcaacatgctgaattaccgatcttgcaaaaacttgtggaaatcctgtgttgagcaccatacgttctttcaggcaaagaagctactacctcaggaaaagaatgttctgtctcagtactggactatgggctctcggaacaccaaaaagtcggtaaataaccaatattgcaaaaaggtgattggcgggatggtgtggaacccagccatgcggagatccttatcagtggagcacttagaaaccaagagtctgccttctcgttcccctcccattactcccaactggcgaagtcctcggctccggcacgaaatccgaaagccacgccactcttctgcagataaccttgcaaatgaaatgacctacatcacggaaacggaagatgtattttacacgtacaagggctctctggcccctcaagacagcgattctgaagtttctcagaaccgaagcccgcaccaagagagtttatccgagaacaatccggcacaaagctacctgacccagaagtcatccagttctgtgtctccatcttcaaatgctccaggctcctgctcacctgacggcgttgatcagcagctcttagatgacttccacagggtgaccaaagggggctccaccgaggacgccagccagtactactgtgacaagaatgataatggtgacagctacttagtcttgatccgtatcacaccagatgaagatggaaaatttggatttaatcttaagggaggagtggatcaaaagatgcctcttgtggtatcaaggataaacccagagtcacctgcggacacctgcattcctaagctgaacgaaggggatcaaatcgtgttaatcaatggccgggacatctcagaacacacgcatgaccaagtggtgatgttcatcaaagccagccgggagtcccactcacgggagctggccctggtgatcaggaggagagctgtccgctcatttgctgacttcaagtctgaagatgaactgaaccagcttttccccgaagccattttccccatgtgtccggagggtggggacactttggagggatccatggcacagctaaagaagggcctcgaaagcgggacggtgctgatccagtttgagcaactctacagaaaaaagccaggtttggccatcacgtttgcaaagctgcctcaaaatttggacaaaaaccgatataaagatgtgctgccttatgacaccacccgggtattattgcagggaaatgaagattatattaatgcaagttacgtgaacatggaaattcctgctgctaaccttgtgaacaagtacatcgccactcaggggcccctgccgcatacctgtgcacagttttggcaggttgtctgggatcagaagttgtcactcattgtcatgttgacgactctcacagaacgagggcggaccaaatgtcaccagtactggccagatccccccgacgtcatgaaccacggcggctttcacatccagtgtcagtcagaggactgcaccatcgcctatgtgtcccgagaaatgctggtcacaaacacccagaccggggaagaacacacagtgacacatctccagtacgtcgcatggcctgaccacggtgtgcccgatgactcctccgactttctggaatttgtaaactatgtgaggtctctgagagtggacagcgagcccgtcctagttcactgcagtgctggaataggtcgaaccggtgtgttggtcactatggaaacagccatgtgcctaactgagaggaacctgcccatttacccactggatattgtccgaaaaatgcgagaccagcgcgccatgatggtgcagacatcaagccagtacaagtttgtgtgtgaagcgattcttcgtgtgtatgaagaaggtttagtccaaatgctggatcctagttaagacaactgtgaaaaagttcattcctctttcccaagggcatcctccttgaaagaggaggacagacctctctggaagcagcaagaggaaccagtagctgtgggaaaggaatgggcacctctgaacccaggcactttaaacttctatagaaaagatatcgtgtacataggaactggtgtagataagcatgcaattatggcatcatttaggcctgtatttctatggaaagatacaaaaaggatctcagtttggggcctgtcctaatgccttcttccctaacatcaccacacacacccctgtcggcatcctggagcaattgagaccggacacccacagagctgttgtcctcccagcaacaagatggtgtggttatcttgggtcatttggatgttttgtttgtttctgtgtgtcagactgtaagggctgagctttctgtgcttctaggtggagctggaacaattcagattcacccgccctgatgctaaggaaaccctgacgtatgtactagatggcagggcactgggggtcaggctgaaggctgagcaacacctctctgccctccctccctttgtcccatctcccagcgacttccaatattcatgtttctgagaattgtgtccctcttcaggttccctcttggtgcctaacctggattagtaatgtgcattcaggtgaattttcagctgaggctctgagaactggtactctcagtgtgttctggtcatcttgtggcttagttgtagaagcaggtgtgtctcttgcctctgcttgcctcctactgcacactcagcacccaggactggaatcaccgactactgaatctcctacatgtattgctgctacttcaagctcctccacttgaaaccttatgattttcccaaggggagatgggacagtgtcatctaaatattccgaatgtttggccttctgagaaaagagcttctagtaattgaaccatgggaaacccagcttctggagggttggccgtggggctgtgtacatgtgtgtgcccaggggtgagtgtttctcaggattcctaacgattcaaattaccgttgagtatatataaagaatgagtctctgtatggaagaacaaatgtgtgcattcacccccagtcacaatggtctccattgcatttcaaaggagaggatcagactatctgaatataaacacaatctgatgttaatttattctaagaacaccatcattttgattgtcctaaagaattctgcctttgtgaataccgtgttaaatttttttaaatttgtgacaggattgtagcaaattattatttaaggaaaataaattgtgtaaacatttaatgtggtatttttgaacagcggtttttatgtactcagaagaggaagtaaagccaggttcttaatggtatttatagaaaagatgttttcatattataatgcacataaatgaagccattttgatattcagcaaattcggtgccaattgaatagtttgctggtagcaagacggatgaagacctatatgggagattctttatctctagagctagcatatttacttgcatactttgtttcttttccacatggatattttactgctaaatggcagaggtgggagggagatgtcacacagtaccataaccccatattgaaaacaagaaaccaccagaaagtttgcagctaaggggcaggggattcagttcctacgcccactcagcactaactacttgcgggcctggttgcttagaagctctacctctctttcattatctgtaaaatagaaacaatacttaggactttagttggaacatgaggattgaataagatcacgctattcatgtgactttttatcggctagaacagcaacagacactgctgtgggtgagttacttagaaaagtttagttatcagtgattagcccaaaaacacatcagtcaaaaatagaatccactggatttttgtctctctttttagagacagggtctcactgtcgcccaggctggagtacagtggcatgatcattgttcactgcagcctcaaattcctgggctcaagcaatcctcgcacctcagcctcctgagtagccgggactataggcacatgccacctcacctggcttgtgtgtgtgtgtgtgtgtgtgtgtgtgtgtgtgtgtgtgtgtgtgtgtgtgtgtgtgtgtgtagagacaggatcttgatgtgttgcctaggctggtctcaaactcctggcctcaagtgatcttcccacctcagcctccaaaactgttgggattataggcgtgagccactgtgcccagcctaactgggtttttatgagaggaaaatagaaaatgctcttctagaagagagagaacaagagcacaaaataatctggactcacaaaaattcagcaagctccaagaaagggggatggagggaacgctggcaaaaatttaaatgccattaggatatttagcaagttattactgtttggtaaaaatgcatcatcaccctgtgtgcaaaatgcttgcaaagtagtctaaatgtctttggagatgggtgttttactgcttttttccaaaaacaaattgtttattatggttgcagaaatgcagccattacggtcacataaatttctaaaaagcctaccaaaggttgcaagcagtcttctgccactgggcaggccagcagttcagacccagcgaggttgccaggaacaaatccaggaaatactgggaagaacaagacaagagaattacctaaaagagcaaacaattcaagtaaatcctgtagctattaccacttaaaatccgtagctcaagattcctgtttcaccaccttatacacttaagcaattatacttaagcctttttttagtcctaagtgaagaactacatcagaatcaggataagtattttgcctgggaaatttggctgcatatgaatggagaagacatttacatcctatgttctggcactttctgaaagatctaattaaacatgttgatgtgccaatttaatcaagatgagagatccctgctggtgtcaccctctagaacctgcacttggtgttttgactttccagaagaaaaaaatgcaactttggttagggggcagtggttggatcacacagttgtctttcgtttcctaccacagtaattcatatttaaatatgcttttagattagtgtggatactattgctgctgtgttgctacctgacctttttctggggggggtacctcagaaatgagcatttgagggcaagcgaaaaagccctcttcatcctccagaggcaacaaagaggcagcagaaatggggaaagattgtgagaggcagggcttgggtctagacctggacttaggcaagatatgttgccctcaaccctgagttttcttatatgtaaaaagggaaggttgggctggactagatgaggtcaagatttgccattctgggaggctgatattccagagaatcaaaattaatcctaaaccaaagctttatggctgctacagagacatgtcacatttctgagacttgtcaccaagagtttgtccctcagactttggcgctgttgaatgcaaagacaaggatggccaccttctggttcttgcctgttgtcctcagctgagagcagtctcggtaaaggtggcaaagattctgtgacctcagaccggggaccaaatgcttgggagtctgatggccgggctgggccaccattctcatagctctcattctgtttggagcaaccaaaggatttgtgtgaagttatttggaaaaggaccttaactgagcagtaatcttttttctgtatatttggaatgtttttcattctgacctgttctgtcagtgattctactgaaaaacaatttaatcaatataaaaatgttcaagctatgcaa

SEQ ID NO: 16893 - DNA, 781 bp, Homo sapiens
  ENST00000497739
gaaagggcccctgcaagaatacttgttaggtttgccagcagtagaatctgcatctgggactgtgcctggaaaggggcactatggaaggtcccaaaattactagcaacgatttcaattcagcaaacctttctgggaaggacacttaggttgagtagaacatagcataagaagtgccaatatagccgggtgcagtgactcacgcctgtaatcccagcactttgggaggtccaggcgggcagatcagttgaggtcaggagtttgagaccagcctggccagcatgagaaaaccctgtctctactaaaaatacaaaaattagccaggcatggtgatgcacacctgtagtcccagctactcggaaggctgaggcacgagaatcgcttgaacctgggaggtggacgttacagtgagccgagatcacgtcactgcactccagcctgggcaacaaagagagaccctgtctcaggaagagaaaaaaaaagtgccacaactctacagaaaaaagccaggtttggccatcacgtttgcaaagctgcctcaaaatttggacaaaaaccgatataaagatgtgctgccttatgacaccacccgggtattattgcagggaaatgaagattatattaatgcaagttacgtgaacatggaaattcctgctgctaaccttgtgaacaagtacatcgccactcaggggcccctgccgcatacctgtgcacagttttggcaggttgtctgggatcagaagttgtcactcattgtcatgttgacgactctcacagaacgagg

SEQ ID NO: 16894 - DNA, 8765 bp, Homo sapiens
  ENST00000412145
gaagggtggtatcccgttgtggagtagaatgtaactatgaccttctgggatttgggcaccagatttatcttactgcaacaggagccatggtgggagccacccccataactcttatagagctggtgggccaccaggactgccagatatatatatatattttttgaaacagggtcttgctatgttgcccagactggcctcaaactcctggactcaaaggatcctccctcagcctcctgagtagctgggattataggcacataccaccacgactagctgccagatcatcttatcttggaccaggcttctaccattaattcacatgctttaaaaaaattaaaaattaaaaaaatgaaaaataaaaaaacttaaaagattttacctatattcctggaacatagttatcttaccccagctttgtagttcctgtttaaggaaattccctctgaaggaaattttagctctcaagagtcaaagaagatgtatagaggtggtatctgttagtttttgtttgtttgttaaggatctaggcagagaggtcattacatttttctgaagttgaggtcacaggtggggtacccacaagagaggtcattacatttctgaagttaggcatcccaggcatctcttctaaagaactatcctgtattctaattgttaaataaatatcttcttcattgtgagcctccacaactgctgtttctgataaatttagatcattctttgcagaattttatatactggcaatctcaaaactaggctccttcaagattcctaggaagtctcccaagctcgggttgggttccactattctagtttctttgtgtatgatgccatggggttgactcagaaactttgctcaatatatgacaaggcagcatttggtgagtggtgatctccacgtttatcttctcatttatatccctaggaagacatactgattagctgagcttgtcaatgaaagcccgggttcaccattggattatctataactctcctttctctttttttctctcagtagcattgtaggaggagagaacacttaattctggttgaatgtcagcttggataaacatagaaacaaactagaaagaactgatgatgttctcctaggtggaaaagatggagattccaataccaaataggtgtgaatcagcaaatgtatgttatactgtctctcaaggccaggtgttcaatacattgtgggtagttaattataatcaaagtaataatattagagttacgacatggatcctaagctttttagccattaaacatataagaaatttgtagcatagtgagtttttttataacatgatcatccaggttaaaataagacacaattgacctcacatatcctatctgagctccgattttgtcatctgtaaaaatggagatagtggtacctaccttacagagttatgaggctgagataagagggaaagttacaaagtagtaccatgtacaaagcccggaactgtgcaaataggaggttgtaatactgtttgaagcattcccatctcaaaaagccagttccttggcctttataaatttgaaggaataatgaaactgatttgtttcaattgtgaaaattatttctctcctgcccctgtgcacttctgccctgtctatattagatttcaagaggtttcccttttgtcatcttggccagacaatggaatgtctatcccgtttgaatctgggtttaaaaaagcatgggagctagtggccaagtgtcacatgtatgccgcatccctaaatagaagtctccccagggcgcttcctgacctgcgcaatgctgccgaaggcctcctttccccgctccccaggcagaggagcaaagtcacaggctgaggggcctgccacgacttgcccacaaaacaggtctggagtttggaagttacatttgctggttgcccagagatgagtgcagaattcagcttggaggtcctggaaacttctagtttactgatgtttatgcttttgctcatgcacccacagttcctgggacacagaatgctcacctgggggtttgtaccccagccaagaaggtgtcttcacagactcccctccttttagcaacttcatgcagatggagcttgggtggatggatcctggcacagtgttcagaacagtggccctgccagtgtgtgggcgccgcttgtgcagagcccctgtgggttctggtcctcaagggcaggggcgctcactgacagcggaacccatagtaccagcccatctttggtgggctgtttccaccccattcatccctgctcagctcttcataggacagcctgtgctggcagaaaattgcccccaccagtcaagacgtagggcatcaacatgagccatcagtaatgacagggcagctttgcagagcgtaaggtagcacctgataccttggaccaaaaccgtatttttatgtatctttcacatgtacagctcttgtctttgactcatcaaactttcttttttttttttttttgcttatttcagtttgagtatgaattaatgaaaacaattgtttcataggcacttgtatttcttacaactgaagatggatatttgcgaaggaaggttaacctgccctcttaactcagcagtggttctagcgtcctatgccgtacaatctcattttggagactataattcttccatacatcatccaggctatctttccgatagtcactttatacccgatcaaaatgaggactttttaacaaaagtcgaatctctgcatgagcagcacagtgggctaaaacaatcagaagcagaatcctgctatatcaacatagcgcggaccctcgacttctatggagtagaactgcacagtggtagggatctgcacaatttagacctaatgattggaattgcttccgcgggtgttgctgtgtaccgaaaatacatttgcacaagtttctatccttgggtgaacattctcaaaatttctttcaaaaggaaaaagttcttcatacatcagcgacagaaacaggctgaatccagggaacatattgtggccttcaacatgctgaattaccgatcttgcaaaaacttgtggaaatcctgtgttgagcaccatacgttctttcaggcaaagaagctactacctcaggaaaagaatgttctgtctcagtactggactatgggctctcggaacaccaaaaagtcggtaaataaccaatattgcaaaaaggtgattggcgggatggtgtggaacccagccatgcggagatccttatcagtggagcacttagaaaccaagagtctgccttctcgttcccctcccattactcccaactggcgaagtcctcggctccggcacgaaatccgaaagccacgccactcttctgcagataaccttgcaaatgaaatgacctacatcacggaaacggaagatgtattttacacgtacaagggctctctggcccctcaagacagcgattctgaagtttctcagaaccgaagcccgcaccaagagagtttatccgagaacaatccggcacaaagctacctgacccagaagtcatccagttctgtgtctccatcttcaaatgctccaggctcctgctcacctgacggcgttgatcagcagctcttagatgacttccacagggtgaccaaagggggctccaccgaggacgccagccagtactactgtgacaagaatgataatggtgacagctacttagtcttgatccgtatcacaccagatgaagatggaaaatttggatttaatcttaagggaggagtggatcaaaagatgcctcttgtggtatcaaggataaacccagagtcacctgcggacacctgcattcctaagctgaacgaaggggatcaaatcgtgttaatcaatggccgggacatctcagaacacacgcatgaccaagtggtgatgttcatcaaagccagccgggagtcccactcacgggagctggccctggtgatcaggaggagagctgtccgctcatttgctgacttcaagtctgaagatgaactgaaccagcttttccccgaagccattttccccatgtgtccggagggtggggacactttggagggatccatggcacagctaaagaagggcctcgaaagcgggacggtgctgatccagtttgagcaactctacagaaaaaagccaggtttggccatcacgtttgcaaagctgcctcaaaatttggacaaaaaccgatataaagatgtgctgccttatgacaccacccgggtattattgcagggaaatgaagattatattaatgcaagttacgtgaacatggaaattcctgctgctaaccttgtgaacaagtacatcgccactcaggggcccctgccgcatacctgtgcacagttttggcaggttgtctgggatcagaagttgtcactcattgtcatgttgacgactctcacagaacgagggcggaccaaatgtcaccagtactggccagatccccccgacgtcatgaaccacggcggctttcacatccagtgtcagtcagaggactgcaccatcgcctatgtgtcccgagaaatgctggtcacaaacacccagaccggggaagaacacacagtgacacatctccagtacgtcgcatggcctgaccacggtgtgcccgatgactcctccgactttctggaatttgtaaactatgtgaggtctctgagagtggacagcgagcccgtcctagttcactgcagtgctggaataggtcgaaccggtgtgttggtcactatggaaacagccatgtgcctaactgagaggaacctgcccatttacccactggatattgtccgaaaaatgcgagaccagcgcgccatgatggtgcagacatcaagccagtacaagtttgtgtgtgaagcgattcttcgtgtgtatgaagaaggtttagtccaaatgctggatcctagttaagacaactgtgaaaaagttcattcctctttcccaagggcatcctccttgaaagaggaggacagacctctctggaagcagcaagaggaaccagtagctgtgggaaaggaatgggcacctctgaacccaggcactttaaacttctatagaaaagatatcgtgtacataggaactggtgtagataagcatgcaattatggcatcatttaggcctgtatttctatggaaagatacaaaaaggatctcagtttggggcctgtcctaatgccttcttccctaacatcaccacacacacccctgtcggcatcctggagcaattgagaccggacacccacagagctgttgtcctcccagcaacaagatggtgtggttatcttgggtcatttggatgttttgtttgtttctgtgtgtcagactgtaagggctgagctttctgtgcttctaggtggagctggaacaattcagattcacccgccctgatgctaaggaaaccctgacgtatgtactagatggcagggcactgggggtcaggctgaaggctgagcaacacctctctgccctccctccctttgtcccatctcccagcgacttccaatattcatgtttctgagaattgtgtccctcttcaggttccctcttggtgcctaacctggattagtaatgtgcattcaggtgaattttcagctgaggctctgagaactggtactctcagtgtgttctggtcatcttgtggcttagttgtagaagcaggtgtgtctcttgcctctgcttgcctcctactgcacactcagcacccaggactggaatcaccgactactgaatctcctacatgtattgctgctacttcaagctcctccacttgaaaccttatgattttcccaaggggagatgggacagtgtcatctaaatattccgaatgtttggccttctgagaaaagagcttctagtaattgaaccatgggaaacccagcttctggagggttggccgtggggctgtgtacatgtgtgtgcccaggggtgagtgtttctcaggattcctaacgattcaaattaccgttgagtatatataaagaatgagtctctgtatggaagaacaaatgtgtgcattcacccccagtcacaatggtctccattgcatttcaaaggagaggatcagactatctgaatataaacacaatctgatgttaatttattctaagaacaccatcattttgattgtcctaaagaattctgcctttgtgaataccgtgttaaatttttttaaatttgtgacaggattgtagcaaattattatttaaggaaaataaattgtgtaaacatttaatgtggtatttttgaacagcggtttttatgtactcagaagaggaagtaaagccaggttcttaatggtatttatagaaaagatgttttcatattataatgcacataaatgaagccattttgatattcagcaaattcggtgccaattgaatagtttgctggtagcaagacggatgaagacctatatgggagattctttatctctagagctagcatatttacttgcatactttgtttcttttccacatggatattttactgctaaatggcagaggtgggagggagatgtcacacagtaccataaccccatattgaaaacaagaaaccaccagaaagtttgcagctaaggggcaggggattcagttcctacgcccactcagcactaactacttgcgggcctggttgcttagaagctctacctctctttcattatctgtaaaatagaaacaatacttaggactttagttggaacatgaggattgaataagatcacgctattcatgtgactttttatcggctagaacagcaacagacactgctgtgggtgagttacttagaaaagtttagttatcagtgattagcccaaaaacacatcagtcaaaaatagaatccactggatttttgtctctctttttagagacagggtctcactgtcgcccaggctggagtacagtggcatgatcattgttcactgcagcctcaaattcctgggctcaagcaatcctcgcacctcagcctcctgagtagccgggactataggcacatgccacctcacctggcttgtgtgtgtgtgtgtgtgtgtgtgtgtgtgtgtgtgtgtgtgtgtgtgtgtgtgtgtgtgtgtagagacaggatcttgatgtgttgcctaggctggtctcaaactcctggcctcaagtgatcttcccacctcagcctccaaaactgttgggattataggcgtgagccactgtgcccagcctaactgggtttttatgagaggaaaatagaaaatgctcttctagaagagagagaacaagagcacaaaataatctggactcacaaaaattcagcaagctccaagaaagggggatggagggaacgctggcaaaaatttaaatgccattaggatatttagcaagttattactgtttggtaaaaatgcatcatcaccctgtgtgcaaaatgcttgcaaagtagtctaaatgtctttggagatgggtgttttactgcttttttccaaaaacaaattgtttattatggttgcagaaatgcagccattacggtcacataaatttctaaaaagcctaccaaaggttgcaagcagtcttctgccactgggcaggccagcagttcagacccagcgaggttgccaggaacaaatccaggaaatactgggaagaacaagacaagagaattacctaaaagagcaaacaattcaagtaaatcctgtagctattaccacttaaaatccgtagctcaagattcctgtttcaccaccttatacacttaagcaattatacttaagcctttttttagtcctaagtgaagaactacatcagaatcaggataagtattttgcctgggaaatttggctgcatatgaatggagaagacatttacatcctatgttctggcactttctgaaagatctaattaaacatgttgatgtgccaatttaatcaagatgagagatccctgctggtgtcaccctctagaacctgcacttggtgttttgactttccagaagaaaaaaatgcaactttggttagggggcagtggttggatcacacagttgtctttcgtttcctaccacagtaattcatatttaaatatgcttttagattagtgtggatactattgctgctgtgttgctacctgacctttttctggggggggtacctcagaaatgagcatttgagggcaagcgaaaaagccctcttcatcctccagaggcaacaaagaggcagcagaaatggggaaagattgtgagaggcagggcttgggtctagacctggacttaggcaagatatgttgccctcaaccctgagttttcttatatgtaaaaagggaaggttgggctggactagatgaggtcaagatttgccattctgggaggctgatattccagagaatcaaaattaatcctaaaccaaagctttatggctgctacagagacatgtcacatttctgagacttgtcaccaagagtttgtccctcagactttggcgctgttgaatgcaaagacaaggatggccaccttctggttcttgcctgttgtcctcagctgagagcagtctcggtaaaggtggcaaagattctgtgacctcagaccggggaccaaatgcttgggagtctgatggccgggctgggccaccattctcatagctctcattctgtttggagcaaccaaaggatttgtgtgaagttatttggaaaaggaccttaactgagcagtaatcttttttctgtatatttggaatgtttttcattctgacctgttctgtcagtgattctactgaaaaacaatttaatcaatataaaaatgttcaagctatgcaacactgt

SEQ ID NO: 16895 - DNA, 8630 bp, Homo sapiens
  ENST00000446349
gaagggtggtatcccgttgtggagtagaatgtaactatgaccttctgggatttgggcaccagatttatcttactgcaacaggagccatggtgggagccacccccataactcttatagagctggtgggccaccaggactgccagatatatatatatattttttgaaacagggtcttgctatgttgcccagactggcctcaaactcctggactcaaaggatcctccctcagcctcctgagtagctgggattataggcacataccaccacgactagctgccagatcatcttatcttggaccaggcttctaccattaattcacatgctttaaaaaaattaaaaattaaaaaaatgaaaaataaaaaaacttaaaagattttacctatattcctggaacatagttatcttaccccagctttgtagttcctgtttaaggaaattccctctgaaggaaattttagctctcaagagtcaaagaagatgtatagaggtggtatctgttagtttttgtttgtttgttaaggatctaggcagagaggtcattacatttttctgaagttgaggtcacaggtggggtacccacaagagaggtcattacatttctgaagttaggcatcccaggcatctcttctaaagaactatcctgtattctaattgttaaataaatatcttcttcattgtgagcctccacaactgctgtttctgataaatttagatcattctttgcagaattttatatactggcaatctcaaaactaggctccttcaagattcctaggaagtctcccaagctcgggttgggttccactattctagtttctttgtgtatgatgccatggggttgactcagaaactttgctcaatatatgacaaggcagcatttggtgagtggtgatctccacgtttatcttctcatttatatccctaggaagacatactgattagctgagcttgtcaatgaaagcccgggttcaccattggattatctataactctcctttctctttttttctctcagtagcattgtaggaggagagaacacttaattctggttgaatgtcagcttggataaacatagaaacaaactagaaagaactgatgatgttctcctaggtggaaaagatggagattccaataccaaataggtgtgaatcagcaaatgtatgttatactgtctctcaaggccaggtgttcaatacattgtgggtagttaattataatcaaagtaataatattagagttacgacatggatcctaagctttttagccattaaacatataagaaatttgtagcatagtgagtttttttataacatgatcatccaggttaaaataagacacaattgacctcacatatcctatctgagctccgattttgtcatctgtaaaaatggagatagtggtacctaccttacagagttatgaggctgagataagagggaaagttacaaagtagtaccatgtacaaagcccggaactgtgcaaataggaggttgtaatactgtttgaagcattcccatctcaaaaagccagttccttggcctttataaatttgaaggaataatgaaactgatttgtttcaattgtgaaaattatttctctcctgcccctgtgcacttctgccctgtctatattagatttcaagaggtttcccttttgtcatcttggccagacaatggaatgtctatcccgtttgaatctgggtttaaaaaagcatgggagctagtggccaagtgtcacatgtatgccgcatccctaaatagaagtctccccagggcgcttcctgacctgcgcaatgctgccgaaggcctcctttccccgctccccaggcagaggagcaaagtcacaggctgaggggcctgccacgacttgcccacaaaacaggtctggagtttggaagttacatttgctggttgcccagagatgagtgcagaattcagcttggaggtcctggaaacttctagtttactgatgtttatgcttttgctcatgcacccacagttcctgggacacagaatgctcacctgggggtttgtaccccagccaagaaggtgtcttcacagactcccctccttttagcaacttcatgcagatggagcttgggtggatggatcctggcacagtgttcagaacagtggccctgccagtgtgtgggcgccgcttgtgcagagcccctgtgggttctggtcctcaagggcaggggcgctcactgacagcggaacccatagtaccagcccatctttggtgggctgtttccaccccattcatccctgctcagctcttcataggacagcctgtgctggcagaaaattgcccccaccagtcaagacgtagggcatcaacatgagccatcagtaatgacagggcagctttgcagagcgtaaggtagcacctgataccttggaccaaaaccgtatttttatgtatctttcacatgtacagctcttgtctttgactcatcaaactttcttttttttttttttttgcttatttcagtttgagtatgaattaatgaaaacaattgtttcataggcacttgtatttcttacaactgaagatggatatttgcgaaggaaggttaacctgccctcttaactcagcagtggttctagcgtcctatgccgtacaatctcattttggagactataattcttccatacatcatccaggctatctttccgatagtcactttatacccgatcaaaatgaggactttttaacaaaagtcgaatctctgcatgagcagcacagtgggctaaaacaatcagaagcagaatcctgctatatcaacatagcgcggaccctcgacttctatggagtagaactgcacagtggtagggatctgcacaatttagacctaatgattggaattgcttccgcgggtgttgctgtgtaccgaaaatacatttgcacaagtttctatccttgggtgaacattctcaaaatttctttcaaaaggaaaaagttcttcatacatcagcgacagaaacaggctgaatccagggaacatattgtggccttcaacatgctgaattaccgatcttgcaaaaacttgtggaaatcctgtgttgagcaccatacgttctttcaggcaaagaagctactacctcaggaaaagaatgttctgtctcagtactggactatgggctctcggaacaccaaaaagcgaagtcctcggctccggcacgaaatccgaaagccacgccactcttctgcagataaccttgcaaatgaaatgacctacatcacggaaacggaagatgtattttacacgtacaagggctctctggcccctcaagacagcgattctgaagtttctcagaaccgaagcccgcaccaagagagtttatccgagaacaatccggcacaaagctacctgacccagaagtcatccagttctgtgtctccatcttcaaatgctccaggctcctgctcacctgacggcgttgatcagcagctcttagatgacttccacagggtgaccaaagggggctccaccgaggacgccagccagtactactgtgacaagaatgataatggtgacagctacttagtcttgatccgtatcacaccagatgaagatggaaaatttggatttaatcttaagggaggagtggatcaaaagatgcctcttgtggtatcaaggataaacccagagtcacctgcggacacctgcattcctaagctgaacgaaggggatcaaatcgtgttaatcaatggccgggacatctcagaacacacgcatgaccaagtggtgatgttcatcaaagccagccgggagtcccactcacgggagctggccctggtgatcaggaggagagctgtccgctcatttgctgacttcaagtctgaagatgaactgaaccagcttttccccgaagccattttccccatgtgtccggagggtggggacactttggagggatccatggcacagctaaagaagggcctcgaaagcgggacggtgctgatccagtttgagcaactctacagaaaaaagccaggtttggccatcacgtttgcaaagctgcctcaaaatttggacaaaaaccgatataaagatgtgctgccttatgacaccacccgggtattattgcagggaaatgaagattatattaatgcaagttacgtgaacatggaaattcctgctgctaaccttgtgaacaagtacatcgccactcaggggcccctgccgcatacctgtgcacagttttggcaggttgtctgggatcagaagttgtcactcattgtcatgttgacgactctcacagaacgagggcggaccaaatgtcaccagtactggccagatccccccgacgtcatgaaccacggcggctttcacatccagtgtcagtcagaggactgcaccatcgcctatgtgtcccgagaaatgctggtcacaaacacccagaccggggaagaacacacagtgacacatctccagtacgtcgcatggcctgaccacggtgtgcccgatgactcctccgactttctggaatttgtaaactatgtgaggtctctgagagtggacagcgagcccgtcctagttcactgcagtgctggaataggtcgaaccggtgtgttggtcactatggaaacagccatgtgcctaactgagaggaacctgcccatttacccactggatattgtccgaaaaatgcgagaccagcgcgccatgatggtgcagacatcaagccagtacaagtttgtgtgtgaagcgattcttcgtgtgtatgaagaaggtttagtccaaatgctggatcctagttaagacaactgtgaaaaagttcattcctctttcccaagggcatcctccttgaaagaggaggacagacctctctggaagcagcaagaggaaccagtagctgtgggaaaggaatgggcacctctgaacccaggcactttaaacttctatagaaaagatatcgtgtacataggaactggtgtagataagcatgcaattatggcatcatttaggcctgtatttctatggaaagatacaaaaaggatctcagtttggggcctgtcctaatgccttcttccctaacatcaccacacacacccctgtcggcatcctggagcaattgagaccggacacccacagagctgttgtcctcccagcaacaagatggtgtggttatcttgggtcatttggatgttttgtttgtttctgtgtgtcagactgtaagggctgagctttctgtgcttctaggtggagctggaacaattcagattcacccgccctgatgctaaggaaaccctgacgtatgtactagatggcagggcactgggggtcaggctgaaggctgagcaacacctctctgccctccctccctttgtcccatctcccagcgacttccaatattcatgtttctgagaattgtgtccctcttcaggttccctcttggtgcctaacctggattagtaatgtgcattcaggtgaattttcagctgaggctctgagaactggtactctcagtgtgttctggtcatcttgtggcttagttgtagaagcaggtgtgtctcttgcctctgcttgcctcctactgcacactcagcacccaggactggaatcaccgactactgaatctcctacatgtattgctgctacttcaagctcctccacttgaaaccttatgattttcccaaggggagatgggacagtgtcatctaaatattccgaatgtttggccttctgagaaaagagcttctagtaattgaaccatgggaaacccagcttctggagggttggccgtggggctgtgtacatgtgtgtgcccaggggtgagtgtttctcaggattcctaacgattcaaattaccgttgagtatatataaagaatgagtctctgtatggaagaacaaatgtgtgcattcacccccagtcacaatggtctccattgcatttcaaaggagaggatcagactatctgaatataaacacaatctgatgttaatttattctaagaacaccatcattttgattgtcctaaagaattctgcctttgtgaataccgtgttaaatttttttaaatttgtgacaggattgtagcaaattattatttaaggaaaataaattgtgtaaacatttaatgtggtatttttgaacagcggtttttatgtactcagaagaggaagtaaagccaggttcttaatggtatttatagaaaagatgttttcatattataatgcacataaatgaagccattttgatattcagcaaattcggtgccaattgaatagtttgctggtagcaagacggatgaagacctatatgggagattctttatctctagagctagcatatttacttgcatactttgtttcttttccacatggatattttactgctaaatggcagaggtgggagggagatgtcacacagtaccataaccccatattgaaaacaagaaaccaccagaaagtttgcagctaaggggcaggggattcagttcctacgcccactcagcactaactacttgcgggcctggttgcttagaagctctacctctctttcattatctgtaaaatagaaacaatacttaggactttagttggaacatgaggattgaataagatcacgctattcatgtgactttttatcggctagaacagcaacagacactgctgtgggtgagttacttagaaaagtttagttatcagtgattagcccaaaaacacatcagtcaaaaatagaatccactggatttttgtctctctttttagagacagggtctcactgtcgcccaggctggagtacagtggcatgatcattgttcactgcagcctcaaattcctgggctcaagcaatcctcgcacctcagcctcctgagtagccgggactataggcacatgccacctcacctggcttgtgtgtgtgtgtgtgtgtgtgtgtgtgtgtgtgtgtgtgtgtgtgtgtgtgtgtgtgtgtgtagagacaggatcttgatgtgttgcctaggctggtctcaaactcctggcctcaagtgatcttcccacctcagcctccaaaactgttgggattataggcgtgagccactgtgcccagcctaactgggtttttatgagaggaaaatagaaaatgctcttctagaagagagagaacaagagcacaaaataatctggactcacaaaaattcagcaagctccaagaaagggggatggagggaacgctggcaaaaatttaaatgccattaggatatttagcaagttattactgtttggtaaaaatgcatcatcaccctgtgtgcaaaatgcttgcaaagtagtctaaatgtctttggagatgggtgttttactgcttttttccaaaaacaaattgtttattatggttgcagaaatgcagccattacggtcacataaatttctaaaaagcctaccaaaggttgcaagcagtcttctgccactgggcaggccagcagttcagacccagcgaggttgccaggaacaaatccaggaaatactgggaagaacaagacaagagaattacctaaaagagcaaacaattcaagtaaatcctgtagctattaccacttaaaatccgtagctcaagattcctgtttcaccaccttatacacttaagcaattatacttaagcctttttttagtcctaagtgaagaactacatcagaatcaggataagtattttgcctgggaaatttggctgcatatgaatggagaagacatttacatcctatgttctggcactttctgaaagatctaattaaacatgttgatgtgccaatttaatcaagatgagagatccctgctggtgtcaccctctagaacctgcacttggtgttttgactttccagaagaaaaaaatgcaactttggttagggggcagtggttggatcacacagttgtctttcgtttcctaccacagtaattcatatttaaatatgcttttagattagtgtggatactattgctgctgtgttgctacctgacctttttctggggggggtacctcagaaatgagcatttgagggcaagcgaaaaagccctcttcatcctccagaggcaacaaagaggcagcagaaatggggaaagattgtgagaggcagggcttgggtctagacctggacttaggcaagatatgttgccctcaaccctgagttttcttatatgtaaaaagggaaggttgggctggactagatgaggtcaagatttgccattctgggaggctgatattccagagaatcaaaattaatcctaaaccaaagctttatggctgctacagagacatgtcacatttctgagacttgtcaccaagagtttgtccctcagactttggcgctgttgaatgcaaagacaaggatggccaccttctggttcttgcctgttgtcctcagctgagagcagtctcggtaaaggtggcaaagattctgtgacctcagaccggggaccaaatgcttgggagtctgatggccgggctgggccaccattctcatagctctcattctgtttggagcaaccaaaggatttgtgtgaagttatttggaaaaggaccttaactgagcagtaatcttttttctgtatatttggaatgtttttcattctgacctgttctgtcagtgattctactgaaaaacaatttaatcaatataaaaatgttcaagctatgcaacactgt

SEQ ID NO: 16896 - DNA, 6832 bp, Homo sapiens
  ENST00000262539
atgctcagacggcggccaggtcgcgccgcgagcgagcttccgcgccgcccgcacgcgcgacctacctgggcgctccgcgcccccggatgctgcaggttattcagcgatagttatgacctcccggttacgtgcgttgggtggaagaattaataatatacgcacctcggagttacccaaagagaaaactcgatcagaagtcatttgcagcatccactttttagatggcgtggtacagacctttaaagttactaaacaagacactggccaggttcttctggatatggtgcacaaccacctgggtgtgactgaaaaggaatattttggtttacagcatgatgacgactccgtggactctcctagatggctggaagcaagcaaagccatcaggaagcagttaaaaggaggtttcccctgtaccctgcattttcgagtaagattttttatacctgatcccaacacactgcagcaagaacaaaccaggcacttgtatttcttacaactgaagatggatatttgcgaaggaaggttaacctgccctcttaactcagcagtggttctagcgtcctatgccgtacaatctcattttggagactataattcttccatacatcatccaggctatctttccgatagtcactttatacccgatcaaaatgaggactttttaacaaaagtcgaatctctgcatgagcagcacagtgggctaaaacaatcagaagcagaatcctgctatatcaacatagcgcggaccctcgacttctatggagtagaactgcacagtggtagggatctgcacaatttagacctaatgattggaattgcttccgcgggtgttgctgtgtaccgaaaatacatttgcacaagtttctatccttgggtgaacattctcaaaatttctttcaaaaggaaaaagttcttcatacatcagcgacagaaacaggctgaatccagggaacatattgtggccttcaacatgctgaattaccgatcttgcaaaaacttgtggaaatcctgtgttgagcaccatacgttctttcaggcaaagaagctactacctcaggaaaagaatgttctgtctcagtactggactatgggctctcggaacaccaaaaagtcggtaaataaccaatattgcaaaaaggtgattggcgggatggtgtggaacccagccatgcggagatccttatcagtggagcacttagaaaccaagagtctgccttctcgttcccctcccattactcccaactggcgaagtcctcggctccggcacgaaatccgaaagccacgccactcttctgcagataaccttgcaaatgaaatgacctacatcacggaaacggaagatgtattttacacgtacaagggctctctggcccctcaagacagcgattctgaagtttctcagaaccgaagcccgcaccaagagagtttatccgagaacaatccggcacaaagctacctgacccagaagtcatccagttctgtgtctccatcttcaaatgctccaggctcctgctcacctgacggcgttgatcagcagctcttagatgacttccacagggtgaccaaagggggctccaccgaggacgccagccagtactactgtgacaagaatgataatggtgacagctacttagtcttgatccgtatcacaccagatgaagatggaaaatttggatttaatcttaagggaggagtggatcaaaagatgcctcttgtggtatcaaggataaacccagagtcacctgcggacacctgcattcctaagctgaacgaaggggatcaaatcgtgttaatcaatggccgggacatctcagaacacacgcatgaccaagtggtgatgttcatcaaagccagccgggagtcccactcacgggagctggccctggtgatcaggaggagagctgtccgctcatttgctgacttcaagtctgaagatgaactgaaccagcttttccccgaagccattttccccatgtgtccggagggtggggacactttggagggatccatggcacagctaaagaagggcctcgaaagcgggacggtgctgatccagtttgagcaactctacagaaaaaagccaggtttggccatcacgtttgcaaagctgcctcaaaatttggacaaaaaccgatataaagatgtgctgccttatgacaccacccgggtattattgcagggaaatgaagattatattaatgcaagttacgtgaacatggaaattcctgctgctaaccttgtgaacaagtacatcgccactcaggggcccctgccgcatacctgtgcacagttttggcaggttgtctgggatcagaagttgtcactcattgtcatgttgacgactctcacagaacgagggcggaccaaatgtcaccagtactggccagatccccccgacgtcatgaaccacggcggctttcacatccagtgtcagtcagaggactgcaccatcgcctatgtgtcccgagaaatgctggtcacaaacacccaggtgagccgcagcctgaggggcacggtggaggggcaggtgctgaatcagcggccactgtcatcccaggtggtcacgcttctaggtgtgcactctgtttgcacctggcaagcgtgtcaaccggggaagaacacacagtgacacatctccagtacgtcgcatggcctgaccacggtgtgcccgatgactcctccgactttctggaatttgtaaactatgtgaggtctctgagagtggacagcgagcccgtcctagttcactgcagtgctggaataggtcgaaccggtgtgttggtcactatggaaacagccatgtgcctaactgagaggaacctgcccatttacccactggatattgtccgaaaaatgcgagaccagcgcgccatgatggtgcagacatcaagccagtacaagtttgtgtgtgaagcgattcttcgtgtgtatgaagaaggtttagtccaaatgctggatcctagttaagacaactgtgaaaaagttcattcctctttcccaagggcatcctccttgaaagaggaggacagacctctctggaagcagcaagaggaaccagtagctgtgggaaaggaatgggcacctctgaacccaggcactttaaacttctatagaaaagatatcgtgtacataggaactggtgtagataagcatgcaattatggcatcatttaggcctgtatttctatggaaagatacaaaaaggatctcagtttggggcctgtcctaatgccttcttccctaacatcaccacacacacccctgtcggcatcctggagcaattgagaccggacacccacagagctgttgtcctcccagcaacaagatggtgtggttatcttgggtcatttggatgttttgtttgtttctgtgtgtcagactgtaagggctgagctttctgtgcttctaggtggagctggaacaattcagattcacccgccctgatgctaaggaaaccctgacgtatgtactagatggcagggcactgggggtcaggctgaaggctgagcaacacctctctgccctccctccctttgtcccatctcccagcgacttccaatattcatgtttctgagaattgtgtccctcttcaggttccctcttggtgcctaacctggattagtaatgtgcattcaggtgaattttcagctgaggctctgagaactggtactctcagtgtgttctggtcatcttgtggcttagttgtagaagcaggtgtgtctcttgcctctgcttgcctcctactgcacactcagcacccaggactggaatcaccgactactgaatctcctacatgtattgctgctacttcaagctcctccacttgaaaccttatgattttcccaaggggagatgggacagtgtcatctaaatattccgaatgtttggccttctgagaaaagagcttctagtaattgaaccatgggaaacccagcttctggagggttggccgtggggctgtgtacatgtgtgtgcccaggggtgagtgtttctcaggattcctaacgattcaaattaccgttgagtatatataaagaatgagtctctgtatggaagaacaaatgtgtgcattcacccccagtcacaatggtctccattgcatttcaaaggagaggatcagactatctgaatataaacacaatctgatgttaatttattctaagaacaccatcattttgattgtcctaaagaattctgcctttgtgaataccgtgttaaatttttttaaatttgtgacaggattgtagcaaattattatttaaggaaaataaattgtgtaaacatttaatgtggtatttttgaacagcggtttttatgtactcagaagaggaagtaaagccaggttcttaatggtatttatagaaaagatgttttcatattataatgcacataaatgaagccattttgatattcagcaaattcggtgccaattgaatagtttgctggtagcaagacggatgaagacctatatgggagattctttatctctagagctagcatatttacttgcatactttgtttcttttccacatggatattttactgctaaatggcagaggtgggagggagatgtcacacagtaccataaccccatattgaaaacaagaaaccaccagaaagtttgcagctaaggggcaggggattcagttcctacgcccactcagcactaactacttgcgggcctggttgcttagaagctctacctctctttcattatctgtaaaatagaaacaatacttaggactttagttggaacatgaggattgaataagatcacgctattcatgtgactttttatcggctagaacagcaacagacactgctgtgggtgagttacttagaaaagtttagttatcagtgattagcccaaaaacacatcagtcaaaaatagaatccactggatttttgtctctctttttagagacagggtctcactgtcgcccaggctggagtacagtggcatgatcattgttcactgcagcctcaaattcctgggctcaagcaatcctcgcacctcagcctcctgagtagccgggactataggcacatgccacctcacctggcttgtgtgtgtgtgtgtgtgtgtgtgtgtgtgtgtgtgtgtgtgtgtgtgtgtgtgtgtgtgtgtagagacaggatcttgatgtgttgcctaggctggtctcaaactcctggcctcaagtgatcttcccacctcagcctccaaaactgttgggattataggcgtgagccactgtgcccagcctaactgggtttttatgagaggaaaatagaaaatgctcttctagaagagagagaacaagagcacaaaataatctggactcacaaaaattcagcaagctccaagaaagggggatggagggaacgctggcaaaaatttaaatgccattaggatatttagcaagttattactgtttggtaaaaatgcatcatcaccctgtgtgcaaaatgcttgcaaagtagtctaaatgtctttggagatgggtgttttactgcttttttccaaaaacaaattgtttattatggttgcagaaatgcagccattacggtcacataaatttctaaaaagcctaccaaaggttgcaagcagtcttctgccactgggcaggccagcagttcagacccagcgaggttgccaggaacaaatccaggaaatactgggaagaacaagacaagagaattacctaaaagagcaaacaattcaagtaaatcctgtagctattaccacttaaaatccgtagctcaagattcctgtttcaccaccttatacacttaagcaattatacttaagcctttttttagtcctaagtgaagaactacatcagaatcaggataagtattttgcctgggaaatttggctgcatatgaatggagaagacatttacatcctatgttctggcactttctgaaagatctaattaaacatgttgatgtgccaatttaatcaagatgagagatccctgctggtgtcaccctctagaacctgcacttggtgttttgactttccagaagaaaaaaatgcaactttggttagggggcagtggttggatcacacagttgtctttcgtttcctaccacagtaattcatatttaaatatgcttttagattagtgtggatactattgctgctgtgttgctacctgacctttttctggggggggtacctcagaaatgagcatttgagggcaagcgaaaaagccctcttcatcctccagaggcaacaaagaggcagcagaaatggggaaagattgtgagaggcagggcttgggtctagacctggacttaggcaagatatgttgccctcaaccctgagttttcttatatgtaaaaagggaaggttgggctggactagatgaggtcaagatttgccattctgggaggctgatattccagagaatcaaaattaatcctaaaccaaagctttatggctgctacagagacatgtcacatttctgagacttgtcaccaagagtttgtccctcagactttggcgctgttgaatgcaaagacaaggatggccaccttctggttcttgcctgttgtcctcagctgagagcagtctcggtaaaggtggcaaagattctgtgacctcagaccggggaccaaatgcttgggagtctgatggccgggctgggccaccattctcatagctctcattctgtttggagcaaccaaaggatttgtgtgaagttatttggaaaaggaccttaactgagcagtaatcttttttctgtatatttggaatgtttttcattctgacctgttctgtcagtgattctactgaaaaacaatttaatcaatataaaaatgttcaagctatgcaacactgt

SEQ ID NO: 16897 - DNA, 2826 bp, Homo sapiens
  ENST00000477854
ggaattctgagctaccgcaccagcatctgagacctcacaccctgcctccctaacctaagaatccagaacacagggcctccccgacccctgagctcccagccgtacagggttctcctgagaactcctgtctgtggaggcctttctaggagactactcttttgatgtacatatttgtgaggtcctctctggaaagggctttctcttggttcccttcagtcagcttttctccaaggagagtcctgaggcctccccgggcacgcagcaccggggccctgctctcagctgcccggtctggaccttagaggttcaggagcctccatgcagggccaggttgaggctgcaggtgagctctgctgggggaacacgggggaagggggccggctccatactcagcctgctcccctgtgccccagcttgcctgtggggtgctctggttcagcggttatggccacatctggtcacagaacgccacaaacctcgtctcctctttgctgacgctcctgaaacagctggaacccacggcctggcttgactctgggacgtggggagtccccagtctgctgctggtctttctgtccgtgggcctggtcctcgttaccaccctggtgtggcacctcctgaggacacccccagagccacccaccccactgccccctgaggacaggcgccagtcagtgagccgccagccctccttcacctactcagagtggatggaggagaagatcgaggatgacttcctggacctcgacccggtgcccgagactcctgtgtttgattgtgtgatggacatcaagcctgaggctgaccccacctcactcaccgtcaagtccatgggtctgcaggagaggaggggttccaatgtctccctgaccctggacatgtgcactccgggctgcaacgaggagggctttggctatctcatgtccccacgtgaggagtccgcccgcgagtacctgctcagcgcctcccgtgtcctccaagcagaagagcttcatgaaaaggccctggaccctttcctgctgcaggcggaattctttgaaatccccatgaactttgtggatccgaaagagtacgacatccctgggctggtgcggaagaaccggtacaaaaccatacttcccaaccctcacagcagagtgtgtctgacctcaccagaccctgacgaccctctgagttcctacatcaatgccaactacatccggggctatggtggggaggagaaggtgtacatcgccactcagggacccatcgtcagcacggtcgccgacttctggcgcatggtgtggcaggagcacacgcccatcattgtcatgatcaccaacatcgaggagatgaacgagaaatgcaccgagtattggccggaggagcaggtggcgtacgacggtgttgagatcactgtgcagaaagtcattcacacggaggattaccggctgcgactcatctccctcaagagtgggactgaggagcgaggcctgaagcattactggttcacatcctggcccgaccagaagaccccagaccgggcccccccactcctgcacctggtgcgggaggtggaggaggcagcccagcaggaggggccccactgtgcccccatcatcgtccactgcagtgcagggattgggaggaccggctgcttcattgccaccagcatctgctgccagcagctgcggcaggagggtgtggtggacatcctgaagaccacgtgccagctccgtcaggacaggggcggcatgatccagacatgcgagcagtaccagtttgtgcaccacgtcatgagcctctacgaaaagcagctgtcccaccagtccccagaatgactgcgcttctcctacaaggttctctgggcactgcccagcctgagtctcggccctcacccagggccctgcctcgggtcctgggcctgctccccgcttcctccccttcagtcagctccctctgtcctctgtcagcctggcctgacccctaccctccagcattgctcttcctactgtacatattggggagtggggggcagggtcgggaagggacatgccaggccaggcctggggccccggggcctgacccacaccacgcagaccccgggctccagtttttaacgatggttccatcaatacctgatccagaatgtttccgtgctacactttgtgtcctgctgcaatgtgttctgtctgtccatccatctctgccctctgtaccggacactgtgtctcctcagccaggaaggggtaatgagctccagcccctaagcaaccggacttgcctgcctcggcctcacccgcacttctcccaaaaggcagatgacggggagttaggcatggggagctccagaaggtcaccagagagctttcagctgagggagagttctctaggttggagtgggcatcacagccagggtggcctctgggtgtcagatgctctcaggagggtgcccagcctgtgaggcactggcaaggtagggggcagatggggcatggagaacccagaggatctaggccctgttggggaggggaggggagctcaaggtttgggtggggactcagcccagatctacgtgagacatttttctgtgtcactgtgggaaagccttcccagaagtctcactgcgtgttgctctgcgtgtgttcccatgtccatgcgtgtgttgagagcccatcaggagggcatgcatgactctttggcaacatgtattatcttggagccacgtgtttttattgctgactttaaatatttatcccacggcagacagagacatttggtgtctttttataattcgctcgtggtcattgaatagagcaataaacggagcattttgagcaaaactaa

SEQ ID NO: 16898 - DNA, 3135 bp, Homo sapiens
  ENST00000358540
gccggggctggggggtgccaaacccacccggcggctgcgccagcgactctgcagctgaagcgcatttggtgaggcggtcgggcgagggagcgcgcacggagcgcgggacggagcgccaggcggacggaccgaaggacggaggcaccgaaggacggacgcccccgcacacgcagacgcacagagctcggcgcggcccccgtcgcatacacactggcacagacacaagcagggacacacgcagacacacgcacactcgcgcgcgcatcctcccgccagcctgcccgcctgctcgccggcgcccggagcccgctctggccgctggatgatctgaagctgccctctctccttcatttatatcaccagcttgctttttgctgagaaagcttcctgccctggaagatggcacccttccccatccagacaccttgggaatgaattatgagggagccaggagtgagagagagaaccacgctgctgatgactccgagggaggggccctggacatgtgctgcagtgagaggctaccgggtctcccccagccgatagtgatggaggcactggacgaggctgaagggctccaggactcacagagagagatgccgccaccccctcctccctcgccgccctcagatccagctcagaagccaccacctcgaggcgctgggagccactccctcactgtcaggagcagcctgtgcctgttcgctgcctcacagttcctgcttgcctgtggggtgctctggttcagcggttatggccacatctggtcacagaacgccacaaacctcgtctcctctttgctgacgctcctgaaacagctggaacccacggcctggcttgactctgggacgtggggagtccccagtctgctgctggtctttctgtccgtgggcctggtcctcgttaccaccctggtgtggcacctcctgaggacacccccagagccacccaccccactgccccctgaggacaggcgccagtcagtgagccgccagccctccttcacctactcagagtggatggaggagaagatcgaggatgacttcctggacctcgacccggtgcccgagactcctgtgtttgattgtgtgatggacatcaagcctgaggctgaccccacctcactcaccgtcaagtccatgggtctgcaggagaggaggggttccaatgtctccctgaccctggacatgtgcactccgggctgcaacgaggagggctttggctatctcatgtccccacgtgaggagtccgcccgcgagtacctgctcagcgcctcccgtgtcctccaagcagaagagcttcatgaaaaggccctggaccctttcctgctgcaggcggaattctttgaaatccccatgaactttgtggatccgaaagagtacgacatccctgggctggtgcggaagaaccggtacaaaaccatacttcccaaccctcacagcagagtgtgtctgacctcaccagaccctgacgaccctctgagttcctacatcaatgccaactacatccggggctatggtggggaggagaaggtgtacatcgccactcagggacccatcgtcagcacggtcgccgacttctggcgcatggtgtggcaggagcacacgcccatcattgtcatgatcaccaacatcgaggagatgaacgagaaatgcaccgagtattggccggaggagcaggtggcgtacgacggtgttgagatcactgtgcagaaagtcattcacacggaggattaccggctgcgactcatctccctcaagagtgggactgaggagcgaggcctgaagcattactggttcacatcctggcccgaccagaagaccccagaccgggcccccccactcctgcacctggtgcgggaggtggaggaggcagcccagcaggaggggccccactgtgcccccatcatcgtccactgcagtgcagggattgggaggaccggctgcttcattgccaccagcatctgctgccagcagctgcggcaggagggtgtggtggacatcctgaagaccacgtgccagctccgtcaggacaggggcggcatgatccagacatgcgagcagtaccagtttgtgcaccacgtcatgagcctctacgaaaagcagctgtcccaccagtccccagaatgactgcgcttctcctacaaggttctctgggcactgcccagcctgagtctcggccctcacccagggccctgcctcgggtcctgggcctgctccccgcttcctccccttcagtcagctccctctgtcctctgtcagcctggcctgacccctaccctccagcattgctcttcctactgtacatattggggagtggggggcagggtcgggaagggacatgccaggccaggcctggggccccggggcctgacccacaccacgcagaccccgggctccagtttttaacgatggttccatcaatacctgatccagaatgtttccgtgctacactttgtgtcctgctgcaatgtgttctgtctgtccatccatctctgccctctgtaccggacactgtgtctcctcagccaggaaggggtaatgagctccagcccctaagcaaccggacttgcctgcctcggcctcacccgcacttctcccaaaaggcagatgacggggagttaggcatggggagctccagaaggtcaccagagagctttcagctgagggagagttctctaggttggagtgggcatcacagccagggtggcctctgggtgtcagatgctctcaggagggtgcccagcctgtgaggcactggcaaggtagggggcagatggggcatggagaacccagaggatctaggccctgttggggaggggaggggagctcaaggtttgggtggggactcagcccagatctacgtgagacatttttctgtgtcactgtgggaaagccttcccagaagtctcactgcgtgttgctctgcgtgtgttcccatgtccatgcgtgtgttgagagcccatcaggagggcatgcatgactctttggcaacatgtattatcttggagccacgtgtttttattgctgactttaaatatttatcccacggcagacagagacatttggtgtctttttataattcgctcgtggtcattgaatagagcaataaacggagcattttgagcaaaactaa

SEQ ID NO: 16899 - DNA, 2299 bp, Homo sapiens
  ENST00000396166
tgtggtctgctcaggctgctataacaaaataccatagaccaggtagcttgtaagcaacaggtttatttttcacagttctggagactgggaagtccaagatcaaggcaccgtgaccctggtgaggacccacttccagggtcatgtcctcacgtggcagaaggagtgaaagctccttttgtaagagcactgatcccattcgtgagggctccgttctcatgacttcatcacctcgcaaaggccctcccttcaaataccaccatgttgggatttggtttcaacatgtgaacttaaggggacacacacattcagtccaaagccacaggttttcagcaggagagcagcatgtccagatgtgtgttgtacacagactattttgactctgtggatctgagacagttggggatgaggcagaaatctcccacactcgagcaatgataaaggtcaaggtggcagtgaagcggggagtgtgaagaggtggtaaaacttgcagcactaattgcagcactaagatagaggcgagtcacgcaggcgcaggcgaggcacagcaagaggcgaagaagagtcccggggctgggttatgtgacaaagggatgactgggggaccatttgttaagataaggaaccctggagatagtaataaattggagaaggggctcttggcccctcttggatgatcctgaagttgttggggcaggaccaaaggcaagatccatgccaacgctgctgaccaacccccaaaaccaagctggctttgggtctgtgtctggtgccactgggcaatgtggcctagatggaagggtgaaggggtcccactctcagtgttcttcctgtgttcttcctccttccatctcatctctatctctgggctggtttgtgagctgaaagagttcacacatacctggggtgggcctctgtctcctcgacagagtgggactgaggagcgaggcctgaagcattactggttcacatcctggcccgaccagaagaccccagaccgggcccccccactcctgcacctggtgcgggaggtggaggaggcagcccagcaggaggggccccactgtgcccccatcatcgtccactgcagtgcagggattgggaggaccggctgcttcattgccaccagcatctgctgccagcagctgcggcaggagggtgtggtggacatcctgaagaccacgtgccagctccgtcaggacaggggcggcatgatccagacatgcgagcagtaccagtttgtgcaccacgtcatgagcctctacgaaaagcagctgtcccaccagtccccagaatgactgcgcttctcctacaaggttctctgggcactgcccagcctgagtctcggccctcacccagggccctgcctcgggtcctgggcctgctccccgcttcctccccttcagtcagctccctctgtcctctgtcagcctggcctgacccctaccctccagcattgctcttcctactgtacatattggggagtggggggcagggtcgggaagggacatgccaggccaggcctggggccccggggcctgacccacaccacgcagaccccgggctccagtttttaacgatggttccatcaatacctgatccagaatgtttccgtgctacactttgtgtcctgctgcaatgtgttctgtctgtccatccatctctgccctctgtaccggacactgtgtctcctcagccaggaaggggtaatgagctccagcccctaagcaaccggacttgcctgcctcggcctcacccgcacttctcccaaaaggcagatgacggggagttaggcatggggagctccagaaggtcaccagagagctttcagctgagggagagttctctaggttggagtgggcatcacagccagggtggcctctgggtgtcagatgctctcaggagggtgcccagcctgtgaggcactggcaaggtagggggcagatggggcatggagaacccagaggatctaggccctgttggggaggggaggggagctcaaggtttgggtggggactcagcccagatctacgtgagacatttttctgtgtcactgtgggaaagccttcccagaagtctcactgcgtgttgctctgcgtgtgttcccatgtccatgcgtgtgttgagagcccatcaggagggcatgcatgactctttggcaacatgtattatcttggagccacgtgtttttattgctgactttaaatatttatcccacggcagacagagacatttggtgtctttttataattcgctcgtggtcattgaatagagcaataaacggagcattttgagcaaaact

SEQ ID NO: 16900 - DNA, 3871 bp, Homo sapiens
  ENST00000396170
agctacgtggtggctcgcctctgattccccgtgtaaaaaatggagtttaggatccctgccctgtgtgcagcccacagcctcaagcccccatggggatggaatgccggaaacctctggccagcgcactagcagcctggagaatacggaagattgtggcaggattgtggggcacatgggcagctccctgctcgtccgggcccctggtgcccacgagaaaaccaaaacaggtgcgtgccccgcgccgcacgtcaggagggcaagactcagtggagggaggggctgtccactcgctctagctccccagaggctgaacagggagaactgggaaaaaggacgcctcctcagcgtcctagaacgagtcctcggcacctggtattgcatgcgccctagtatggggccgctccacttgcgcaggtgttggcaacatgcggggagcgccacggcatgcccccaatgagccgactccctcccccaactctgccccctttgtctcgctggcccctactccttctgtctgcctgtctgtcccgtcccaggttcagcgcgcacggccctgccggggtccctctggcagttgccgtagccgcgcggcccgacccggggctcccaagaggagaaaaaatcatgaatgaaatggatgcgctgctcccactcctccgccctccttgtccaagcaaccttggcatgggggcgacgactgcggagactccgcgcagagttgctcgggagagggaggcacctgagatgaggtcaggggttaagggtctgtgatccggcccccttcgtgccccgggagcaggccgctctcccggtcccccgccccgccagccctgcgcaattcccggcgagcggcggaagcccgcccgggggcggggcggagccggggctggggggtgccaaacccacccggcggctgcgccagcgactctgcagctgaagcgcatttggtgaggcggtcgggcgagggagcgcgcacggagcgcgggacggagcgccaggcggacggaccgaaggacggaggcaccgaaggacggacgcccccgcacacgcagacgcacagagctcggcgcggcccccgtcgcatacacactggcacagacacaagcagggacacacgcagacacacgcacactcgcgcgcgcatcctcccgccagcctgcccgcctgctcgccggcgcccggagcccgctctggccgcttgctttttgctgagaaagcttcctgccctggaagatggcacccttccccatccagacaccttgggaatgaattatgagggagccaggagtgagagagagaaccacgctgctgatgactccgagggaggggccctggacatgtgctgcagtgagaggctaccgggtctcccccagccgatagtgatggaggcactggacgaggctgaagggctccaggactcacagagagagatgccgccaccccctcctccctcgccgccctcagatccagctcagaagccaccacctcgaggcgctgggagccactccctcactgtcaggagcagcctgtgcctgttcgctgcctcacagttcctgctggaacccacggcctggcttgactctgggacgtggggagtccccagtctgctgctggtctttctgtccgtgggcctggtcctcgttaccaccctggtgtggcacctcctgaggacacccccagagccacccaccccactgccccctgaggacaggcgccagtcagtgagccgccagccctccttcacctactcagagtggatggaggagaagatcgaggatgacttcctggacctcgacccggtgcccgagactcctgtgtttgattgtgtgatggacatcaagcctgaggctgaccccacctcactcaccgtcaagtccatgggtctgcaggagaggaggggttccaatgtctccctgaccctggacatgtgcactccgggctgcaacgaggagggctttggctatctcatgtccccacgtgaggagtccgcccgcgagtacctgctcagcgcctcccgtgtcctccaagcagaagagcttcatgaaaaggccctggaccctttcctgctgcaggcggaattctttgaaatccccatgaactttgtggatccgaaagagtacgacatccctgggctggtgcggaagaaccggtacaaaaccatacttcccaaccctcacagcagagtgtgtctgacctcaccagaccctgacgaccctctgagttcctacatcaatgccaactacatccggggctatggtggggaggagaaggtgtacatcgccactcagggacccatcgtcagcacggtcgccgacttctggcgcatggtgtggcaggagcacacgcccatcattgtcatgatcaccaacatcgaggagatgaacgagaaatgcaccgagtattggccggaggagcaggtggcgtacgacggtgttgagatcactgtgcagaaagtcattcacacggaggattaccggctgcgactcatctccctcaagagtgggactgaggagcgaggcctgaagcattactggttcacatcctggcccgaccagaagaccccagaccgggcccccccactcctgcacctggtgcgggaggtggaggaggcagcccagcaggaggggccccactgtgcccccatcatcgtccactgcagtgcagggattgggaggaccggctgcttcattgccaccagcatctgctgccagcagctgcggcaggagggtgtggtggacatcctgaagaccacgtgccagctccgtcaggacaggggcggcatgatccagacatgcgagcagtaccagtttgtgcaccacgtcatgagcctctacgaaaagcagctgtcccaccagtccccagaatgactgcgcttctcctacaaggttctctgggcactgcccagcctgagtctcggccctcacccagggccctgcctcgggtcctgggcctgctccccgcttcctccccttcagtcagctccctctgtcctctgtcagcctggcctgacccctaccctccagcattgctcttcctactgtacatattggggagtggggggcagggtcgggaagggacatgccaggccaggcctggggccccggggcctgacccacaccacgcagaccccgggctccagtttttaacgatggttccatcaatacctgatccagaatgtttccgtgctacactttgtgtcctgctgcaatgtgttctgtctgtccatccatctctgccctctgtaccggacactgtgtctcctcagccaggaaggggtaatgagctccagcccctaagcaaccggacttgcctgcctcggcctcacccgcacttctcccaaaaggcagatgacggggagttaggcatggggagctccagaaggtcaccagagagctttcagctgagggagagttctctaggttggagtgggcatcacagccagggtggcctctgggtgtcagatgctctcaggagggtgcccagcctgtgaggcactggcaaggtagggggcagatggggcatggagaacccagaggatctaggccctgttggggaggggaggggagctcaaggtttgggtggggactcagcccagatctacgtgagacatttttctgtgtcactgtgggaaagccttcccagaagtctcactgcgtgttgctctgcgtgtgttcccatgtccatgcgtgtgttgagagcccatcaggagggcatgcatgactctttggcaacatgtattatcttggagccacgtgtttttattgctgactttaaatatttatcccacggcagacagagacatttggtgtctttttataattcgctcgtggtcattgaatagagcaataaacggagcattttgagcaaaact

SEQ ID NO: 16901 - DNA, 2796 bp, Homo sapiens
  ENST00000396168
catacacactggcacagacacaagcagggacacacgcagacacacgcacactcgcgcgcgcatcctcccgccagcctgcccgcctgctcgccggcgcccggagcccgctctggccggagtgagagagagaaccacgctgctgatgactccgagggaggggccctggacatgtgctgcagtgagaggctaccgggtctcccccagccgatagtgatggaggcactggacgaggctgaagggctccaggactcacagagagagatgccgccaccccctcctccctcgccgccctcagatccagctcagaagccaccacctcgaggcgctgggagccactccctcactgtcaggagcagcctgtgcctgttcgctgcctcacagttcctgcttgcctgtggggtgctctggttcagcggttatggccacatctggtcacagaacgccacaaacctcgtctcctctttgctgacgctcctgaaacagctggaacccacggcctggcttgactctgggacgtggggagtccccagtctgctgctggtctttctgtccgtgggcctggtcctcgttaccaccctggtgtggcacctcctgaggacacccccagagccacccaccccactgccccctgaggacaggcgccagtcagtgagccgccagccctccttcacctactcagagtggatggaggagaagatcgaggatgacttcctggacctcgacccggtgcccgagactcctgtgtttgattgtgtgatggacatcaagcctgaggctgaccccacctcactcaccgtcaagtccatgggtctgcaggagaggaggggttccaatgtctccctgaccctggacatgtgcactccgggctgcaacgaggagggctttggctatctcatgtccccacgtgaggagtccgcccgcgagtacctgctcagcgcctcccgtgtcctccaagcagaagagcttcatgaaaaggccctggaccctttcctgctgcaggcggaattctttgaaatccccatgaactttgtggatccgaaagagtacgacatccctgggctggtgcggaagaaccggtacaaaaccatacttcccaaccctcacagcagagtgtgtctgacctcaccagaccctgacgaccctctgagttcctacatcaatgccaactacatccggggctatggtggggaggagaaggtgtacatcgccactcagggacccatcgtcagcacggtcgccgacttctggcgcatggtgtggcaggagcacacgcccatcattgtcatgatcaccaacatcgaggagatgaacgagaaatgcaccgagtattggccggaggagcaggtggcgtacgacggtgttgagatcactgtgcagaaagtcattcacacggaggattaccggctgcgactcatctccctcaagagtgggactgaggagcgaggcctgaagcattactggttcacatcctggcccgaccagaagaccccagaccgggcccccccactcctgcacctggtgcgggaggtggaggaggcagcccagcaggaggggccccactgtgcccccatcatcgtccactgcagtgcagggattgggaggaccggctgcttcattgccaccagcatctgctgccagcagctgcggcaggagggtgtggtggacatcctgaagaccacgtgccagctccgtcaggacaggggcggcatgatccagacatgcgagcagtaccagtttgtgcaccacgtcatgagcctctacgaaaagcagctgtcccaccagtccccagaatgactgcgcttctcctacaaggttctctgggcactgcccagcctgagtctcggccctcacccagggccctgcctcgggtcctgggcctgctccccgcttcctccccttcagtcagctccctctgtcctctgtcagcctggcctgacccctaccctccagcattgctcttcctactgtacatattggggagtggggggcagggtcgggaagggacatgccaggccaggcctggggccccggggcctgacccacaccacgcagaccccgggctccagtttttaacgatggttccatcaatacctgatccagaatgtttccgtgctacactttgtgtcctgctgcaatgtgttctgtctgtccatccatctctgccctctgtaccggacactgtgtctcctcagccaggaaggggtaatgagctccagcccctaagcaaccggacttgcctgcctcggcctcacccgcacttctcccaaaaggcagatgacggggagttaggcatggggagctccagaaggtcaccagagagctttcagctgagggagagttctctaggttggagtgggcatcacagccagggtggcctctgggtgtcagatgctctcaggagggtgcccagcctgtgaggcactggcaaggtagggggcagatggggcatggagaacccagaggatctaggccctgttggggaggggaggggagctcaaggtttgggtggggactcagcccagatctacgtgagacatttttctgtgtcactgtgggaaagccttcccagaagtctcactgcgtgttgctctgcgtgtgttcccatgtccatgcgtgtgttgagagcccatcaggagggcatgcatgactctttggcaacatgtattatcttggagccacgtgtttttattgctgactttaaatatttatcccacggcagacagagacatttggtgtctttttataattcgctcgtggtcattgaatagagcaataaacggagcattttgagcaaaa

SEQ ID NO: 16902 - DNA, 797 bp, Homo sapiens
  ENST00000496201
gctaatcgagggtgactgctggaagtggagccacgctgactgatcccagattgagaggcagccacagccaccccaaaaggggtggcagagccctgcctgtggacagggccggagtcatcggcccgcatggcccatcttccacaggtctcccccagccgatagtgatggaggcactggacgaggctgaagggctccaggactcacagagagagatgccgccaccccctcctccctcgccgccctcagatccagctcagaagccaccacctcgaggcgctgggagccactccctcactgtcaggagcagcctgtgcctgttcgctgcctcacagttcctgcttgcctgtggggtgctctggttcagcggttatggccacatctggtcacagaacgccacaaacctcgtctcctctttgctgacgctcctgaaacagctggaacccacggcctggcttgactctgggacgtggggagtccccagtctgctgctggtctttctgtccgtgggcctggtcctcgttaccaccctggtgtggcacctcctgaggacacccccagagccacccaccccactgccccctgaggacaggcgccagtcagtgagccgccagccctccttcacctactcagagtggatggaggagaagatcgaggatgacttcctggacctcgacccggtgcccgagactcctgtgtttgattgtgtgatggacatcaagcctgaggctgaccccacctcactcaccgtcaagtccatgggtctgcaggagaggaggggttccaatgtctccctgacc

SEQ ID NO: 16903 - DNA, 12316 bp, Homo sapiens
  ENST00000334414
ttttttttttccccaagcgaagcatgaacagttgctaagtggaaaatggaggctgaattttacatggtgattcttacctgcttgatcttcaggaactcagaagggtttcagattgtccatgtccagaaacaacagtgtcttttcaaaaatgagaaagtggtcgtgggctcatgcaacaggaccatccagaaccagcagtggatgtggactgaggatgaaaagctccttcatgttaaatctgcactgtgcttggccatctccaactcttcccgcggcccctcccgctcagccatcttggaccgctgttcccaggcaccccgatggacctgctatgatcaggaaggcttccttgaggtggaaaatgcctctctctttctccagaaacaaggctccagagtagtggtcaagaaggccaggaaatacctccatagctggatgaaaatagatgtcaacaaggagggaaaactggtcaatgaaagcctctgtttacaaaaagctggcctgggagcagaagtttcggtgaggagcactagaaacacggctccaccccagattctcactacctttaatgcagttccagatggcctggtattccttattaggaataccacagaggccttcatcagaaatgctgcagaaaactacagccaaaacagcagcgagaggcagcatcccaatctgcacatgactggaattacagacacatcatgggttttgtcgactactcagcccttctccagcaccactgaagagactggactggcggagccagagagatgtaacttcaccctggcggagtccaaggcctccagccattctgtgtctatccagtggagaattttgggctcaccctgtaactttagcctcatctatagcagtgacaccctgggggccgcgttgtgccctacctttcggatagacaacaccacatacggatgtaaccttcaagatttacaagcaggaaccatctataacttcaggattatttctctggatgaagagagaacagtggtcttgcaaacagatcctttacctcctgctaggtttggagtcagtaaagagaagacgacttcaaccagcttgcatgtttggtggactccttcttccggaaaagtcacctcatatgaggtgcaattatttgatgaaaataaccaaaagatacagggggttcaaattcaagaaagtacttcatggaatgaatacacttttttcaatctcactgctggtagtaaatacaatattgccatcacagctgtttctggaggaaaacgttctttttcagtttataccaatggatcaacagtgccatctccagtgaaagatattggtatttccacaaaagccaattctctcctgatttcctggtcccatggttctgggaatgtggaacgataccggctgatgctaatggataaagggatcctagttcatggcggtgttgtggacaaacatgctacttcctatgcttttcacgggctgacccctggctacctctacaacctcactgttatgactgaggctgcagggctgcaaaactacaggtggaaactagtcaggacagcccccatggaagtctcaaatctgaaggtgacaaatgatggcagtttgacctctctaaaagtcaaatggcaaagacctcctggaaatgtggattcttacaatatcaccctgtctcacaaagggaccatcaaggaatccagagtattagcaccttggattactgaaactcactttaaagagttagtccccggtcgactttatcaagttactgtcagctgtgtctctggtgaactgtctgctcagaagatggcagtgggcagaacatttccagacaaagttgcaaacctggaggcaaacaataatggcaggatgaggtctcttgtagtgagctggtcgccccctgctggagactgggagcagtatcggatcctactcttcaatgattctgtggtgctgctcaacatcactgtgggaaaggaagaaacacagtatgtcatggatgacacggggctcgtaccgggaagacagtatgaggtggaagtcattgttgagagtggaaatttgaagaattctgagcgttgccaaggcaggacagtccccctggctgtcctccagcttcgtgtcaaacatgccaatgaaacctcactgagtatcatgtggcagacccctgtagcagaatgggagaaatacatcatttccctagctgacagagacctcttactgatccacaagtcactctccaaagatgccaaagaattcacttttactgacctggtgcctggacgaaaatacatggctacagtcaccagtattagtggagacttaaaaaattcctcttcagtaaaaggaagaacagtgcctgcccaagtgactgacttgcatgtggccaaccaaggaatgaccagtagtctgtttactaactggacccaggcacaaggagacgtagaattttaccaagtcttactgatccatgaaaatgtggtcattaaaaatgaaagcatctccagtgagaccagcagatacagcttccactctctcaagtccggcagcctgtactccgtggtggtaacaacagtgagtggagggatctcttcccgacaagtggttgtggagggaagaacagtcccttccagtgtgagtggagtaacggtgaacaattccggtcgtaatgactacctcagcgtttcctggctgctggcgcccggagatgtggataactatgaggtaacattgtctcatgacggcaaggtggttcagtcccttgtcattgccaagtctgtcagagaatgttccttcagctccctcaccccaggccgcctctacaccgtgaccataactacaaggagtggcaagtatgaaaatcactccttcagccaagagcggacagtgcctgacaaagtccagggagtcagtgttagcaactcagccaggagtgactatttaagggtatcctgggtgcatgccactggagactttgatcactatgaagtcaccattaaaaacaaaaacaacttcattcaaactaaaagcattcccaagtcagaaaacgaatgtgtatttgttcagctagtccctggacggttgtacagtgtcactgttactacaaaaagtggacaatatgaagccaatgaacaagggaatgggagaacaattccagagcctgttaaggatctaacattgcgcaacaggagcactgaggacttgcatgtgacttggtcaggagctaatggggatgtcgaccaatatgagatccagctgctcttcaatgacatgaaagtatttcctccttttcaccttgtaaataccgcaaccgagtatcgatttacttccctaacaccaggccgccaatacaaaattcttgtcttgacgattagcggggatgtacagcagtcagccttcattgagggcttcacagttcctagtgctgtcaaaaatattcacatttctcccaatggagcaacagatagcctgacggtgaactggactcctggtgggggagacgttgattcctacacggtgtcggcattcaggcacagtcaaaaggttgactctcagactattcccaagcacgtctttgagcacacgttccacagactggaggccggggagcagtaccagatcatgattgcctcagtcagcgggtccctgaagaatcagataaatgtggttgggcggacagttccagcatctgtccaaggagtaattgcagacaatgcatacagcagttattccttaatagtaagttggcaaaaagctgctggtgtggcagaaagatatgatatcctgcttctaactgaaaatggaatccttctgcgcaacacatcagagccagccaccactaagcaacacaaatttgaagatctaacaccaggcaagaaatacaagatacagatcctaactgtcagtggaggcctctttagcaaggaagcccagactgaaggccgaacagtcccagcagctgtcaccgacctgaggatcacagagaactccaccaggcacctgtccttccgctggaccgcctcagagggggagctcagctggtacaacatctttttgtacaacccagatgggaatctccaggagagagctcaagttgacccactagtccagagcttctctttccagaacttgctacaaggcagaatgtacaagatggtgattgtaactcacagtggggagctgtctaatgagtctttcatatttggtagaacagtcccagcctctgtgagtcatctcagggggtccaatcggaacacgacagacagcctttggttcaactggagtccagcctctggggactttgacttttatgagctgattctctataatcccaatggcacaaagaaggaaaactggaaagacaaggacctgacggagtggcggtttcaaggccttgttcctggaaggaagtacgtgctgtgggtggtaactcacagtggagatctcagcaataaagtcacagcggagagcagaacagctccaagtcctcccagtcttatgtcatttgctgacattgcaaacacatccttggccatcacgtggaaagggcccccagactggacagactacaacgactttgagctgcagtggttgcccagagatgcacttactgtcttcaacccctacaacaacagaaaatcagaaggacgcattgtgtatggtcttcgtccagggagatcctatcaattcaacgtcaagactgtcagtggtgattcctggaaaacttacagcaaaccaatttttggatctgtgaggacaaagcctgacaagatacaaaacctgcattgccggcctcagaactccacggccattgcctgttcttggatccctcctgattctgactttgatggttatagtattgaatgccggaaaatggacacccaagaagttgagttttccagaaagctggagaaagaaaaatctctgctcaacatcatgatgctagtgccccataagaggtacctggtgtccatcaaagtgcagtcggccggcatgaccagcgaggtggttgaagacagcactatcacaatgatagaccgcccccctcctccacccccacacattcgtgtgaatgaaaaggatgtgctaattagcaagtcttccatcaactttactgtcaactgcagctggttcagcgacaccaatggagctgtgaaatacttcacagtggtggtgagagaggctgatggcagtgatgagctgaagccagaacagcagcaccctctcccttcctacctggagtacaggcacaatgcctccattcgggtgtatcagactaattattttgccagcaaatgtgccgaaaatcctaacagcaactccaagagttttaacattaagcttggagcagagatggagagcctaggtggaaaatgcgatcccactcagcaaaaattctgtgatggaccactgaagccacacactgcctacagaatcagcattcgagcttttacacagctctttgatgaggacctgaaggaattcacaaagccactctattcagacacatttttttctttacccatcactactgaatcagagcccttgtttggagctattgaaggtgtgagtgctggtctgtttttaattggcatgctagtggctgttgttgccttattgatctgcagacagaaagtgagccatggtcgagaaagaccctctgcccgtctgagcattcgtagggatcgaccattatctgtccacttaaacctgggccagaaaggtaaccggaaaacttcttgtccaataaaaataaatcagtttgaagggcatttcatgaagctacaggctgactccaactaccttctatccaaggaatacgaggagttaaaagacgtgggccgaaaccagtcatgtgacattgcactcttgccggagaatagagggaaaaatcgatacaacaatatattgccctatgatgccacgcgagtgaagctctccaatgtagatgatgatccttgctctgactacatcaatgccagctacatccctggcaacaacttcagaagagaatacattgtcactcagggaccgcttcctggcaccaaggatgacttctggaaaatggtgtgggaacaaaacgttcacaacatcgtcatggtgacccagtgtgttgagaagggccgagtaaagtgtgatcattactggccagcggaccaggattccctctactatggggacctcatcctgcagatgctctcagagtccgtcctgcctgagtggaccatccgggagtttaagatatgcggtgaggaacagcttgatgcacacagactcatccgccactttcactatacggtgtggccagaccatggagtcccagaaaccacccagtctctgatccagtttgtgagaactgtcagggactacatcaacagaagcccgggtgctgggcccactgtggtgcactgcagtgctggtgtgggtaggactggaacctttattgcattggaccgaatcctccagcagttagactccaaagactctgtggacatttatggagcagtgcacgacctaagacttcacagggttcacatggtccagactgagtgtcagtatgtctacctacatcagtgtgtaagagatgtcctcagagcaagaaagctacggagtgaacaagaaaaccccttgtttccaatctatgaaaatgtgaatccagagtatcacagagatccagtctattcaaggcattgagaatgtacctgaagagctcctggataaaaattattcactgtgtgatttgtttttaaaaacttgcttcatgccctacagaggtgccagctatttctgttgatactatgtataatttattaatctggagaatgtttaaaattttatataatttaaaggtaacagatattattgtacatagttgtattttgtagtttcttctgtaaatatgtatttttcataatgtttaatattaagctttatataatactatttttccacactaaagtgttcatgacttgttctacataaaactaattcaacctgtatgacaggactactggtaaaatgcatatggaggtggtggcagagacaatccttcaggccatgttttctacctgttttgatattcactggacaggaaaaagggcagggctagagagagcaaatactatggctagatttgctgcattgctgtcccatgaatctcgagagccaacagacatgtcctaacttgctattaggacaaatgtgacagtcaaaaaaaggattagagggagggagaaaaaagaattaagcagtaccaaagctgaactagatgcttgtgtctgaactagttgctctctctctcctttctccttccagggattcaagccaaagtggtcagctcagggatcatgtaacttgcagtgcaagcccaggatggtaggatgcagggttgagggttctgatagagaatgattccaaacagaagtgatgaattccttttgttaataagatgccagctatacccagactggaaacataacatgcaaagcactatctacagtgattagagatcctttcattgcattcatggtgtggagtgtgaacatccacacccatactgtaatgtatttatacacactagtttctgtctcattttcagtggtctccattcctagaaaagtcacaattatccattcctacttgatttcccattaaaagaatattatggtagcagattgtgcccctcattaaaaggcttaatgccaacattttcatagaaatgactacaaacatcatatatagtaaatttaaaaacaatagcaaaaacaaaaacagtggtcttcagtaaaattttcaaaacttcttttagtaaatcaatgaagtcaaaatgtcaagtaatcacccaaagttgcatttaataacaaaaggcactacatactgtaccaagtttatcttcaatatttgtgccttacttactttgactataacaaattccaatgagtcagaaagtatttccttcatcaaggtccagttccgacagcattcctgggaaaaatttgaaaggagtttgtacggaatcttcatagatacctgagaagatgagctggagatgtttgcctttttcacactacaaatttttctgtaataaacttgggaattagaggtcaagtttgttgatggcatagcttcctttgcataaagagtatatttcttttcaaagtatatatttttgtaacctaccataaagtccgtaagtgaatacaacgaatgtaattgacataataattgaaaatcattgactatacctaaaatagttctttataattaaataactctacacccaatctggaaatttttccaaggttatttgaagtttacaaaaatgtgaagcataatcataagcttcaaagattcacagtttcattgtgctcaatgctcttgtgaaatgacagtcttaagctctgattctgtatcaaggaactaagtgaatcttctggaaatgaaaaggaacaacatatgtgtaagtgcagtagatgtaccaccagcgagaaaatagaggtcagagatctacaacgtgtggcatccattagaaatcacctttcctacattgaaaagaaaaaagagaaaaagcagaattttacactaatgttgcttgatgcaaagcacattaatgcttggaaggatacattcattttcgacttttcattcactcagaaaacttctagtaagtatctgcaacctgctaggcactgttccagaatctacacatttctactcacataaagagaatcctcataaagttaggattgttgttactaccttcaattgagcttaaaagacagcctcatcaagggaatgggataactgagccagtctaggacagtggtcaccttccacaggccacacactggaaagtgctaatgctactttaatagcaaacctctggatctaggagagagagcaattaattgcacaaaccaggagttaaaaccataaaaaaaacctatgcatctgtaatagtaaataacactcacgtactctggcaacatctagggtagtatcagaattatgtaaatggacatgacagggaaaaatcgtaggtttttttagtctaatccaacccaggaaatgtttattcctaccctacacctaattttaaaccttcttagcaacaaatatttcactattcgctcctactcctgggaagactaaatatataattgacttatttattaaatttaggagaaaaaaaaagttttccttgacattcagctctattggatttatttccatttaattgcatcatgtgttatgtcttggtaaacactccatttcctgtcttggtgggcatcctgtctgtgtacctgtgcagtacactttaatcatcaagacttcaaagtgcttttgagctatcaaatcttgggagagtcccatctagcatcttaataattatttttccaagttcgttataattaactcctttaacctcatctcattaaatcaattttgtattgtcattctgttgttctctggaaagcagccaattgttcagctcttgaatcagaattttcaaagactcacctctcttacctgggcttgcacatatttgtcctaagtaattctctatcccttaaacctctgagtccctctgttttattacttgccccactcctcctacttgaatatgtttgttttcccagttgaatgtgatttttatctactgttcatattatcttttatacccatgagtataatttcatagtcctttcaggttccacatcatcaaagagatgaccataatttcacttttttttgaaatgaagtcttgctctgttgcccaggctggagtgcagtggcacaatctcagctcactacaacctccgcctcccaggttcaagcgattctgccttagcctcccaagtagctggaattacaggtgcctgccaccatgtctggctaatttttgtgtttttagtagagatggggtttcaccatgttggccaggctggtcttgaactcgtgaccttaggtgatccacccacctcaacctcccaaagtgctaggattacaagagtgagccaccgcacctggccaattcacttttaaatactaaaaggcacacagcacacagacattttcggggcagttttctttgggagggtctttgataaattttgtaatcacctctcggaagaaagcccaaaatgacatgtgaaaataatattaaaccatttaccagatgtccagcaatataaaaatagacctcacatgctacccttcacatgctgattctcttgccttgctgtttaaggatccagtttcttatgttaaacattttccttaccttttgcaataatattattggccatatactaaattctcattcacttagctttctaagaattctttgaggttggaatcctgaaatcataaagctaccagatctgcacaacagcagtggtagtatctgagcccaaactctgagacgctctagagttttagtttacaaacatgagccagaccaaacctgacctggtgaaaatcaataggtaataaactgcttgtatatgatagcagttcaagggctttctgggttccatttcactgaggaaatgaaaatataactgattagccaagacagagtggcaataaggaataactgatcctcctccaagttgcagtgagcaagccctcaagcctacctcattcctgaagagttgaaggagaaaatgccgtgctaattttctgccctgctatttttaacctgaaatttagaattacatcaggtattcaaagaatgttccctatcaaaggaaaatctgtaaacgatgactgcaaaaagcaagtgaaatgatgcaaagagaaaatatttgcaaaacagaatctaaccagacatcatcatgaagataaaatggcatctcttctgtgtggcctgggtgtgcttggacaatcctgtcacacgtttctattaggacatgttgcccttttgaggattcactctatgttggccagatggtttaactgattaaacaattgaatcaatttattttgctttttgaattgaccagatatttaactaaatgtactgggtttggcattttagacacactgccttagattcttgtagtgcatgatgactttgaaaatgtttggccattttagttaaaatgcagggtaacatttgatgcagccatgataacaggaaaaatctgttctgttctaaaaatgtttctagcaatagaagtatttctggctaagagaatactcttgacttgtagggaggctccctcggaataaatgtatgcaacacaaataaggcattttattttttaaaagattgtctatataagatacacttattaaataaagaaattgttggtgaatgctctgaaaatagaggcttatgtaatggaaataagagattaacaggtttaccaaagattatttttataacctctatgccaattcacatgatcttatataagacaccaaaataagttattcaaaactgtgaataatgtcagacaaatgcaatgtgtcccttctagaacagtcacaaaaagaattggttatagctattttaataaataatatcctcaccccaagaacaaacgttcagttatgctgagatgttctaatagctgtgtgcgtagataagcacctccatcaagaaaggaacacatgaaattgtggctttaagagtttgtggcagagttggacagcattccatctgcaggttagtaggaaagcctgtaccagcctttgtggaatgtcctagtctgccacactgacaagagggtgcaccagtgctctactggaagagtatttctggttttctatgcaggactattgggcttataaattcctcaagaacaaggaccaagtctttaatctcgtctcgactcctaccttgtggaaattagtgcacagctcatagacattctacacacacttcttgaaattgctcctggcctgatattttggatgttaggtagtcagtgtccaataatactgttgtccgtgcaggttaatctagccattccttcatttgtgtgaagcataaataatgtaagtaaatacagcaactgaactttttatgttctataatagagcacttttatgtttttaatatcatttattatttctctgaaaatccagttaagatggcagatgattctattttttcatattatagcatctacccacaatatttctaactaactgtatttgaacaaagaacttccttagtctttcaatttaaattatgtatttgcttaatacatttttatatttgtaactgtggtaaaaaaaaaatctatatagcatcttgcatacattctcactagtacaggaataaaactgcagtttgttgaaggag

SEQ ID NO: 16904 - DNA, 6583 bp, Homo sapiens
  ENST00000550358
aagcatgaacagttgctaagtggaaaatggaggctgaattttacatggtgattcttacctgcttgatcttcaggaactcagaagggtttcagattgtccatgtccagaaacaacagtgtcttttcaaaaatgagaaagtggtcgtgggctcatgcaacaggaccatccagaaccagcagtggatgtggactgaggatgaaaagctccttcatgttaaatctgcactgtgcttggccatctccaactcttcccgcggcccctcccgctcagccatcttggaccgctgttcccaggcaccccgatggacctgctatgatcaggaaggcttccttgaggtggaaaatgcctctctctttctccagaaacaaggctccagagtagtggtcaagaaggccaggaaatacctccatagctggatgaaaatagatgtcaacaaggagggaaaactggtcaatgaaagcctctgtttacaaaaagctggcctgggagcagaagtttcggtgaggagcactagaaacacggctccaccccagattctcactacctttaatgcagttccagatggcctggtattccttattaggaataccacagaggccttcatcagaaatgctgcagaaaactacagccaaaacagcagcgagaggcagcatcccaatctgcacatgactggaattacagacacatcatgggttttgtcgactactcagcccttctccagcaccactgaagagactggactggcggagccagagagatgtaacttcaccctggcggagtccaaggcctccagccattctgtgtctatccagtggagaattttgggctcaccctgtaactttagcctcatctatagcagtgacaccctgggggccgcgttgtgccctacctttcggatagacaacaccacatacggatgtaaccttcaagatttacaagcaggaaccatctataacttcaggattatttctctggatgaagagagaacagtggtcttgcaaacagatcctttacctcctgctaggtttggagtcagtaaagagaagacgacttcaaccagcttgcatgtttggtggactccttcttccggaaaagtcacctcatatgaggtgcaattatttgatgaaaataaccaaaagatacagggggttcaaattcaagaaagtacttcatggaatgaatacacttttttcaatctcactgctggtagtaaatacaatattgccatcacagctgtttctggaggaaaacgttctttttcagtttataccaatggatcaacagtgccatctccagtgaaagatattggtatttccacaaaagccaattctctcctgatttcctggtcccatggttctgggaatgtggaacgataccggctgatgctaatggataaagggatcctagttcatggcggtgttgtggacaaacatgctacttcctatgcttttcacgggctgacccctggctacctctacaacctcactgttatgactgaggctgcagggctgcaaaactacaggtggaaactagtcaggacagcccccatggaagtctcaaatctgaaggtgacaaatgatggcagtttgacctctctaaaagtcaaatggcaaagacctcctggaaatgtggattcttacaatatcaccctgtctcacaaagggaccatcaaggaatccagagtattagcaccttggattactgaaactcactttaaagagttagtccccggtcgactttatcaagttactgtcagctgtgtctctggtgaactgtctgctcagaagatggcagtgggcagaacatttccagacaaagttgcaaacctggaggcaaacaataatggcaggatgaggtctcttgtagtgagctggtcgccccctgctggagactgggagcagtatcggatcctactcttcaatgattctgtggtgctgctcaacatcactgtgggaaaggaagaaacacagtatgtcatggatgacacggggctcgtaccgggaagacagtatgaggtggaagtcattgttgagagtggaaatttgaagaattctgagcgttgccaaggcaggacagtccccctggctgtcctccagcttcgtgtcaaacatgccaatgaaacctcactgagtatcatgtggcagacccctgtagcagaatgggagaaatacatcatttccctagctgacagagacctcttactgatccacaagtcactctccaaagatgccaaagaattcacttttactgacctggtgcctggacgaaaatacatggctacagtcaccagtattagtggagacttaaaaaattcctcttcagtaaaaggaagaacagtgcctgcccaagtgactgacttgcatgtggccaaccaaggaatgaccagtagtctgtttactaactggacccaggcacaaggagacgtagaattttaccaagtcttactgatccatgaaaatgtggtcattaaaaatgaaagcatctccagtgagaccagcagatacagcttccactctctcaagtccggcagcctgtactccgtggtggtaacaacagtgagtggagggatctcttcccgacaagtggttgtggagggaagaacagtgcctgacaaagtccagggagtcagtgttagcaactcagccaggagtgactatttaagggtatcctgggtgcatgccactggagactttgatcactatgaagtcaccattaaaaacaaaaacaacttcattcaaactaaaagcattcccaagtcagaaaacgaatgtgtatttgttcagctagtccctggacggttgtacagtgtcactgttactacaaaaagtggacaatatgaagccaatgaacaagggaatgggagaacaattccagagcctgttaaggatctaacattgcgcaacaggagcactgaggacttgcatgtgacttggtcaggagctaatggggatgtcgaccaatatgagatccagctgctcttcaatgacatgaaagtatttcctccttttcaccttgtaaataccgcaaccgagtatcgatttacttccctaacaccaggccgccaatacaaaattcttgtcttgacgattagcggggatgtacagcagtcagccttcattgagggcttcacagttcctagtgctgtcaaaaatattcacatttctcccaatggagcaacagatagcctgacggtgaactggactcctggtgggggagacgttgattcctacacggtgtcggcattcaggcacagtcaaaaggttgactctcagactattcccaagcacgtctttgagcacacgttccacagactggaggccggggagcagtaccagatcatgattgcctcagtcagcgggtccctgaagaatcagataaatgtggttgggcggacagttccagcatctgtccaaggagtaattgcagacaatgcatacagcagttattccttaatagtaagttggcaaaaagctgctggtgtggcagaaagatatgatatcctgcttctaactgaaaatggaatccttctgcgcaacacatcagagccagccaccactaagcaacacaaatttgaagatctaacaccaggcaagaaatacaagatacagatcctaactgtcagtggaggcctctttagcaaggaagcccagactgaaggccgaacagtcccagcagctgtcaccgacctgaggatcacagagaactccaccaggcacctgtccttccgctggaccgcctcagagggggagctcagctggtacaacatctttttgtacaacccagatgggaatctccaggagagagctcaagttgacccactagtccagagcttctctttccagaacttgctacaaggcagaatgtacaagatggtgattgtaactcacagtggggagctgtctaatgagtctttcatatttggtagaacagtcccagcctctgtgagtcatctcagggggtccaatcggaacacgacagacagcctttggttcaactggagtccagcctctggggactttgacttttatgagctgattctctataatcccaatggcacaaagaaggaaaactggaaagacaaggacctgacggagtggcggtttcaaggccttgttcctggaaggaagtacgtgctgtgggtggtaactcacagtggagatctcagcaataaagtcacagcggagagcagaacagctccaagtcctcccagtcttatgtcatttgctgacattgcaaacacatccttggccatcacgtggaaagggcccccagactggacagactacaacgactttgagctgcagtggttgcccagagatgcacttactgtcttcaacccctacaacaacagaaaatcagaaggacgcattgtgtatggtcttcgtccagggagatcctatcaattcaacgtcaagactgtcagtggtgattcctggaaaacttacagcaaaccaatttttggatctgtgaggacaaagcctgacaagatacaaaacctgcattgccggcctcagaactccacggccattgcctgttcttggatccctcctgattctgactttgatggttatagtattgaatgccggaaaatggacacccaagaagttgagttttccagaaagctggagaaagaaaaatctctgctcaacatcatgatgctagtgccccataagaggtacctggtgtccatcaaagtgcagtcggccggcatgaccagcgaggtggttgaagacagcactatcacaatgatagaccgcccccctcctccacccccacacattcgtgtgaatgaaaaggatgtgctaattagcaagtcttccatcaactttactgtcaactgcagctggttcagcgacaccaatggagctgtgaaatacttcacagtggtggtgagagaggctgatggcagtgatgagctgaagccagaacagcagcaccctctcccttcctacctggagtacaggcacaatgcctccattcgggtgtatcagactaattattttgccagcaaatgtgccgaaaatcctaacagcaactccaagagttttaacattaagcttggagcagagatggagagcctaggtggaaaatgcgatcccactcagcaaaaattctgtgatggaccactgaagccacacactgcctacagaatcagcattcgagcttttacacagctctttgatgaggacctgaaggaattcacaaagccactctattcagacacatttttttctttacccatcactactgaatcagagcccttgtttggagctattgaaggtgtgagtgctggtctgtttttaattggcatgctagtggctgttgttgccttattgatctgcagacagaaagtgagccatggtcgagaaagaccctctgcccgtctgagcattcgtagggatcgaccattatctgtccacttaaacctgggccagaaaggtaaccggaaaacttcttgtccaataaaaataaatcagtttgaagggcatttcatgaagctacaggctgactccaactaccttctatccaaggaatacgaggagttaaaagacgtgggccgaaaccagtcatgtgacattgcactcttgccggagaatagagggaaaaatcgatacaacaatatattgccctatgatgccacgcgagtgaagctctccaatgtagatgatgatccttgctctgactacatcaatgccagctacatccctggcaacaacttcagaagagaatacattgtcactcagggaccgcttcctggcaccaaggatgacttctggaaaatggtgtgggaacaaaacgttcacaacatcgtcatggtgacccagtgtgttgagaagggccgagtaaagtgtgatcattactggccagcggaccaggattccctctactatggggacctcatcctgcagatgctctcagagtccgtcctgcctgagtggaccatccgggagtttaagatatgcggtgaggaacagcttgatgcacacagactcatccgccactttcactatacggtgtggccagaccatggagtcccagaaaccacccagtctctgatccagtttgtgagaactgtcagggactacatcaacagaagcccgggtgctgggcccactgtggtgcactgcagtgctggtgtgggtaggactggaacctttattgcattggaccgaatcctccagcagttagactccaaagactctgtggacatttatggagcagtgcacgacctaagacttcacagggttcacatggtccagactgagtgtcagtatgtctacctacatcagtgtgtaagagatgtcctcagagcaagaaagctacggagtgaacaagaaaaccccttgtttccaatctatgaaaatgtgaatccagagtatcacagagatccagtctattcaaggcattgagaatgtacctgaagagctcctggataaaaattattcactgtgtgatttgtttttaaaaacttgcttcatgccctacagaggtgccagctatttctgttgatactatgtataatttattaatctggagaatgtttaaaattttatataatttaaaggtaacagatattattgta

SEQ ID NO: 16905 - DNA, 5839 bp, Homo sapiens
  ENST00000538708
tctcctctggatcttaactactgagcgcaatgctgagccatggagccgggttggccttgtggatcacactgagcctgctgcagactggactggcggagccagagagatgtaacttcaccctggcggagtccaaggcctccagccattctgtgtctatccagtggagaattttgggctcaccctgtaactttagcctcatctatagcagtgacaccctgggggccgcgttgtgccctacctttcggatagacaacaccacatacggatgtaaccttcaagatttacaagcaggaaccatctataacttcaggattatttctctggatgaagagagaacagtggtcttgcaaacagatcctttacctcctgctaggtttggagtcagtaaagagaagacgacttcaaccagcttgcatgtttggtggactccttcttccggaaaagtcacctcatatgaggtgcaattatttgatgaaaataaccaaaagatacagggggttcaaattcaagaaagtacttcatggaatgaatacacttttttcaatctcactgctggtagtaaatacaatattgccatcacagctgtttctggaggaaaacgttctttttcagtttataccaatggatcaacagtgccatctccagtgaaagatattggtatttccacaaaagccaattctctcctgatttcctggtcccatggttctgggaatgtggaacgataccggctgatgctaatggataaagggatcctagttcatggcggtgttgtggacaaacatgctacttcctatgcttttcacgggctgacccctggctacctctacaacctcactgttatgactgaggctgcagggctgcaaaactacaggtggaaactagtcaggacagcccccatggaagtctcaaatctgaaggtgacaaatgatggcagtttgacctctctaaaagtcaaatggcaaagacctcctggaaatgtggattcttacaatatcaccctgtctcacaaagggaccatcaaggaatccagagtattagcaccttggattactgaaactcactttaaagagttagtccccggtcgactttatcaagttactgtcagctgtgtctctggtgaactgtctgctcagaagatggcagtgggcagaacatttccagacaaagttgcaaacctggaggcaaacaataatggcaggatgaggtctcttgtagtgagctggtcgccccctgctggagactgggagcagtatcggatcctactcttcaatgattctgtggtgctgctcaacatcactgtgggaaaggaagaaacacagtatgtcatggatgacacggggctcgtaccgggaagacagtatgaggtggaagtcattgttgagagtggaaatttgaagaattctgagcgttgccaaggcaggacagtccccctggctgtcctccagcttcgtgtcaaacatgccaatgaaacctcactgagtatcatgtggcagacccctgtagcagaatgggagaaatacatcatttccctagctgacagagacctcttactgatccacaagtcactctccaaagatgccaaagaattcacttttactgacctggtgcctggacgaaaatacatggctacagtcaccagtattagtggagacttaaaaaattcctcttcagtaaaaggaagaacagtgcctgcccaagtgactgacttgcatgtggccaaccaaggaatgaccagtagtctgtttactaactggacccaggcacaaggagacgtagaattttaccaagtcttactgatccatgaaaatgtggtcattaaaaatgaaagcatctccagtgagaccagcagatacagcttccactctctcaagtccggcagcctgtactccgtggtggtaacaacagtgagtggagggatctcttcccgacaagtggttgtggagggaagaacagtcccttccagtgtgagtggagtaacggtgaacaattccggtcgtaatgactacctcagcgtttcctggctgctggcgcccggagatgtggataactatgaggtaacattgtctcatgacggcaaggtggttcagtcccttgtcattgccaagtctgtcagagaatgttccttcagctccctcaccccaggccgcctctacaccgtgaccataactacaaggagtggcaagtatgaaaatcactccttcagccaagagcggacagtgcctgacaaagtccagggagtcagtgttagcaactcagccaggagtgactatttaagggtatcctgggtgcatgccactggagactttgatcactatgaagtcaccattaaaaacaaaaacaacttcattcaaactaaaagcattcccaagtcagaaaacgaatgtgtatttgttcagctagtccctggacggttgtacagtgtcactgttactacaaaaagtggacaatatgaagccaatgaacaagggaatgggagaacaattccagagcctgttaaggatctaacattgcgcaacaggagcactgaggacttgcatgtgacttggtcaggagctaatggggatgtcgaccaatatgagatccagctgctcttcaatgacatgaaagtatttcctccttttcaccttgtaaataccgcaaccgagtatcgatttacttccctaacaccaggccgccaatacaaaattcttgtcttgacgattagcggggatgtacagcagtcagccttcattgagggcttcacagttcctagtgctgtcaaaaatattcacatttctcccaatggagcaacagatagcctgacggtgaactggactcctggtgggggagacgttgattcctacacggtgtcggcattcaggcacagtcaaaaggttgactctcagactattcccaagcacgtctttgagcacacgttccacagactggaggccggggagcagtaccagatcatgattgcctcagtcagcgggtccctgaagaatcagataaatgtggttgggcggacagtcccagcagctgtcaccgacctgaggatcacagagaactccaccaggcacctgtccttccgctggaccgcctcagagggggagctcagctggtacaacatctttttgtacaacccagatgggaatctccaggagagagctcaagttgacccactagtccagagcttctctttccagaacttgctacaaggcagaatgtacaagatggtgattgtaactcacagtggggagctgtctaatgagtctttcatatttggtagaacagtcccagcctctgtgagtcatctcagggggtccaatcggaacacgacagacagcctttggttcaactggagtccagcctctggggactttgacttttatgagctgattctctataatcccaatggcacaaagaaggaaaactggaaagacaaggacctgacggagtggcggtttcaaggccttgttcctggaaggaagtacgtgctgtgggtggtaactcacagtggagatctcagcaataaagtcacagcggagagcagaacagctccaagtcctcccagtcttatgtcatttgctgacattgcaaacacatccttggccatcacgtggaaagggcccccagactggacagactacaacgactttgagctgcagtggttgcccagagatgcacttactgtcttcaacccctacaacaacagaaaatcagaaggacgcattgtgtatggtcttcgtccagggagatcctatcaattcaacgtcaagactgtcagtggtgattcctggaaaacttacagcaaaccaatttttggatctgtgaggacaaagcctgacaagatacaaaacctgcattgccggcctcagaactccacggccattgcctgttcttggatccctcctgattctgactttgatggttatagtattgaatgccggaaaatggacacccaagaagttgagttttccagaaagctggagaaagaaaaatctctgctcaacatcatgatgctagtgccccataagaggtacctggtgtccatcaaagtgcagtcggccggcatgaccagcgaggtggttgaagacagcactatcacaatgatagaccgcccccctcctccacccccacacattcgtgtgaatgaaaaggatgtgctaattagcaagtcttccatcaactttactgtcaactgcagctggttcagcgacaccaatggagctgtgaaatacttcacagtggtggtgagagaggctgatggcagtgatgagctgaagccagaacagcagcaccctctcccttcctacctggagtacaggcacaatgcctccattcgggtgtatcagactaattattttgccagcaaatgtgccgaaaatcctaacagcaactccaagagttttaacattaagcttggagcagagatggagagcctaggtggaaaatgcgatcccactcagcaaaaattctgtgatggaccactgaagccacacactgcctacagaatcagcattcgagcttttacacagctctttgatgaggacctgaaggaattcacaaagccactctattcagacacatttttttctttacccatcactactgaatcagagcccttgtttggagctattgaaggtgtgagtgctggtctgtttttaattggcatgctagtggctgttgttgccttattgatctgcagacagaaagtgagccatggtcgagaaagaccctctgcccgtctgagcattcgtagggatcgaccattatctgtccacttaaacctgggccagaaaggtaaccggaaaacttcttgtccaataaaaataaatcagtttgaagggcatttcatgaagctacaggctgactccaactaccttctatccaaggaatacgaggagttaaaagacgtgggccgaaaccagtcatgtgacattgcactcttgccggagaatagagggaaaaatcgatacaacaatatattgccctatgatgccacgcgagtgaagctctccaatgtagatgatgatccttgctctgactacatcaatgccagctacatccctggcaacaacttcagaagagaatacattgtcactcagggaccgcttcctggcaccaaggatgacttctggaaaatggtgtgggaacaaaacgttcacaacatcgtcatggtgacccagtgtgttgagaagggccgagtaaagtgtgatcattactggccagcggaccaggattccctctactatggggacctcatcctgcagatgctctcagagtccgtcctgcctgagtggaccatccgggagtttaagatatgcggtgaggaacagcttgatgcacacagactcatccgccactttcactatacggtgtggccagaccatggagtcccagaaaccacccagtctctgatccagtttgtgagaactgtcagggactacatcaacagaagcccgggtgctgggcccactgtggtgcactgcagtgctggtgtgggtaggactggaacctttattgcattggaccgaatcctccagcagttagactccaaagactctgtggacatttatggagcagtgcacgacctaagacttcacagggttcacatggtccagactgagtgtcagtatgtctacctacatcagtgtgtaagagatgtcctcagagcaagaaagctacggagtgaacaagaaaaccccttgtttccaatctatgaaaatgtgaatccagagtatcacagagatccagtctattcaaggcattgagaatgtacctgaagagctcctggataaaaattattcactgtgtgatttgtttttaaaaacttgcttcatgccctacagaggtgcca

SEQ ID NO: 16906 - DNA, 5839 bp, Homo sapiens
  ENST00000550857
tctcctctggatcttaactactgagcgcaatgctgagccatggagccgggttggccttgtggatcacactgagcctgctgcagactggactggcggagccagagagatgtaacttcaccctggcggagtccaaggcctccagccattctgtgtctatccagtggagaattttgggctcaccctgtaactttagcctcatctatagcagtgacaccctgggggccgcgttgtgccctacctttcggatagacaacaccacatacggatgtaaccttcaagatttacaagcaggaaccatctataacttcaggattatttctctggatgaagagagaacagtggtcttgcaaacagatcctttacctcctgctaggtttggagtcagtaaagagaagacgacttcaaccagcttgcatgtttggtggactccttcttccggaaaagtcacctcatatgaggtgcaattatttgatgaaaataaccaaaagatacagggggttcaaattcaagaaagtacttcatggaatgaatacacttttttcaatctcactgctggtagtaaatacaatattgccatcacagctgtttctggaggaaaacgttctttttcagtttataccaatggatcaacagtgccatctccagtgaaagatattggtatttccacaaaagccaattctctcctgatttcctggtcccatggttctgggaatgtggaacgataccggctgatgctaatggataaagggatcctagttcatggcggtgttgtggacaaacatgctacttcctatgcttttcacgggctgacccctggctacctctacaacctcactgttatgactgaggctgcagggctgcaaaactacaggtggaaactagtcaggacagcccccatggaagtctcaaatctgaaggtgacaaatgatggcagtttgacctctctaaaagtcaaatggcaaagacctcctggaaatgtggattcttacaatatcaccctgtctcacaaagggaccatcaaggaatccagagtattagcaccttggattactgaaactcactttaaagagttagtccccggtcgactttatcaagttactgtcagctgtgtctctggtgaactgtctgctcagaagatggcagtgggcagaacattccccctggctgtcctccagcttcgtgtcaaacatgccaatgaaacctcactgagtatcatgtggcagacccctgtagcagaatgggagaaatacatcatttccctagctgacagagacctcttactgatccacaagtcactctccaaagatgccaaagaattcacttttactgacctggtgcctggacgaaaatacatggctacagtcaccagtattagtggagacttaaaaaattcctcttcagtaaaaggaagaacagtgcctgcccaagtgactgacttgcatgtggccaaccaaggaatgaccagtagtctgtttactaactggacccaggcacaaggagacgtagaattttaccaagtcttactgatccatgaaaatgtggtcattaaaaatgaaagcatctccagtgagaccagcagatacagcttccactctctcaagtccggcagcctgtactccgtggtggtaacaacagtgagtggagggatctcttcccgacaagtggttgtggagggaagaacagtcccttccagtgtgagtggagtaacggtgaacaattccggtcgtaatgactacctcagcgtttcctggctgctggcgcccggagatgtggataactatgaggtaacattgtctcatgacggcaaggtggttcagtcccttgtcattgccaagtctgtcagagaatgttccttcagctccctcaccccaggccgcctctacaccgtgaccataactacaaggagtggcaagtatgaaaatcactccttcagccaagagcggacagtgcctgacaaagtccagggagtcagtgttagcaactcagccaggagtgactatttaagggtatcctgggtgcatgccactggagactttgatcactatgaagtcaccattaaaaacaaaaacaacttcattcaaactaaaagcattcccaagtcagaaaacgaatgtgtatttgttcagctagtccctggacggttgtacagtgtcactgttactacaaaaagtggacaatatgaagccaatgaacaagggaatgggagaacaattccagagcctgttaaggatctaacattgcgcaacaggagcactgaggacttgcatgtgacttggtcaggagctaatggggatgtcgaccaatatgagatccagctgctcttcaatgacatgaaagtatttcctccttttcaccttgtaaataccgcaaccgagtatcgatttacttccctaacaccaggccgccaatacaaaattcttgtcttgacgattagcggggatgtacagcagtcagccttcattgagggcttcacagttcctagtgctgtcaaaaatattcacatttctcccaatggagcaacagatagcctgacggtgaactggactcctggtgggggagacgttgattcctacacggtgtcggcattcaggcacagtcaaaaggttgactctcagactattcccaagcacgtctttgagcacacgttccacagactggaggccggggagcagtaccagatcatgattgcctcagtcagcgggtccctgaagaatcagataaatgtggttgggcggacagttccagcatctgtccaaggagtaattgcagacaatgcatacagcagttattccttaatagtaagttggcaaaaagctgctggtgtggcagaaagatatgatatcctgcttctaactgaaaatggaatccttctgcgcaacacatcagagccagccaccactaagcaacacaaatttgaagatctaacaccaggcaagaaatacaagatacagatcctaactgtcagtggaggcctctttagcaaggaagcccagactgaaggccgaacagtcccagcagctgtcaccgacctgaggatcacagagaactccaccaggcacctgtccttccgctggaccgcctcagagggggagctcagctggtacaacatctttttgtacaacccagatgggaatctccaggagagagctcaagttgacccactagtccagagcttctctttccagaacttgctacaaggcagaatgtacaagatggtgattgtaactcacagtggggagctgtctaatgagtctttcatatttggtagaacagtcccagcctctgtgagtcatctcagggggtccaatcggaacacgacagacagcctttggttcaactggagtccagcctctggggactttgacttttatgagctgattctctataatcccaatggcacaaagaaggaaaactggaaagacaaggacctgacggagtggcggtttcaaggccttgttcctggaaggaagtacgtgctgtgggtggtaactcacagtggagatctcagcaataaagtcacagcggagagcagaacagctccaagtcctcccagtcttatgtcatttgctgacattgcaaacacatccttggccatcacgtggaaagggcccccagactggacagactacaacgactttgagctgcagtggttgcccagagatgcacttactgtcttcaacccctacaacaacagaaaatcagaaggacgcattgtgtatggtcttcgtccagggagatcctatcaattcaacgtcaagactgtcagtggtgattcctggaaaacttacagcaaaccaatttttggatctgtgaggacaaagcctgacaagatacaaaacctgcattgccggcctcagaactccacggccattgcctgttcttggatccctcctgattctgactttgatggttatagtattgaatgccggaaaatggacacccaagaagttgagttttccagaaagctggagaaagaaaaatctctgctcaacatcatgatgctagtgccccataagaggtacctggtgtccatcaaagtgcagtcggccggcatgaccagcgaggtggttgaagacagcactatcacaatgatagaccgcccccctcctccacccccacacattcgtgtgaatgaaaaggatgtgctaattagcaagtcttccatcaactttactgtcaactgcagctggttcagcgacaccaatggagctgtgaaatacttcacagtggtggtgagagaggctgatggcagtgatgagctgaagccagaacagcagcaccctctcccttcctacctggagtacaggcacaatgcctccattcgggtgtatcagactaattattttgccagcaaatgtgccgaaaatcctaacagcaactccaagagttttaacattaagcttggagcagagatggagagcctaggtggaaaatgcgatcccactcagcaaaaattctgtgatggaccactgaagccacacactgcctacagaatcagcattcgagcttttacacagctctttgatgaggacctgaaggaattcacaaagccactctattcagacacatttttttctttacccatcactactgaatcagagcccttgtttggagctattgaaggtgtgagtgctggtctgtttttaattggcatgctagtggctgttgttgccttattgatctgcagacagaaagtgagccatggtcgagaaagaccctctgcccgtctgagcattcgtagggatcgaccattatctgtccacttaaacctgggccagaaaggtaaccggaaaacttcttgtccaataaaaataaatcagtttgaagggcatttcatgaagctacaggctgactccaactaccttctatccaaggaatacgaggagttaaaagacgtgggccgaaaccagtcatgtgacattgcactcttgccggagaatagagggaaaaatcgatacaacaatatattgccctatgatgccacgcgagtgaagctctccaatgtagatgatgatccttgctctgactacatcaatgccagctacatccctggcaacaacttcagaagagaatacattgtcactcagggaccgcttcctggcaccaaggatgacttctggaaaatggtgtgggaacaaaacgttcacaacatcgtcatggtgacccagtgtgttgagaagggccgagtaaagtgtgatcattactggccagcggaccaggattccctctactatggggacctcatcctgcagatgctctcagagtccgtcctgcctgagtggaccatccgggagtttaagatatgcggtgaggaacagcttgatgcacacagactcatccgccactttcactatacggtgtggccagaccatggagtcccagaaaccacccagtctctgatccagtttgtgagaactgtcagggactacatcaacagaagcccgggtgctgggcccactgtggtgcactgcagtgctggtgtgggtaggactggaacctttattgcattggaccgaatcctccagcagttagactccaaagactctgtggacatttatggagcagtgcacgacctaagacttcacagggttcacatggtccagactgagtgtcagtatgtctacctacatcagtgtgtaagagatgtcctcagagcaagaaagctacggagtgaacaagaaaaccccttgtttccaatctatgaaaatgtgaatccagagtatcacagagatccagtctattcaaggcattgagaatgtacctgaagagctcctggataaaaattattcactgtgtgatttgtttttaaaaacttgcttcatgccctacagaggtgcca

SEQ ID NO: 16907 - DNA, 6110 bp, Homo sapiens
  ENST00000261266
gtctcctctggatcttaactactgagcgcaatgctgagccatggagccgggttggccttgtggatcacactgagcctgctgcagactggactggcggagccagagagatgtaacttcaccctggcggagtccaaggcctccagccattctgtgtctatccagtggagaattttgggctcaccctgtaactttagcctcatctatagcagtgacaccctgggggccgcgttgtgccctacctttcggatagacaacaccacatacggatgtaaccttcaagatttacaagcaggaaccatctataacttcaggattatttctctggatgaagagagaacagtggtcttgcaaacagatcctttacctcctgctaggtttggagtcagtaaagagaagacgacttcaaccagcttgcatgtttggtggactccttcttccggaaaagtcacctcatatgaggtgcaattatttgatgaaaataaccaaaagatacagggggttcaaattcaagaaagtacttcatggaatgaatacacttttttcaatctcactgctggtagtaaatacaatattgccatcacagctgtttctggaggaaaacgttctttttcagtttataccaatggatcaacagtgccatctccagtgaaagatattggtatttccacaaaagccaattctctcctgatttcctggtcccatggttctgggaatgtggaacgataccggctgatgctaatggataaagggatcctagttcatggcggtgttgtggacaaacatgctacttcctatgcttttcacgggctgacccctggctacctctacaacctcactgttatgactgaggctgcagggctgcaaaactacaggtggaaactagtcaggacagcccccatggaagtctcaaatctgaaggtgacaaatgatggcagtttgacctctctaaaagtcaaatggcaaagacctcctggaaatgtggattcttacaatatcaccctgtctcacaaagggaccatcaaggaatccagagtattagcaccttggattactgaaactcactttaaagagttagtccccggtcgactttatcaagttactgtcagctgtgtctctggtgaactgtctgctcagaagatggcagtgggcagaacatttccagacaaagttgcaaacctggaggcaaacaataatggcaggatgaggtctcttgtagtgagctggtcgccccctgctggagactgggagcagtatcggatcctactcttcaatgattctgtggtgctgctcaacatcactgtgggaaaggaagaaacacagtatgtcatggatgacacggggctcgtaccgggaagacagtatgaggtggaagtcattgttgagagtggaaatttgaagaattctgagcgttgccaaggcaggacagtccccctggctgtcctccagcttcgtgtcaaacatgccaatgaaacctcactgagtatcatgtggcagacccctgtagcagaatgggagaaatacatcatttccctagctgacagagacctcttactgatccacaagtcactctccaaagatgccaaagaattcacttttactgacctggtgcctggacgaaaatacatggctacagtcaccagtattagtggagacttaaaaaattcctcttcagtaaaaggaagaacagtgcctgcccaagtgactgacttgcatgtggccaaccaaggaatgaccagtagtctgtttactaactggacccaggcacaaggagacgtagaattttaccaagtcttactgatccatgaaaatgtggtcattaaaaatgaaagcatctccagtgagaccagcagatacagcttccactctctcaagtccggcagcctgtactccgtggtggtaacaacagtgagtggagggatctcttcccgacaagtggttgtggagggaagaacagtcccttccagtgtgagtggagtaacggtgaacaattccggtcgtaatgactacctcagcgtttcctggctgctggcgcccggagatgtggataactatgaggtaacattgtctcatgacggcaaggtggttcagtcccttgtcattgccaagtctgtcagagaatgttccttcagctccctcaccccaggccgcctctacaccgtgaccataactacaaggagtggcaagtatgaaaatcactccttcagccaagagcggacagtgcctgacaaagtccagggagtcagtgttagcaactcagccaggagtgactatttaagggtatcctgggtgcatgccactggagactttgatcactatgaagtcaccattaaaaacaaaaacaacttcattcaaactaaaagcattcccaagtcagaaaacgaatgtgtatttgttcagctagtccctggacggttgtacagtgtcactgttactacaaaaagtggacaatatgaagccaatgaacaagggaatgggagaacaattccagagcctgttaaggatctaacattgcgcaacaggagcactgaggacttgcatgtgacttggtcaggagctaatggggatgtcgaccaatatgagatccagctgctcttcaatgacatgaaagtatttcctccttttcaccttgtaaataccgcaaccgagtatcgatttacttccctaacaccaggccgccaatacaaaattcttgtcttgacgattagcggggatgtacagcagtcagccttcattgagggcttcacagttcctagtgctgtcaaaaatattcacatttctcccaatggagcaacagatagcctgacggtgaactggactcctggtgggggagacgttgattcctacacggtgtcggcattcaggcacagtcaaaaggttgactctcagactattcccaagcacgtctttgagcacacgttccacagactggaggccggggagcagtaccagatcatgattgcctcagtcagcgggtccctgaagaatcagataaatgtggttgggcggacagttccagcatctgtccaaggagtaattgcagacaatgcatacagcagttattccttaatagtaagttggcaaaaagctgctggtgtggcagaaagatatgatatcctgcttctaactgaaaatggaatccttctgcgcaacacatcagagccagccaccactaagcaacacaaatttgaagatctaacaccaggcaagaaatacaagatacagatcctaactgtcagtggaggcctctttagcaaggaagcccagactgaaggccgaacagtcccagcagctgtcaccgacctgaggatcacagagaactccaccaggcacctgtccttccgctggaccgcctcagagggggagctcagctggtacaacatctttttgtacaacccagatgggaatctccaggagagagctcaagttgacccactagtccagagcttctctttccagaacttgctacaaggcagaatgtacaagatggtgattgtaactcacagtggggagctgtctaatgagtctttcatatttggtagaacagtcccagcctctgtgagtcatctcagggggtccaatcggaacacgacagacagcctttggttcaactggagtccagcctctggggactttgacttttatgagctgattctctataatcccaatggcacaaagaaggaaaactggaaagacaaggacctgacggagtggcggtttcaaggccttgttcctggaaggaagtacgtgctgtgggtggtaactcacagtggagatctcagcaataaagtcacagcggagagcagaacagctccaagtcctcccagtcttatgtcatttgctgacattgcaaacacatccttggccatcacgtggaaagggcccccagactggacagactacaacgactttgagctgcagtggttgcccagagatgcacttactgtcttcaacccctacaacaacagaaaatcagaaggacgcattgtgtatggtcttcgtccagggagatcctatcaattcaacgtcaagactgtcagtggtgattcctggaaaacttacagcaaaccaatttttggatctgtgaggacaaagcctgacaagatacaaaacctgcattgccggcctcagaactccacggccattgcctgttcttggatccctcctgattctgactttgatggttatagtattgaatgccggaaaatggacacccaagaagttgagttttccagaaagctggagaaagaaaaatctctgctcaacatcatgatgctagtgccccataagaggtacctggtgtccatcaaagtgcagtcggccggcatgaccagcgaggtggttgaagacagcactatcacaatgatagaccgcccccctcctccacccccacacattcgtgtgaatgaaaaggatgtgctaattagcaagtcttccatcaactttactgtcaactgcagctggttcagcgacaccaatggagctgtgaaatacttcacagtggtggtgagagaggctgatggcagtgatgagctgaagccagaacagcagcaccctctcccttcctacctggagtacaggcacaatgcctccattcgggtgtatcagactaattattttgccagcaaatgtgccgaaaatcctaacagcaactccaagagttttaacattaagcttggagcagagatggagagcctaggtggaaaatgcgatcccactcagcaaaaattctgtgatggaccactgaagccacacactgcctacagaatcagcattcgagcttttacacagctctttgatgaggacctgaaggaattcacaaagccactctattcagacacatttttttctttacccatcactactgaatcagagcccttgtttggagctattgaaggtgtgagtgctggtctgtttttaattggcatgctagtggctgttgttgccttattgatctgcagacagaaagtgagccatggtcgagaaagaccctctgcccgtctgagcattcgtagggatcgaccattatctgtccacttaaacctgggccagaaaggtaaccggaaaacttcttgtccaataaaaataaatcagtttgaagggcatttcatgaagctacaggctgactccaactaccttctatccaaggaatacgaggagttaaaagacgtgggccgaaaccagtcatgtgacattgcactcttgccggagaatagagggaaaaatcgatacaacaatatattgccctatgatgccacgcgagtgaagctctccaatgtagatgatgatccttgctctgactacatcaatgccagctacatccctggcaacaacttcagaagagaatacattgtcactcagggaccgcttcctggcaccaaggatgacttctggaaaatggtgtgggaacaaaacgttcacaacatcgtcatggtgacccagtgtgttgagaagggccgagtaaagtgtgatcattactggccagcggaccaggattccctctactatggggacctcatcctgcagatgctctcagagtccgtcctgcctgagtggaccatccgggagtttaagatatgcggtgaggaacagcttgatgcacacagactcatccgccactttcactatacggtgtggccagaccatggagtcccagaaaccacccagtctctgatccagtttgtgagaactgtcagggactacatcaacagaagcccgggtgctgggcccactgtggtgcactgcagtgctggtgtgggtaggactggaacctttattgcattggaccgaatcctccagcagttagactccaaagactctgtggacatttatggagcagtgcacgacctaagacttcacagggttcacatggtccagactgagtgtcagtatgtctacctacatcagtgtgtaagagatgtcctcagagcaagaaagctacggagtgaacaagaaaaccccttgtttccaatctatgaaaatgtgaatccagagtatcacagagatccagtctattcaaggcattgagaatgtacctgaagagctcctggataaaaattattcactgtgtgatttgtttttaaaaacttgcttcatgccctacagaggtgcca

SEQ ID NO: 16908 - DNA, 552 bp, Homo sapiens
  ENST00000549400
cataatcagaataaaagttatctcccttatgtttcagccatggtcgagaaagaccctctgcccgtctgagcattcgtagggatcgaccattatctgtccacttaaacctgggccagaaaggtaaccggaaaacttcttggtaagagagagaacacattaattactatattatctgcctttgaaatatgagtcagaatagttatggcactttcccttttctgcagtaactcttttctgtttgtttcatttttaattacagtccaataaaaataaatcagtttgaagggcatttcatgaagctacaggctgactccaactaccttctatccaaggaatacgaggtacaactcaggcagaatgaagcttcagcatccctagttcttagcagaatttccttcctaatgtttactgtgtcatcataggctgattgagctcagaagttaggaggctgcttagaatctcagctgagcactcttttatgcctaaactatgccctgaatagaatataccatctaatcttagaggccagcttgagctccagaataacacagc

SEQ ID NO: 16909 - DNA, 5291 bp, Homo sapiens
  ENST00000551525
agcatgaacagttgctaagtggaaaatggaggctgaattttacatggtgattcttacctgcttgatcttcaggaactcagggtttcagattgtccatgtccagaaacaacagtgtcttttcaaaaatgagaaagtggtcgtgggctcatgcaacaggaccatccagaaccagcagtggatgtggactgaggatgaaaagctccttcatgttaaatctgcactgtgcttggccatctccaactcttcccgcggcccctcccgctcagccatcttggaccgctgttcccaggcaccccgatggacctgctatgatcaggaaggcttccttgaggtggaaaatgcctctctctttctccagaaacaaggctccagagtagtggtcaagaaggccaggaaatacctccatagctggatgaaaatagatgtcaacaaggagggaaaactggtcaatgaaagcctctgtttacaaaaagctggcctgggagcagaagtttcggtgaggagcactagaaacacggctccaccccagattctcactacctttaatgcagttccagatggcctggtattccttattaggaataccacagaggccttcatcagaaatgctgcagaaaactacagccaaaacagcagcgagaggcagcatcccaatctgcacatgactggaattacagacacatcatgggttttgtcgactactcagcccttctccagcaccactgaagagactggactggcggagccagagagatgtaacttcaccctggcggagtccaaggcctccagccattctgtgtctatccagtggagaattttgggctcaccctgtaactttagcctcatctatagcagtgacaccctgggggccgcgttgtgccctacctttcggatagacaacaccacatacggatgtaaccttcaagatttacaagcaggaaccatctataacttcaggattatttctctggatgaagagagaacagtggtcttgcaaacagatcctttacctcctgctaggtttggagtcagtaaagagaagacgacttcaaccagcttgcatgtttggtggactccttcttccggaaaagtcacctcatatgaggtgcaattatttgatgaaaataaccaaaagatacagggggttcaaattcaagaaagtacttcatggaatgaatacacttttttcaatctcactgctggtagtaaatacaatattgccatcacagctgtttctggaggaaaacgttctttttcagtttataccaatggatcaacagtgccatctccagtgaaagatattggtatttccacaaaagccaattctctcctgatttcctggtcccatggttctgggaatgtggaacgataccggctgatgctaatggataaagggatcctagttcatggcggtgttgtggacaaacatgctacttcctatgcttttcacgggctgacccctggctacctctacaacctcactgttatgactgaggctgcagggctgcaaaactacaggtggaaactagtcaggacagcccccatggaagtctcaaatctgaaggtgacaaatgatggcagtttgacctctctaaaagtcaaatggcaaagacctcctggaaatgtggattcttacaatatcaccctgtctcacaaagggaccatcaaggaatccagagtattagcaccttggattactgaaactcactttaaagagttagtccccggtcgactttatcaagttactgtcagctgtgtctctggtgaactgtctgctcagaagatggcagtgggcagaacatttccagacaaagttgcaaacctggaggcaaacaataatggcaggatgaggtctcttgtagtgagctggtcgccccctgctggagactgggagcagtatcggatcctactcttcaatgattctgtggtgctgctcaacatcactgtgggaaaggaagaaacacagtatgtcatggatgacacggggctcgtaccgggaagacagtatgaggtggaagtcattgttgagagtggaaatttgaagaattctgagcgttgccaaggcaggacagtccccctggctgtcctccagcttcgtgtcaaacatgccaatgaaacctcactgagtatcatgtggcagacccctgtagcagaatgggagaaatacatcatttccctagctgacagagacctcttactgatccacaagtcactctccaaagatgccaaagaattcacttttactgacctggtgcctggacgaaaatacatggctacagtcaccagtattagtggagacttaaaaaattcctcttcagtaaaaggaagaacagtgcctgcccaagtgactgacttgcatgtggccaaccaaggaatgaccagtagtctgtttactaactggacccaggcacaaggagacgtagaattttaccaagtcttactgatccatgaaaatgtggtcattaaaaatgaaagcatctccagtgagaccagcagatacagcttccactctctcaagtccggcagcctgtactccgtggtggtaacaacagtgagtggagggatctcttcccgacaagtggttgtggagggaagaacagtcccttccagtgtgagtggagtaacggtgaacaattccggtcgtaatgactacctcagcgtttcctggctgctggcgcccggagatgtggataactatgaggtaacattgtctcatgacggcaaggtggttcagtcccttgtcattgccaagtctgtcagagaatgttccttcagctccctcaccccaggccgcctctacaccgtgaccataactacaaggagtggcaagtatgaaaatcactccttcagccaagagcggacagtgcctgacaaagtccagggagtcagtgttagcaactcagccaggagtgactatttaagggtatcctgggtgcatgccactggagactttgatcactatgaagtcaccattaaaaacaaaaacaacttcattcaaactaaaagcattcccaagtcagaaaacgaatgtgtatttgttcagctagtccctggacggttgtacagtgtcactgttactacaaaaagtggacaatatgaagccaatgaacaagggaatgggagaacaattccagagcctgttaaggatctaacattgcgcaacaggagcactgaggacttgcatgtgacttggtcaggagctaatggggatgtcgaccaatatgagatccagctgctcttcaatgacatgaaagtatttcctccttttcaccttgtaaataccgcaaccgagtatcgatttacttccctaacaccaggccgccaatacaaaattcttgtcttgacgattagcggggatgtacagcagtcagccttcattgagggcttcacagttcctagtgctgtcaaaaatattcacatttctcccaatggagcaacagatagcctgacggtgaactggactcctggtgggggagacgttgattcctacacggtgtcggcattcaggcacagtcaaaaggttgactctcagactattcccaagcacgtctttgagcacacgttccacagactggaggccggggagcagtaccagatcatgattgcctcagtcagcgggtccctgaagaatcagataaatgtggttgggcggacagttccagcatctgtccaaggagtaattgcagacaatgcatacagcagttattccttaatagtaagttggcaaaaagctgctggtgtggcagaaagatatgatatcctgcttctaactgaaaatggaatccttctgcgcaacacatcagagccagccaccactaagcaacacaaatttgaagatctaacaccaggcaagaaatacaagatacagatcctaactgtcagtggaggcctctttagcaaggaagcccagactgaaggccgaacagtcccagcagctgtcaccgacctgaggatcacagagaactccaccaggcacctgtccttccgctggaccgcctcagagggggagctcagctggtacaacatctttttgtacaacccagatgggaatctccaggagagagctcaagttgacccactagtccagagcttctctttccagaacttgctacaaggcagaatgtacaagatggtgattgtaactcacagtggggagctgtctaatgagtctttcatatttggtagaacagtcccagcctctgtgagtcatctcagggggtccaatcggaacacgacagacagcctttggttcaactggagtccagcctctggggactttgacttttatgagctgattctctataatcccaatggcacaaagaaggaaaactggaaagacaaggacctgacggagtggcggtttcaaggccttgttcctggaaggaagtacgtgctgtgggtggtaactcacagtggagatctcagcaataaagtcacagcggagagcagaacagctccaagtcctcccagtcttatgtcatttgctgacattgcaaacacatccttggccatcacgtggaaagggcccccagactggacagactacaacgactttgagctgcagtggttgcccagagatgcacttactgtcttcaacccctacaacaacagaaaatcagaaggacgcattgtgtatggtcttcgtccagggagatcctatcaattcaacgtcaagactgtcagtggtgattcctggaaaacttacagcaaaccaatttttggatctgtgaggacaagtatgacatgttttgctactcttatttctcaaatggagtagaggaagtatatgttcaacatcttactcaaatagggcttggattaaatccatatttttacatgggattggtctggatttgaattcaggcagaagtctctgtagatttgttcgttcattcaacattaacaacaagggacaataaatctctctctgccctcatggggcttacaattaggtaggacgtactatttgtaaatagacattatattttgggtgtgatgagggaagtaaatggtactatggagacacttgttaggtaatctgacccaatacaagagaacttcttggaaaaggaaacatccaaatagaaacctaaagcaagagatttaccaggtagaggtaggggaagaagtggagaatattccaggtagagagaataaaatattccaagatgagagaggagggagagtacaagatctaccaataggggaacagaaagaagtttatttggccatagcataaaaggtgaggattaagggaatcagataataaaatattttgtattccatggtaa

SEQ ID NO: 16910 - DNA, 4237 bp, Homo sapiens
  ENST00000548122
agttgctaagtggaaaatggaggctgaattttacatggtgattcttacctgcttgatcttcaggaactcagaagggtttcagattgtccatgtccagaaacaacagtgtcttttcaaaaatgagaaagtggtcgtgggctcatgcaacaggaccatccagaaccagcagtggatgtggactgaggatgaaaagctccttcatgttaaatctgcactgtgcttggccttcatcagaaatgctgcagaaaactacagccaaaacagcagcgagaggcagcatcccaatctgcacatgactggaattacagacacatcatgggttttgtcgactactcagcccttctccagcaccactgaagagactggactggcggagccagagagatgtaacttcaccctggcggagtccaaggcctccagccattctgtgtctatccagtggagaattttgggctcaccctgtaactttagcctcatctatagcagtgacaccctgggggccgcgttgtgccctacctttcggatagacaacaccacatacggatgtaaccttcaagatttacaagcaggaaccatctataacttcaggattatttctctggatgaagagagaacagtggtcttgcaaacagatcctttacctcctgctaggtttggagtcagtaaagagaagacgacttcaaccagcttgcatgtttggtggactccttcttccggaaaagtcacctcatatgaggtgcaattatttgatgaaaataaccaaaagatacagggggttcaaattcaagaaagtacttcatggaatgaatacacttttttcaatctcactgctggtagtaaatacaatattgccatcacagctgtttctggaggaaaacgttctttttcagtttataccaatggatcaacagtgccatctccagtgaaagatattggtatttccacaaaagccaattctctcctgatttcctggtcccatggttctgggaatgtggaacgataccggctgatgctaatggataaagggatcctagttcatggcggtgttgtggacaaacatgctacttcctatgcttttcacgggctgacccctggctacctctacaacctcactgttatgactgaggctgcagggctgcaaaactacaggtggaaactagtcaggacagcccccatggaagtctcaaatctgaaggtgacaaatgatggcagtttgacctctctaaaagtcaaatggcaaagacctcctggaaatgtggattcttacaatatcaccctgtctcacaaagggaccatcaaggaatccagagtattagcaccttggattactgaaactcactttaaagagttagtccccggtcgactttatcaagttactgtcagctgtgtctctggtgaactgtctgctcagaagatggcagtgggcagaacatttccagacaaagttgcaaacctggaggcaaacaataatggcaggatgaggtctcttgtagtgagctggtcgccccctgctggagactgggagcagtatcggatcctactcttcaatgattctgtggtgctgctcaacatcactgtgggaaaggaagaaacacagtatgtcatggatgacacggggctcgtaccgggaagacagtatgaggtggaagtcattgttgagagtggaaatttgaagaattctgagcgttgccaaggcaggacagtccccctggctgtcctccagcttcgtgtcaaacatgccaatgaaacctcactgagtatcatgtggcagacccctgtagcagaatgggagaaatacatcatttccctagctgacagagacctcttactgatccacaagtcactctccaaagatgccaaagaattcacttttactgacctggtgcctggacgaaaatacatggctacagtcaccagtattagtggagacttaaaaaattcctcttcagtaaaaggaagaacagtgcctgcccaagtgactgacttgcatgtggccaaccaaggaatgaccagtagtctgtttactaactggacccaggcacaaggagacgtagaattttaccaagtcttactgatccatgaaaatgtggtcattaaaaatgaaagcatctccagtgagaccagcagatacagcttccactctctcaagtccggcagcctgtactccgtggtggtaacaacagtgagtggagggatctcttcccgacaagtggttgtggagggaagaacagtcccttccagtgtgagtggagtaacggtgaacaattccggtcgtaatgactacctcagcgtttcctggctgctggcgcccggagatgtggataactatgaggtaacattgtctcatgacggcaaggtggttcagtcccttgtcattgccaagtctgtcagagaatgttccttcagctccctcaccccaggccgcctctacaccgtgaccataactacaaggagtggcaagtatgaaaatcactccttcagccaagagcggacagtgcctgacaaagtccagggagtcagtgttagcaactcagccaggagtgactatttaagggtatcctgggtgcatgccactggagactttgatcactatgaagtcaccattaaaaacaaaaacaacttcattcaaactaaaagcattcccaagtcagaaaacgaatgtgtatttgttcagctagtccctggacggttgtacagtgtcactgttactacaaaaagtggacaatatgaagccaatgaacaagggaatgggagaacaattccagagcctgttaaggatctaacattgcgcaacaggagcactgaggacttgcatgtgacttggtcaggagctaatggggatgtcgaccaatatgagatccagctgctcttcaatgacatgaaagtatttcctccttttcaccttgtaaataccgcaaccgagtatcgatttacttccctaacaccaggccgccaatacaaaattcttgtcttgacgattagcggggatgtacagcagtcagccttcattgagggcttcacagttcctagtgctgtcaaaaatattcacatttctcccaatggagcaacagatagcctgacggtgaactggactcctggtgggggagacgttgattcctacacggtgtcggcattcaggcacagtcaaaaggttgactctcagactattcccaagcacgtctttgagcacacgttccacagactggaggccggggagcagtaccagatcatgattgcctcagtcagcgggtccctgaagaatcagataaatgtggttgggcggacagttccagcatctgtccaaggagtaattgcagacaatgcatacagcagttattccttaatagtaagttggcaaaaagctgctggtgtggcagaaagatatgatatcctgcttctaactgaaaatggaatccttctgcgcaacacatcagagccagccaccactaagcaacacaaatttgaagatctaacaccaggcaagaaatacaagatacagatcctaactgtcagtggaggcctctttagcaaggaagcccagactgaaggccgaacagtcccagcagctgtcaccgacctgaggatcacagagaactccaccaggcacctgtccttccgctggaccgcctcagagggggagctcagctggtacaacatctttttgtacaacccagatgggaatctccaggagagagctcaagttgacccactagtccagagcttctctttccagaacttgctacaaggcagaatgtacaagatggtgattgtaactcacagtggggagctgtctaatgagtctttcatatttggtagaacagtcccagcctctgtgagtcatctcagggggtccaatcggaacacgacagacagcctttggttcaactggagtccagcctctggggactttgacttttatgagctgattctctataatcccaatggcacaaagaaggaaaactggaaagacaaggacctgacggagtggcggtttcaaggccttgttcctggaaggaagtacgtgctgtgggtggtaactcacagtggagatctcagcaataaagtcacagcggagagcagaacagctccaagtcctcccagtcttatgtcatttgctgacattgcaaacacatccttggccatcacgtggaaagggcccccagactggacagactacaacgactttgagctgcagtggttgcccagagatgcacttactgtcttcaacccctacaac

SEQ ID NO: 16911 - DNA, 2661 bp, Homo sapiens
  ENST00000538174
aacagttgctaagtggaaaatggaggctgaattttacatggtgattcttacctgcttgatcttcaggaactcagaagggtttcagattgtccatgtccagaaacaacagtgtcttttcaaaaatgagaaagtggtcgtgggctcatgcaacaggaccatccagaaccagcagtggatgtggactgaggatgaaaagctccttcatgttaaatctgcactgtgcttggccatctccaactcttcccgcggcccctcccgctcagccatcttggaccgctgttcccaggcaccccgatggacctgctatgatcaggaaggcttccttgaggtggaaaatgcctctctctttctccagaaacaaggctccagagtagtggtcaagaaggccaggaaatacctccatagctggatgaaaatagatgtcaacaaggagggaaaactggtcaatgaaagcctctgtttacaaaaagctggcctgggagcagaagtttcggtgaggagcactagaaacacggctccaccccagattctcactacctttaatgcagttccagatggcctggtattccttattaggaataccacagaggccttcatcagaaatgctgcagaaaactacagccaaaacagcagcgagaggcagcatcccaatctgcacatgactggaattacagacacatcatgggttttgtcgactactcagcccttctccagcaccactgaagagactggactggcggagccagagagatgtaacttcaccctggcggagtccaaggcctccagccattctgtgtctatccagtggagaattttgggctcaccctgtaactttagcctcatctatagcagtgacaccctgggggccgcgttgtgccctacctttcggatagacaacaccacatacggatgtaaccttcaagatttacaagcaggaaccatctataacttcaggattatttctctggatgaagagagaacagtggtcttgcaaacagatcctttacctcctgctaggtttggagtcagtaaagagaagacgacttcaaccagcttgcatgtttggtggactccttcttccggaaaagtcacctcatatgaggtgcaattatttgatgaaaataaccaaaagatacagggggttcaaattcaagaaagtacttcatggaatgaatacacttttttcaatctcactgctggtagtaaatacaatattgccatcacagctgtttctggaggaaaacgttctttttcagtttataccaatggatcaacagtgccatctccagtgaaagatattggtatttccacaaaagccaattctctcctgatttcctggtcccatggttctgggaatgtggaacgataccggctgatgctaatggataaagggatcctagttcatggcggtgttgtggacaaacatgctacttcctatgcttttcacgggctgacccctggctacctctacaacctcactgttatgactgaggctgcagggctgcaaaactacaggtggaaactagtcaggacagcccccatggaagtctcaaatctgaaggtgacaaatgatggcagtttgacctctctaaaagtcaaatggcaaagacctcctggaaatgtggattcttacaatatcaccctgtctcacaaagggaccatcaaggaatccagagtattagcaccttggattactgaaactcactttaaagagttagtccccggtcgactttatcaagttactgtcagctgtgtctctggtgaactgtctgctcagaagatggcagtgggcagaacatttccagacaaagttgcaaacctggaggcaaacaataatggcaggatgaggtctcttgtagtgagctggtcgccccctgctggagactgggagcagtatcggatcctactcttcaatgattctgtggtgctgctcaacatcactgtgggaaaggaagaaacacagtatgtcatggatgacacggggctcgtaccgggaagacagtatgaggtggaagtcattgttgagagtggaaatttgaagaattctgagcgttgccaaggcaggacagtccccctggctgtcctccagcttcgtgtcaaacatgccaatgaaacctcactgagtatcatgtggcagacccctgtagcagaatgggagaaatacatcatttccctagctgacagagacctcttactgatccacaagtcactctccaaagatgccaaagaattcacttttactgacctggtgcctggacgaaaatacatggctacagtcaccagtattagtggagacttaaaaaattcctcttcagtaaaaggaagaacagtgtaattggaagcaaagtcatcaagatttccctttttagttggacgccgtggctcacatctgtaatcccagcactttgggaggccgagatgggtggatcttgaggccaggaattcaagaccagcctggccaacatggcaagacactgtctctactaaaaacacaaaaattagctgggagtggtggcacatacctgtaatcccagatactcgggaggctgaggcataagaatcacttaaacccaggaggtggaggttgcatgagtcgagatcctgccactgcacactagcctgggtgatagagcgagaacctgcctcaaaaaaaaaaaaaaa

SEQ ID NO: 16912 - DNA, 2373 bp, Homo sapiens
  ENST00000552253
ttttttttttccccaagcgaagcatgaacagttgctaagtggaaaatggaggctgaattttacatggtgattcttacctgcttgatcttcaggaactcagaagggtttcagattgtccatgtccagaaacaacagtgtcttttcaaaaatgagaaagtggtcgtgggctcatgcaacaggaccatccagaaccagcagtggatgtggactgaggatgaaaagctccttcatgttaaatctgcactgtgcttggccatctccaactcttcccgcggcccctcccgctcagccatcttggaccgctgttcccaggcaccccgatggacctgctatgatcaggaaggcttccttgaggtggaaaatgcctctctctttctccagaaacaaggctccagagtagtggtcaagaaggccaggaaatacctccatagctggatgaaaatagatgtcaacaaggagggaaaactggtcaatgaaagcctctgtttacaaaaagctggcctgggagcagaagtttcggtgaggagcactagaaacacggctccaccccagattctcactacctttaatgcagttccagatggcctggtattccttattaggaataccacagaggccttcatcagaaatgctgcagaaaactacagccaaaacagcagcgagaggcagcatcccaatctgcacatgactggaattacagacacatcatgggttttgtcgactactcagcccttctccagcaccactgaagagactggactggcggagccagagagatgtaacttcaccctggcggagtccaaggcctccagccattctgtgtctatccagtggagaattttgggctcaccctgtaactttagcctcatctatagcagtgacaccctgggggccgcgttgtgccctacctttcggatagacaacaccacatacggatgtaaccttcaagatttacaagcaggaaccatctataacttcaggattatttctctggatgaagagagaacagtggtcttgcaaacagatcctttacctcctgctaggtttggagtcagtaaagagaagacgacttcaaccagcttgcatgtttggtggactccttcttccggaaaagtcacctcatatgaggtgcaattatttgatgaaaataaccaaaagatacagggggttcaaattcaagaaagtacttcatggaatgaatacacttttttcaatctcactgctggtagtaaatacaatattgccatcacagctgtttctggaggaaaacgttctttttcagtttataccaatggatcaacagtgccatctccagtgaaagatattggtatttccacaaaagccaattctctcctgatttcctggtcccatggttctgggaatgtggaacgataccggctgatgctaatggataaagggatcctagttcatggcggtgttgtggacaaacatgctacttcctatgcttttcacgggctgacccctggctacctctacaacctcactgttatgactgaggctgcagggctgcaaaactacaggtggaaactagtcaggacagcccccatggaagtctcaaatctgaaggtgacaaatgatggcagtttgacctctctaaaagtcaaatggcaaagacctcctggaaatgtggattcttacaatatcaccctgtctcacaaagggaccatcaaggaatccagagtattagcaccttggattactgaaactcactttaaagagttagtccccggtcgactttatcaagttactgtcagctgtgtctctggtgaactgtctgctcagaagatggcagtgggcagaacatgtgagtcttgggctccagaatgttccttggttgctcaaatcactctctgatccaccttaaaataggacaaaataagtcagcaggaaaactcctttcccaatctgagaagtggagcctatgtaactgaaggtgtctgtagtatggcccattcttctgagtcacttaggcaactgagtttggatttctgaatgatctgcatgttgtttctgtcttatgctttttcatgtcacgtcacttaagtagcataaatgcattagcattgataccagtatataaaacatttctgattcattcttacagtgagaaccagttagcatttaaccatgttttccatacattattttattaatttatgtcctcacttatctatccagtgccttatatatgtaaattactgtactattgttaaaacgactaagacatgctacttgcctttaaggcaggatccagcagactaccccatctggtgccaaatctggtctgtggcctgattttgtttagccctcaagctaagagtggtttttacatgtttaaagggttgtacaaac

SEQ ID NO: 16913 - DNA, 639 bp, Homo sapiens
  ENST00000547715
cttgtggatcacactgagcctgctgcagactggactggcggagccagagagatgtaacttcaccctggcggagtccaaggcctccagccattctgtgtctatccagtggagaattttgggctcaccctgtaactttagcctcatctatagcagtgacaccctgggggccgcgttgtgccctacctttcggatagacaacaccacatacggatgtaaccttcaagatttacaagcaggaaccatctataacttcaggattatttctctggatgaagagagaacagtggtcttgcaaacaggtaaaggatgacaggtgcaattggatggccaagccacacggggttgggccctgccttttcaagctggtgtttcatttgagttccagggatacaaaaaatgaaggtaaaaatacctgtgaagataaatattgacagaaatgtctggtttcctcggatctagccagaagcagcttggtggactttcagagactcccttagtgctgaaaacagccaactagctactgaaagggtcggggtggggtgcagggcggtcagcaaagagaaactttgggctgcggtgggaattttttaaagtgatgtggtttacgcttccattgcattaaattgtcaaaccctggaa

SEQ ID NO: 16914 - DNA, 5331 bp, Homo sapiens
  ENST00000254667
agccggagctggagccgaggcggcggcgggacgcggccggccggacaaatttcctgctaggctgcggacagcgggcggcaggagccggcgcgagcggcttcaggaacccacggcctctgcgcgtccccgcgacccttcttcgcgcccggcgaagacagccgggcgccccggagggcggcgggcaggcgcccgggagatgcggagcctccgctgcagcgcgatctgcgcgaccagaccggcccccccgagactatagccttcactttccctcggtccaccatggagcccttgtgtccactcctgctggtgggttttagcttgccgctcgccagggctctcaggggcaacgagaccactgccgacagcaacgagacaaccacgacctcaggccctccggacccgggcgcctcccagccgctgctggcctggctgctactgccgctgctgctcctcctcctcgtgctccttctcgccgcctacttcttcaggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaactcattgccatctggacacatacaaggaacttttgaactggcaaataaagaagaaaacagagaaaaaaacagatatcccaacatccttcccaatgaccattctagggtgattctgagccaactggatggaattccctgttcagactacatcaatgcttcctacatagatggttacaaagagaagaataaattcatagcagctcaaggtcccaaacaggaaacggttaacgacttctggagaatggtctgggagcaaaagtctgcgaccatcgtcatgttaacaaacttgaaagaaaggaaagaggaaaagtgccatcagtactggcccgaccaaggctgctggacctatggaaacatccgggtgtgcgtggaggactgcgtggttttggtcgactacaccatccggaagttctgcatacagccacagctccccgacggctgcaaagcccccaggctggtctcacagctgcacttcaccagctggcccgacttcggagtgccttttacccccattgggatgctgaagttcctcaagaaagtaaagacgctcaaccccgtgcacgctgggcccatcgtggtccactgtagcgcgggcgtgggccggacgggcaccttcattgtgatcgatgccatgatggccatgatgcacgcggagcagaaggtggatgtgtttgaatttgtgtctcgaatccgtaatcagcgccctcagatggttcaaacggatatgcagtacacgttcatctaccaagccttactcgagtactacctctacggggacacagagctggacgtgtcctccctggagaagcacctgcagaccatgcacggcaccaccacccacttcgacaagatcgggctggaggaggagttcaggaaattgacaaatgtccggatcatgaaggagaacatgaggacgggcaacttgccggcaaacatgaagaaggccagggtcatccagatcatcccgtatgacttcaaccgagtgatcctttccatgaaaaggggtcaagaatacacagactacatcaacgcatccttcatagacggctaccgacagaaggactatttcatcgccacccaggggccactggcacacacggttgaggacttctggaggatgatctgggaatggaaatcccacactatcgtgatgctgacggaggtgcaggagagagagcaggataaatgctaccagtattggccaaccgagggctcagttactcatggagaaataacgattgagataaagaatgataccctttcagaagccatcagtatacgagactttctggtcactctcaatcagccccaggcccgccaggaggagcaggtccgagtagtgcgccagtttcacttccacggctggcctgagatcgggattcccgccgagggcaaaggcatgattgacctcatcgcagccgtgcagaagcagcagcagcagacaggcaaccaccccatcaccgtgcactgcagtgccggagctgggcgaacaggtacattcatagccctcagcaacattttggagcgagtaaaagccgagggacttttagatgtatttcaagctgtgaagagtttacgacttcagagaccacatatggtgcaaaccctggaacagtatgaattctgctacaaagtggtacaagattttattgatatattttctgattatgctaatttcaaatgaagattcctgccttaaaatattttttaatttaatggtcagtatattttgtaaaaatcatgttaatttatttcatagttgacattaatatcttccctaatttctttgtatatattttgttatgccttaaaggccacctgctatacagttgttaaatcttaaatatgctttttaaaaattggaataatgtattaaggtcaaataatatcccataaaatatatatttctgctaatattagtaaatatcttaatttttcattagattcatatcatttaatttcacatattcaacacctttaaatgttgtaatcttaatatgcgaagtgtgcctctgcaagatactaacacaaagctcatgttaagaaaacagttgaggactcagaagtcagttcgaaaatgcactttcctaacagtgaattcacaaccctgaacagcagcatttttggaaggcaaactgttcgtgatggtacaatgtaaatggggacttctgtaaagttctcagtttcggtccatgtggtttatctttacattttaaagatcaaagaagtctttacaacctgaatccaggtctaaaacacactagagtagctggtgactataaataatattttaaaatgctgtgtctacaccatcaagactgtgtctacactatcttggctgaacgagaagagatgtaaatgctgggtggtcccgttgacccacggcgttgggtacaacaaaaccagccatcggagttacaccccaaagcaccatttgctgtccagctgcctgtcgtttggcccagaccaccctcagaaaaaaaccagctgcctctcccattctcccctcccgttctgccacagcggcctgggctggtccagtgctatgcctggaggctcaacacaaaacttcccatccaaacattcagatgaactgagcgtcttacacacgcagtacagaggagcacacattaggatagaaacagtagaataaccacgggcaattaaactttaaattttctgagcagcattttggtatttaaacatttcttgtaaaaagctgagacagtttgtaagaaaagaatccttaaaatctagatttataccattttttaaagtcccacctttcaatgtttaataaaacaaaaagagaaatccttaatctaaaagctaaattatttttgaatggaaatactactgagaccattgacactggataacagtaatgatcccattaccagataagattgactgacggggaaaaaaaaaaaaaaagaatggggtgtgaatgtaccaacactgaatcttacagcagttatctttctatggccattaggtacctagcagatgtgcacaatataaacaaaaagatatctggcctaccttactactaaaagcatttaacacgtgcatttttggtacttttttttttgttttctaaaagctacataaaggccttatttgacattttcactgataactgatcgcaccctcatgttgcagtgttcgtcccctattcattaacagtgtgtgcaaatgcaaccccaggacacattattgttctgatagatgctcacagggaatcaagcttctcgcccactccacggctctgagccccatccaagggcaagacttggtgcccagctggaaggacgaaagcacactttgtgaccgccatcctcaccagctgcatgcctgggctgcacactgctgaacgtgctcctctctccttctctgtacaatgattcagcatctcggcggaagaggaaaatggagctttttgaggctcgccaggtcccttttgttttcaccattaaaattccaaacccaaagcctttgtttgactgaaggagaagagagggaagtaagcttctgttcagcacctgaaccctagaaaaagagccagtttgctacgatgaaggtgacatttctctggtcatttatttgagagttcgaagtcaaagtcgaggggcaccggctttggttcatgtctaggagccctctgtcagaatccttgaagccctttaatggtctaactggcatctcttgtatcaagaagtacctttaaggtagaccttttcagggtgccctcaggaaagggccctgctcatgtttttttcctgtccccttagaccaaccccaggtgtccactgcaggggttctgcctgttcccaaactttttccattccaggaacaaaggagaagccactttccccaggacgcaagactctcccctccactgtccgggacagcgttcgccctttagcggggaggtcattacagcctcatggcctctaccaaggccccagatcacaggatctcctgggccttggagcacctcacgctgggggaatcaatccctgagggactcagaatcttctccgtgcaacctggaaagttcatctcttgtttccttcagtcaaagaaagtccattgtacataacaaaacagcccccaaacagcccagtgccgacaccattgttcctttcacactttcctttgttgcatgcagttgggttcaaatgccaaatagtgattagaagacgaccattctgatctgtgtgtgatctggtcactatgtgactgcctttacggtttctctccatgtgctatatgaatgaagaatgcataccagtgttttaaaaggtatttttatgtgtttttaaacacttttttaaatgagcctgacacctgtgtttcagcatttggagacatccccatgttattcttttaagtgtataattactgatacttttttgtttgtttgtttaactaagttgtgtttaacttatgtgcagtctttataatgtatgtatgttattacagtttcaactatcatattttctttgattacatttataatttgatcttgctctgattataatgccagtgaatgttgctgaactctttgtatatgcaaattgcaagatttaaaccattctgatgcaaggataaacctttactttgactacca

SEQ ID NO: 16915 - DNA, 779 bp, Homo sapiens
  ENST00000442830
gagcggcttcaggaacccacggcctctgcgcgtccccgcgacccttcttcgcgcccggcgaagacagccgggcgccccggagggcggcgggcaggcgcccgggagatgcggagcctccgctgcagcgcgatctgcgcgaccagaccggcccccccgagtaagcgcttgcagccagttgtctagttgtcagaagccgagctcatcagcgggctcctggtgtcggcgttctgctgctggaaggtcagggagttccctggaccccacggaagaagctgtctccatgaaggacagggaccgtgccgtgaaccttttattctcccactgacatgactatagccttcactttccctcggtccaccatggagcccttgtgtccactcctgctggtgggttttagcttgccgctcgccagggctctcaggggcaacgagaccactgccgacagcaacgagacaaccacgacctcaggccctccggacccgggcgcctcccagccgctgctggcctggctgctactgccgctgctgctcctcctcctcgtgctccttctcgccgcctacttcttcaggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaac

SEQ ID NO: 16916 - DNA, 522 bp, Homo sapiens
  ENST00000471218
ggattctccaaggccaggatggtttcccagcgtcttcccaggaagacaagaggtccaccatggagcccttgtgtccactcctgctggtgggttttagcttgccgctcgccagggctctcaggggcaacgagaccactgccgacagcaacgagacaaccacgacctcaggccctccggacccgggcgcctcccagccgctgctggcctggctgctactgccgctgctgctcctcctcctcgtgctccttctcgccgcctacttcttcaggttcaggaagcagaggaaagctgtggtcagcaccagcgacaagaagatgcccaacggaatcttggaggagcaagcaaagggtgatgctgctcagcaggtcaccctcagggcccaagaagtattttcccatccccgtggagcacctggaggaggagatccgtatcagatccgccgacgactgcaagcagtttcgggaggagttcaactcattgccatctggacacatacaaggaacttttgaactggcaaataaa

SEQ ID NO: 16917 - DNA, 2304 bp, Homo sapiens
  ENST00000455661
atctcaaatcctgttgcagtcagtagcgctggctgtctgcagtagagatggttttcaatgattgtttcagaaattccttatcaacagaaaatgaacgagacggggagttttcagaaaataaatggatttgcagacaacttaacgtcatcatcgaagtcaccaaagaaagcaaagcagcgactggggaagctgaggctgaagtagcaagggcatgccacccaggctgctattccagtcgctgtgaaagcctggtcactgtctttgccacgcagaacacatctctgggaatgctgtcgatctatgcctccatcttttaaaggctttccatttctgtctggattttttctttatgggaggcagaaataatagtgaattgaatgaaatggagtatataagtgtctagcacagtccttggcacatagaaagtgctctgtaaacagtacttcgcatcaaattcttgggatgaatgaaagtgagtgcctggcgctgcacataagaaaagacgtggcagcaaaccatcctcccgacatgacgtgctgcgttggtgcgtttacgtccctgttccttctgaaagactcaaaattgtgttggagctactggtgcacctttgtaagacctgcactaacgaccgcgccactgggaagggcacttctttatgaagtcgccgtattcccagggagactggtcaacccatacaatgtgaaaaaaaaagaagctatgtgaaaaaatattcccctttgtcatagagaaggagaacttggtgaggctgggcagctgcaggagcctcagtttttcagataacagaacagagtagaccttgagggtccatttccctttttgttttaggaagtgctgtagaagggggcaaagagatctttgatatgagaaggtatttcttcaaagcagcatcgtgcctgaaatagcattgttctttacgctgagagaggaggaaatgggaatttggtgttcaacgggtttaaagtttcagttacaagaaatggacaagtccgagagctctgctgtgccacatcatgcctaaagtcaccgagactgtgttgtacacttttttgttaaaaggtaaatctcatgttaaatgttgttactacaattaaaaagaagccctaggctgtgtttgcagaaaggcactaaccatacatgtgctcaagagcccttttgtgttttcttcacttcatgttgtagttcaatttagttttgctttgcaaggatcctcggaaagtgtatcatcagcaatgacttttattttagaactaaatgtgaaccacggggggaatcatgatcgacattgctcgttgtcctttcttcctccctgtgggctgtgaatccaactcgtcctgggagcagggcgctctcgccttctgttcctctccgagctcagtgcacagaagcattctgcttacccagctgggactgctgactgcaccatcgagcacgcaggttgcactgttctcagcagctacactggattatatgccgcctttcttactgactgattatgaacttaaaacaaattcactctgctgctgtgaattatacatttatttttaagcatttatttcaactcgagatgagcggtctctcctgtaaatttctccctgctggatctttgctctggtttctggtgacatagtgtgagtgccggcagccgcgagcctcagaaggaaaattacaaagggaatactcagtaaatgatgtattgcctttcgcatcagtagcctgcttggaaatgttcaaattatcagcccaggagactccagtgctgtggacatgggtctgaacgaattgatcacctaggggctactgagaacgcggtgctctgtccaccatggagcccttgtgtccactcctgctggtgggttttagcttgccgctcgccagggctctcaggggcaacgagaccactgccgacagcaacgagacaaccacgacctcaggccctccggacccgggcgcctcccagccgctgctggcctggctgctactgccgctgctgctcctcctcctcgtgctccttctcgccgcctacttcttcaggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaactcattgccatctggacacatacaaggaacttttgaactggc

SEQ ID NO: 16918 - DNA, 338 bp, Homo sapiens
  ENST00000467366
cgcctcccagccgctgctggcctggctgctactgccgctgctgctcctcctcctcgtgctccttctcgccgcctacttcttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaactcattgccatctggacacatacaaggaacttttgaactggcaaataaag

SEQ ID NO: 16919 - DNA, 4957 bp, Homo sapiens
  ENST00000306042
gtgcagcagagggcagctgagaggctgggtggctgggcctgggagacacacagaggccaggccttagcgcggctcagccatgagcaacaggagtagcttttcccggctcacctggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaactcattgccatctggacacatacaaggaacttttgaactggcaaataaagaagaaaacagagaaaaaaacagatatcccaacatccttcccaatgaccattctagggtgattctgagccaactggatggaattccctgttcagactacatcaatgcttcctacatagatggttacaaagagaagaataaattcatagcagctcaaggtcccaaacaggaaacggttaacgacttctggagaatggtctgggagcaaaagtctgcgaccatcgtcatgttaacaaacttgaaagaaaggaaagaggaaaagtgccatcagtactggcccgaccaaggctgctggacctatggaaacatccgggtgtgcgtggaggactgcgtggttttggtcgactacaccatccggaagttctgcatacagccacagctccccgacggctgcaaagcccccaggctggtctcacagctgcacttcaccagctggcccgacttcggagtgccttttacccccattgggatgctgaagttcctcaagaaagtaaagacgctcaaccccgtgcacgctgggcccatcgtggtccactgtagcgcgggcgtgggccggacgggcaccttcattgtgatcgatgccatgatggccatgatgcacgcggagcagaaggtggatgtgtttgaatttgtgtctcgaatccgtaatcagcgccctcagatggttcaaacggatatgcagtacacgttcatctaccaagccttactcgagtactacctctacggggacacagagctggacgtgtcctccctggagaagcacctgcagaccatgcacggcaccaccacccacttcgacaagatcgggctggaggaggagttcaggaaattgacaaatgtccggatcatgaaggagaacatgaggacgggcaacttgccggcaaacatgaagaaggccagggtcatccagatcatcccgtatgacttcaaccgagtgatcctttccatgaaaaggggtcaagaatacacagactacatcaacgcatccttcatagacggctaccgacagaaggactatttcatcgccacccaggggccactggcacacacggttgaggacttctggaggatgatctgggaatggaaatcccacactatcgtgatgctgacggaggtgcaggagagagagcaggataaatgctaccagtattggccaaccgagggctcagttactcatggagaaataacgattgagataaagaatgataccctttcagaagccatcagtatacgagactttctggtcactctcaatcagccccaggcccgccaggaggagcaggtccgagtagtgcgccagtttcacttccacggctggcctgagatcgggattcccgccgagggcaaaggcatgattgacctcatcgcagccgtgcagaagcagcagcagcagacaggcaaccaccccatcaccgtgcactgcagtgccggagctgggcgaacaggtacattcatagccctcagcaacattttggagcgagtaaaagccgagggacttttagatgtatttcaagctgtgaagagtttacgacttcagagaccacatatggtgcaaaccctggaacagtatgaattctgctacaaagtggtacaagattttattgatatattttctgattatgctaatttcaaatgaagattcctgccttaaaatattttttaatttaatggtcagtatattttgtaaaaatcatgttaatttatttcatagttgacattaatatcttccctaatttctttgtatatattttgttatgccttaaaggccacctgctatacagttgttaaatcttaaatatgctttttaaaaattggaataatgtattaaggtcaaataatatcccataaaatatatatttctgctaatattagtaaatatcttaatttttcattagattcatatcatttaatttcacatattcaacacctttaaatgttgtaatcttaatatgcgaagtgtgcctctgcaagatactaacacaaagctcatgttaagaaaacagttgaggactcagaagtcagttcgaaaatgcactttcctaacagtgaattcacaaccctgaacagcagcatttttggaaggcaaactgttcgtgatggtacaatgtaaatggggacttctgtaaagttctcagtttcggtccatgtggtttatctttacattttaaagatcaaagaagtctttacaacctgaatccaggtctaaaacacactagagtagctggtgactataaataatattttaaaatgctgtgtctacaccatcaagactgtgtctacactatcttggctgaacgagaagagatgtaaatgctgggtggtcccgttgacccacggcgttgggtacaacaaaaccagccatcggagttacaccccaaagcaccatttgctgtccagctgcctgtcgtttggcccagaccaccctcagaaaaaaaccagctgcctctcccattctcccctcccgttctgccacagcggcctgggctggtccagtgctatgcctggaggctcaacacaaaacttcccatccaaacattcagatgaactgagcgtcttacacacgcagtacagaggagcacacattaggatagaaacagtagaataaccacgggcaattaaactttaaattttctgagcagcattttggtatttaaacatttcttgtaaaaagctgagacagtttgtaagaaaagaatccttaaaatctagatttataccattttttaaagtcccacctttcaatgtttaataaaacaaaaagagaaatccttaatctaaaagctaaattatttttgaatggaaatactactgagaccattgacactggataacagtaatgatcccattaccagataagattgactgacggggaaaaaaaaaaaaaaagaatggggtgtgaatgtaccaacactgaatcttacagcagttatctttctatggccattaggtacctagcagatgtgcacaatataaacaaaaagatatctggcctaccttactactaaaagcatttaacacgtgcatttttggtacttttttttttgttttctaaaagctacataaaggccttatttgacattttcactgataactgatcgcaccctcatgttgcagtgttcgtcccctattcattaacagtgtgtgcaaatgcaaccccaggacacattattgttctgatagatgctcacagggaatcaagcttctcgcccactccacggctctgagccccatccaagggcaagacttggtgcccagctggaaggacgaaagcacactttgtgaccgccatcctcaccagctgcatgcctgggctgcacactgctgaacgtgctcctctctccttctctgtacaatgattcagcatctcggcggaagaggaaaatggagctttttgaggctcgccaggtcccttttgttttcaccattaaaattccaaacccaaagcctttgtttgactgaaggagaagagagggaagtaagcttctgttcagcacctgaaccctagaaaaagagccagtttgctacgatgaaggtgacatttctctggtcatttatttgagagttcgaagtcaaagtcgaggggcaccggctttggttcatgtctaggagccctctgtcagaatccttgaagccctttaatggtctaactggcatctcttgtatcaagaagtacctttaaggtagaccttttcagggtgccctcaggaaagggccctgctcatgtttttttcctgtccccttagaccaaccccaggtgtccactgcaggggttctgcctgttcccaaactttttccattccaggaacaaaggagaagccactttccccaggacgcaagactctcccctccactgtccgggacagcgttcgccctttagcggggaggtcattacagcctcatggcctctaccaaggccccagatcacaggatctcctgggccttggagcacctcacgctgggggaatcaatccctgagggactcagaatcttctccgtgcaacctggaaagttcatctcttgtttccttcagtcaaagaaagtccattgtacataacaaaacagcccccaaacagcccagtgccgacaccattgttcctttcacactttcctttgttgcatgcagttgggttcaaatgccaaatagtgattagaagacgaccattctgatctgtgtgtgatctggtcactatgtgactgcctttacggtttctctccatgtgctatatgaatgaagaatgcataccagtgttttaaaaggtatttttatgtgtttttaaacacttttttaaatgagcctgacacctgtgtttcagcatttggagacatccccatgttattcttttaagtgtataattactgatacttttttgtttgtttgtttaactaagttgtgtttaacttatgtgcagtctttataatgtatgtatgttattacagtttcaactatcatattttctttgattacatttataatttgatcttgctctgattataatgccagtgaatgttgctgaactctttgtatatgcaaattgcaagatttaaaccattctgatgcaaggataaacctttactttgactacca

SEQ ID NO: 16920 - DNA, 325 bp, Homo sapiens
  ENST00000487428
acagaggccaggccttagcgcggctcagccatgagcaacaggagtagcttttcccggctcacctggtgggtatcactgtgccgagcgctgttggctctcggggaacctagaagtgtggaaacctaacgcatcctgtgtctctaaggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccga

SEQ ID NO: 16921 - DNA, 987 bp, Homo sapiens
  ENST00000495530
ggccttagcgcggctcagccatgagcaacaggagtagcttttcccggctcacctggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaactcattgccatctggacacatacaaggaacttttgaactggcaaataaagaagaaaacagagaaaaaaacagatatcccaacatccttcccaggttacaaagagaagaataaattcatagcagctcaaggtcccaaacaggaaacggttaacgacttctggagaatggtctgggagcaaaagtctgcgaccatcgtcatgttaacaaacttgaaagaaaggaaagaggaaaagtgccatcagtactggcccgaccaaggctgctggacctatggaaacatccgggtgtgcgtggaggactgcgtggttttggtcgactacaccatccggaagttctgcatacagccacagctccccgacggctgcaaagcccccaggctggtctcacagctgcacttcaccagctggcccgacttcggagtgccttttacccccattgggatgctgaagttcctcaagaaagtaaagacgctcaaccccgtgcacgctgggcccatcgtggtccactgtagcgcgggcgtgggccggacgggcaccttcattgtgatcgatgccatgatggccatgatgcacgcggagcagaaggtggatgtgtttgaatttgtgtctcgaatccgtaatcagcgccctcagatggttcaaacggatatgcagtacacgttcatctaccaagccttactcgagtactacctctacggggacacagagctggacgtgtcctcc

SEQ ID NO: 16922 - DNA, 5736 bp, Homo sapiens
  ENST00000479896
ccttagcgcggctcagccatgagcaacaggagtagcttttcccggctcacctggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaactcattgccatctggacacatacaaggaacttttgaactggcaaataaagaagaaaacagagaaaaaaacagatatcccaacatccttcccaatgaccattctagggtgattctgagccaactggatggaattccctgttcagactacatcaatgcttcctacatagatggttacaaagagaagaataaattcatagcagctcaaggtcccaaacaggaaacggttaacgacttctggagaatggtctgggagcaaaagtctgcgaccatcgtcatgttaacaaacttgaaagaaaggaaagaggaaaagtgccatcagtactggcccgaccaaggctgctggacctatggaaacatccgggtgtgcgtggaggactgcgtggttttggtcgactacaccatccggaagttctgcatacagccacagctccccgacggctgcaaagcccccaggctggtctcacagctgcacttcaccagctggcccgacttcggagtgccttttacccccattgggatgctgaagttcctcaagaaagtaaagacgctcaaccccgtgcacgctgggcccatcgtggtccactgtagcgcgggcgtgggccggacgggcaccttcattgtgatcgatgccatgatggccatgatgcacgcggagcagaaggtggatgtgtttgaatttgtgtctcgaatccgtaatcagcgccctcagatggttcaaacggatatgcagtacacgttcatctaccaagccttactcgagtactacctctacggggacacagagctggacgtgtcctccctggagaagcacctgcagaccatgcacggcaccaccacccacttcgacaagatcgggctggaggaggagttcaggaaattgacaaatgtccggatcatgaaggagaacatgaggacgggcaacttgccggcaaacatgaagaaggccagggtcatccagatcatcccgtgtaaggcacccgtggcgtggcttgggcagggctggggcggggctggtgccggaggctttcatcctggagaagccattgaccgcttacccctgtgcaccagggtcaaaagcagggtgtcctctggcctcaggctaagggctcctgtgtgctgtaccaaatgtcaggtagaaaagacacctgtgaagcaccagctgacccagacagtcctgcatgggtctcaggcaagctgcttcggatatgagcttgcagatgcgggagggcagccgaggctgatttcaggggagggcttcacagaagctggagatttgcggcaggcacgacttgggattccttgtctcattccttgtctccccaagcctgggcagaggcccgcctcccccttacacagaggggcctgagccacccagccgaggccatgcaggtgaactcagctgagaccacctaggaaaaggctgtggccttgaggaggacaagaaatgggcctagggtagagtcaggacactggtctgccacccaggtcatgggagagggaaggaggacctggcaggtgtgggaggagtggaggcaaagctggcaagaagacagggccacatgcagtgggcaggggagtgggaatcgggaggctcaccaagtgggaaaaagagaaacttgagaaacccggccccaaagcagactccacagggatccgaggaactagggagggaggtgggagatgccccgcttgggaggagggtgtgcctcgttatagacttgtcctcgacagagtcacagctcaacaaacaccatctggaaacagctgggagcaggcctgctgcagcagggtctccccgagcactgcagatgacttcaaccgagtgatcctttccatgaaaaggggtcaagaatacacagactacatcaacgcatccttcatagacggctaccgacagaaggactatttcatcgccacccaggggccactggcacacacggttgaggacttctggaggatgatctgggaatggaaatcccacactatcgtgatgctgacggaggtgcaggagagagagcaggataaatgctaccagtattggccaaccgagggctcagttactcatggagaaataacgattgagataaagaatgataccctttcagaagccatcagtatacgagactttctggtcactctcaatcagccccaggcccgccaggaggagcaggtccgagtagtgcgccagtttcacttccacggctggcctgagatcgggattcccgccgagggcaaaggcatgattgacctcatcgcagccgtgcagaagcagcagcagcagacaggcaaccaccccatcaccgtgcactgcagtgccggagctgggcgaacaggtacattcatagccctcagcaacattttggagcgagtaaaagccgagggacttttagatgtatttcaagctgtgaagagtttacgacttcagagaccacatatggtgcaaaccctggaacagtatgaattctgctacaaagtggtacaagattttattgatatattttctgattatgctaatttcaaatgaagattcctgccttaaaatattttttaatttaatggtcagtatattttgtaaaaatcatgttaatttatttcatagttgacattaatatcttccctaatttctttgtatatattttgttatgccttaaaggccacctgctatacagttgttaaatcttaaatatgctttttaaaaattggaataatgtattaaggtcaaataatatcccataaaatatatatttctgctaatattagtaaatatcttaatttttcattagattcatatcatttaatttcacatattcaacacctttaaatgttgtaatcttaatatgcgaagtgtgcctctgcaagatactaacacaaagctcatgttaagaaaacagttgaggactcagaagtcagttcgaaaatgcactttcctaacagtgaattcacaaccctgaacagcagcatttttggaaggcaaactgttcgtgatggtacaatgtaaatggggacttctgtaaagttctcagtttcggtccatgtggtttatctttacattttaaagatcaaagaagtctttacaacctgaatccaggtctaaaacacactagagtagctggtgactataaataatattttaaaatgctgtgtctacaccatcaagactgtgtctacactatcttggctgaacgagaagagatgtaaatgctgggtggtcccgttgacccacggcgttgggtacaacaaaaccagccatcggagttacaccccaaagcaccatttgctgtccagctgcctgtcgtttggcccagaccaccctcagaaaaaaaccagctgcctctcccattctcccctcccgttctgccacagcggcctgggctggtccagtgctatgcctggaggctcaacacaaaacttcccatccaaacattcagatgaactgagcgtcttacacacgcagtacagaggagcacacattaggatagaaacagtagaataaccacgggcaattaaactttaaattttctgagcagcattttggtatttaaacatttcttgtaaaaagctgagacagtttgtaagaaaagaatccttaaaatctagatttataccattttttaaagtcccacctttcaatgtttaataaaacaaaaagagaaatccttaatctaaaagctaaattatttttgaatggaaatactactgagaccattgacactggataacagtaatgatcccattaccagataagattgactgacggggaaaaaaaaaaaaaaagaatggggtgtgaatgtaccaacactgaatcttacagcagttatctttctatggccattaggtacctagcagatgtgcacaatataaacaaaaagatatctggcctaccttactactaaaagcatttaacacgtgcatttttggtacttttttttttgttttctaaaagctacataaaggccttatttgacattttcactgataactgatcgcaccctcatgttgcagtgttcgtcccctattcattaacagtgtgtgcaaatgcaaccccaggacacattattgttctgatagatgctcacagggaatcaagcttctcgcccactccacggctctgagccccatccaagggcaagacttggtgcccagctggaaggacgaaagcacactttgtgaccgccatcctcaccagctgcatgcctgggctgcacactgctgaacgtgctcctctctccttctctgtacaatgattcagcatctcggcggaagaggaaaatggagctttttgaggctcgccaggtcccttttgttttcaccattaaaattccaaacccaaagcctttgtttgactgaaggagaagagagggaagtaagcttctgttcagcacctgaaccctagaaaaagagccagtttgctacgatgaaggtgacatttctctggtcatttatttgagagttcgaagtcaaagtcgaggggcaccggctttggttcatgtctaggagccctctgtcagaatccttgaagccctttaatggtctaactggcatctcttgtatcaagaagtacctttaaggtagaccttttcagggtgccctcaggaaagggccctgctcatgtttttttcctgtccccttagaccaaccccaggtgtccactgcaggggttctgcctgttcccaaactttttccattccaggaacaaaggagaagccactttccccaggacgcaagactctcccctccactgtccgggacagcgttcgccctttagcggggaggtcattacagcctcatggcctctaccaaggccccagatcacaggatctcctgggccttggagcacctcacgctgggggaatcaatccctgagggactcagaatcttctccgtgcaacctggaaagttcatctcttgtttccttcagtcaaagaaagtccattgtacataacaaaacagcccccaaacagcccagtgccgacaccattgttcctttcacactttcctttgttgcatgcagttgggttcaaatgccaaatagtgattagaagacgaccattctgatctgtgtgtgatctggtcactatgtgactgcctttacggtttctctccatgtgctatatgaatgaagaatgcataccagtgttttaaaaggtatttttatgtgtttttaaacacttttttaaatgagcctgacacctgtgtttcagcatttggagacatccccatgttattcttttaagtgtataattactgatacttttttgtttgtttgtttaactaagttgtgtttaacttatgtgcagtctttataatgtatgtatgttattacagtttcaactatcatattttctttgattacatttataatttgatcttgctctgattataatgccagtgaatgttgctgaactctttgtatatgcaaattgcaagatttaaaccattctgatgcaaggataaacctttactttgactacca

SEQ ID NO: 16923 - DNA, 866 bp, Homo sapiens
  ENST00000492479
cctaccggttccggaacgcttcagggcatgacgtgtgtgtccccaacaagcctgagaagggagtgaacagctgtccaggggccaacggccagggtgccggggctgggaccccaaagggacttcccttcatgccttttgacttcgaaattgtcctctacacacaggtcccaaacaggaaacggttaacgacttctggagaatggtctgggagcaaaagtctgcgaccatcgtcatgttaacaaacttgaaagaaaggaaagaggaaaagtgccatcagtactggcccgaccaaggctgctggacctatggaaacatccgggtgtgcgtggaggactgcgtggttttggtcgactacaccatccggaagttctgcatacagccacagctccccgacggctgcaaagcccccaggctggtctcacagctgcacttcaccagctggcccgacttcggagtgccttttacccccattgggatgctgaagttcctcaagaaagtaaagacgctcaaccccgtgcacgctgggcccatcgtggtccactgtagcgcgggcgtgggccggacgggcaccttcattgtgatcgatgccatgatggccatgatgcacgcggagcagaaggtggatgtgtttgaatttgtgtctcgaatccgtaatcagcgccctcagatggttcaaacggatatgcagtacacgttcatctaccaagccttactcgagtactacctctacggggacacagagctggacgtgtcctccctggagaagcacctgcagaccatgcacggcaccaccacccacttcgacaagatcgggctggaggaggagttcaggaaattgacaaatgtccggatcatgaaggagaaca

SEQ ID NO: 16924 - DNA, 3944 bp, Homo sapiens
  ENST00000463727
gggcagaggtttgggcagggctgatgtgaacacaaatgtcagtgactgagccaggccccaagaaccctacaggagaatgttcagagagccccctcttcatcccagtcgataaaacccaccaaagccaggaggctccggttgatggtgggaatggagttctgggcaggtctgcttggccgccctcacctctccccgggaatcccaagtcacctctgggaaccaagatggaaatgagagaaagccccctggtttctacaggaagccccccaacaacacacaagtcgttatggaagagcacaccatgctcagatgggcccccacagcagagtcttccagaacacgctgtcctggagaccagggtccgaggaccaggctgcccctcgccagctgccacttcagcctcggtttcctcacctgtgatgggaaggacagcctcggcggagcctgtgactggcatctgggtgggctttgcacaacatgaagaattactcaaatgtacagccaaggccaccccacaaccccctgtccacagagagccccacttgttcctggcagtgattggcctcaccagggtatcactttgattagatactaagtttccatctgttacagacaggttcattctgagtatcacagcactgccagggacaaaagccacctgcacgcagtgatgcaggcgctctgcacctgtcatgcaggtgttcacgagaagccgtccaggaacccccgaagaacgggctttccccaagtctgagcaacactcgcttgctggggccaagcagaggctggaccccaccccacccaccctccagtgtagctcatactgggaagaatttgcagggtcagataacagtaatctgacagatgccacctcacttaatgccccgagtcagatgacttggtttgcccagtttgacagagagggaggctggataccagagctgttgcatagttgatctgaggtccctctgctcccagggggacagatctaggatgccaatcacacatataagaagaagacactgtttggtaagtgagaaaaattctccacacagcctaatccgaggcttactgcaccagctgttaatgtgcctcttagtagagtgtcggtggctatcagaggaccggcctgagatcactttactgagaccacagctccctctggtggctgcactgtagctttgctcctaattaaccaaaaaaacaaaaagttgcatccagtgacctgggtgcgcaggccccttcggggcctttcatttacttcgggaggagtgtgactcacgacgcagcatctttctctttccccaaagcgcgggcgtgggccggacgggcaccttcattgtgatcgatgccatgatggccatgatgcacgcggagcagaaggtggatgtgtttgaatttgtgtctcgaatccgtaatcagcgccctcagatggttcaaacggatgtgagtcatgccttcctcttgccctgatctagcttcccaaagcaaacccgatgccttcgccacacaggtgtgcagggccctggctctgatgggcacgtggcaaccagcctgggcctggcctggcttcgctccccatagccttccctgcccacgcgtgggacctcagggactccctcgtcctcatctttccctcgtatcctcatgtgagatggggcaatcctactcccccaaacggtgcatgtacacagtgcgtggcgtgctcaccaatgtgaggctctgctgctaccgttctccttactcaagggcataaatggtcgttatccgtggccggtactctgactcttgcctcacacctccttgtgttggcaaaaagagaaaaagaagaaagccgccctctttggtctgccaagctccacgtgggccaagactgcagggcagagttgagggtgtgggcacccctggcctctctgcagatgcagtacacgttcatctaccaagccttactcgagtactacctctacggggacacagagctggacgtgtcctccctggagaagcacctgcagaccatgcacggcaccaccacccacttcgacaagatcgggctggaggaggagttcaggaaattgacaaatgtccggatcatgaaggagaacatgaggacgggcaacttgccggcaaacatgaagaaggccagggtcatccagatcatcccgtgtaaggcacccgtggcgtggcttgggcagggctggggcggggctggtgccggaggctttcatcctggagaagccattgaccgcttacccctgtgcaccagggtcaaaagcagggtgtcctctggcctcaggctaagggctcctgtgtgctgtaccaaatgtcaggtagaaaagacacctgtgaagcaccagctgacccagacagtcctgcatgggtctcaggcaagctgcttcggatatgagcttgcagatgcgggagggcagccgaggctgatttcaggggagggcttcacagaagctggagatttgcggcaggcacgacttgggattccttgtctcattccttgtctccccaagcctgggcagaggcccgcctcccccttacacagaggggcctgagccacccagccgaggccatgcaggtgaactcagctgagaccacctaggaaaaggctgtggccttgaggaggacaagaaatgggcctagggtagagtcaggacactggtctgccacccaggtcatgggagagggaaggaggacctggcaggtgtgggaggagtggaggcaaagctggcaagaagacagggccacatgcagtgggcaggggagtgggaatcgggaggctcaccaagtgggaaaaagagaaacttgagaaacccggccccaaagcagactccacagggatccgaggaactagggagggaggtgggagatgccccgcttgggaggagggtgtgcctcgttatagacttgtcctcgacagagtcacagctcaacaaacaccatctggaaacagctgggagcaggcctgctgcagcagggtctccccgagcactgcaggcgagtagagctccccggggtgctgccatcttcagactctggcccttggttttctggggccccggtgtcctgctggccactctagattgcttgcctggccacattccatttactccttcagcgcaatatttttagtgcttgtattttggtatgtattatatcgattcctgaaaaatgaaaatgataattgggtggttttcagagttttccttcaaaaagaaaaatacccctgagccactttaattatcgtctctcataacgtaaactttccaaagagttggctttacgtagtgattttattaataggatctatattttgcaagcttgtagcaatggattaaagttagcaaggtgggaccctttttgtaataactaaaggaagataatgctttgcagatgacttcaaccgagtgatcctttccatgaaaaggggtcaagaatacacagactacatcaacgcatccttcatagacgtacgtatgctggcctgggttgtgtttatgcagatgtgtttccttcacatgtgaccacagacttgattagcttgttttcacaatgagaaagaattgacatgtttccagaaactcagccatttttgttagcagaattacttgcttaaaaaaaaaagtggcaaggcacgatggctcacacctgtaatcccaacactttgggaagctaaggcgggcagatcacttggggtcaggagtttgaaactagcctggccaatatggcaaaacccgtctctactaaaaatacaaaaattagctgggcgtgatggcaggtgcctgtaatcccagctacttgggaagctgaggcaggagaattgcttgaatccgggaggctgaggttgcagtgagctgagattacaccactgtactccaacctgggcaacagagtgagagcgagaccccctctcaaaaaaaaaaaaaaaaaaaaaaaaa

SEQ ID NO: 16925 - DNA, 5122 bp, Homo sapiens
  ENST00000418331
ccccagccgcatgacgcgcggaggaggcagcgggagcagccgcgggagccgggaccgggtagccgcgcgctgggggtgggcgccgctcgctccgccccgcgaagcccctgcgcgctcagggacgcggcccccccgcggcagccgcgctaggctccggcgtgtggccgcggccgccgccgccgctgccatgtctccggggaagcccggggcgggcggagcggggacgaggcggaccggctggcggaggaggaggcgaaggagacggcaggaggcggcgacgacggtgcccgggctcgggcgcacggcggggcccgattcgcgcgtccggggcacgttccagggcgcgcggggcatgaagccggcggcgcgggaggcgcggctgcctccgcgctcgcccgggctgcgctgggcgctgccgctgctgctgctgctgctgcgcctgggccagatcctgtgcgcaggtggcacccctagtccaattcctgacccttcagtagcaactgttgccacaggggaaaatggcataacgcagatcagcagtacagcagaatcctttcataaacagaatggaactggaacacctcaggtggaaacaaacaccagtgaggatggtgaaagctctggagccaacgatagtttaagaacacctgaacaaggatctaatgggactgatggggcatctcaaaaaactcccagtagcactgggcccagtcctgtgtttgacattaaagctgtttccatcagtccaaccaatgtgatcttaacttggaaaagtaatgacacagctgcttctgagtacaagtatgtagtaaagcataagatggaaaatgagaagacaattactgttgtgcatcaaccatggtgtaacatcacaggcttacgtccagcgacttcatatgtattctccatcactccaggaataggcaatgagacttggggagatcccagagtcataaaagtcatcacagagccgatcccagtttctgatctccgtgttgccctcacgggtgtgaggaaggctgctctctcctggagcaatggcaatggcactgcctcctgccgggttcttcttgaaagcattggaagccatgaggagttgactcaagactcaagacttcaggtcaatatctcgggcctgaagccaggggttcaatacaacatcaacccgtatcttctacaatcaaataagacaaagggagaccccttgggcacagaaggtggcttggatgccagcaatacagagagaagccgggcagggagccccaccgcccctgtgcatgatgagtccctcgtgggacctgtggacccatcctccggccagcagtcccgagacacggaagtcctgcttgtcgggttagagcctggcacccgatacaatgccaccgtttattcccaagcagcgaatggcacagaaggacagccccaggccatagagttcaggacaaatgctattcaggtttttgacgtcaccgctgtgaacatcagtgccacaagcctgaccctgatctggaaagtcagcgataacgagtcgtcatctaactatacctacaagatacatgtggcgggggagacagattcttccaatctcaacgtcagtgagcctcgcgctgtcatccccggactccgctccagcaccttctacaacatcacagtgtgtcctgtcctaggtgacatcgagggcacgccgggcttcctccaagtgcacaccccccctgttccagtttctgacttccgagtgacagtggtcagcacgacggagatcggcttagcatggagcagccatgatgcagaatcatttcagatgcatatcacacaggagggagctggcaattctcgggtagaaataaccaccaaccaaagtattatcattggtggcttgttccctggaaccaagtattgctttgaaatagttccaaaaggaccaaatgggactgaaggggcatctcggacagtttgcaatagaactgttcccagtgcagtgtttgacatccacgtggtctacgtcaccaccacggagatgtggctggactggaagagccctgacggtgcttccgagtatgtctaccatttagtcatagagtccaagcatggctctaaccacacaagcacgtatgacaaagcgattactctccagggcctgattccgggcaccttatataacatcaccatctctccagaagtggaccacgtctggggggaccccaactccactgcacagtacacacggcccagcaatgtgtccaacattgatgtaagtaccaacaccacagcagcaactttaagttggcagaactttgatgacgcctctcccacgtactcctactgccttcttattgagaaggctggaaattccagcaacgcaacacaagtagtcacggacattggaattactgacgctacagtcactgaattaatacctggctcatcatacacagtggagatctttgcacaagtaggggatgggatcaagtcactggaacctggccggaagtcattctgtacagatcctgcgtccatggcctccttcgactgcgaagtggtccccaaagagccagccctggttctcaaatggacctgccctcctggcgccaatgcaggctttgagctggaggtcagcagtggagcctggaacaatgcgacccacctggagagctgctcctctgagaatggcactgagtatagaacggaagtcacgtatttgaatttttctacctcgtacaacatcagcatcaccactgtgtcctgtggaaagatggcagcccccacccggaacacctgcactactggcatcacagatccccctcctccagatggatcccctaatattacatctgtcagtcacaattcagtaaaggtcaagttcagtggatttgaagccagccacggacccatcaaagcctatgctgtcattctcaccaccggggaagctggtcacccttctgcagatgtcctgaaatacacgtatgaggatttcaaaaagggagcctcagatacttatgtgacatacctcataagaacagaagaaaagggacgttctcagagcttgtctgaagttttgaaatatgaaattgacgttgggaatgagtcaaccacacttggttattacaatgggaagctggaacctctgggctcctaccgggcttgtgtggctggcttcaccaacattaccttccaccctcaaaacaaggggctcattgatggggctgagagctatgtgtccttcagtcgctactcagatgctgtttccttgccccaggatccaggtgtcatctgtggagcggtttttggctgtatctttggtgccctggttattgtgactgtgggaggcttcatcttctggagaaagaagaggaaagatgcaaagaataatgaagtgtccttttctcaaattaaacctaaaaaatctaagttaatcagagtggagaattttgaggcctacttcaagaagcagcaagctgactccaactgtgggttcgcagaggaatacgaagatctgaagcttgttggaattagtcaacctaaatatgcagcagaactggctgagaatagaggaaagaatcgctataataatgttctgccctatgatatttcccgtgtcaaactttcggtccagacccattcaacggatgactacatcaatgccaactacatgcctggctaccactccaagaaagattttattgccacacaaggacctttaccgaacactttgaaagatttttggcgtatggtttgggagaaaaatgtatatgccatcattatgttgactaaatgtgttgaacagggaagaaccaaatgtgaggagtattggccctccaagcaggctcaggactatggagacataactgtggcaatgacatcagaaattgttcttccggaatggaccatcagagatttcacagtgaaaaatatccagacaagtgagagtcaccctctgagacagttccatttcacctcctggccagaccacggtgttcccgacaccactgacctgctcatcaacttccggtacctcgttcgtgactacatgaagcagagtcctcccgaatcgccgattctggtgcattgcagtgctggggtcggaaggacgggcactttcattgccattgatcgtctcatctaccagatagagaatgagaacaccgtggatgtgtatgggattgtgtatgaccttcgaatgcataggcctttaatggtgcagacagaggaccagtatgttttcctcaatcagtgtgttttggatattgtcagatcccagaaagactcaaaagtagatcttatctaccagaacacaactgcaatgacaatctatgaaaaccttgcgcccgtgaccacatttggaaagaccaatggttacatcgcctaattccaaaggaataacctttctggagtgaaccagaccgtcgcacccacagcgaaggcacatgccccgatgtcgacatgtttttatatgtctaatatcttaattctttgttctgttttgtgagaactaattttgagggcatgaagctgcatatgatagatgacaaattggggctgtcgggggctgtggatgggtggggagcaaatcatctgcattcctgatgaccaatgggatgaggtcactttttttttttttcccccttgaggattgtggaaaaccaggaaaagggagctatgatttttttttccaaaacaatttcttttttaaaaaagactattttatatgattcacatgctaaagccaggattgtgttgggttgaatatattttaagtatcagaggtctatttttacctactgtgtcttggaatctagccgatggaaaatacctaattgtggatgatgattgcgcagggaggggtacgtggcacctcttccgaatgggttttctatttgaacatgtgccttttctgaattatgcttccacaggcaaaactcagtagagatctatatttttgtactgaatctcataattggaatatacggaatatttaaacagtagcttagcatcagaggtttgcttcctcagtaacatttctgttctcatttgatcaggggaggcctctttgccccgactccgcttcccctgccccctgtacatttgtgctccattttttcttcccttttccctcccagttttc

SEQ ID NO: 16926 - DNA, 3158 bp, Homo sapiens
  ENST00000440289
ggaggaggcagcgggagcagccgcgggagccgggaccgggtagccgcgcgctgggggtgggcgccgctcgctccgccccgcgaagcccctgcgcgctcagggacgcggcccccccgcggcagccgcgctaggctccggcgtgtggccgcggccgccgccgccgctgccatgtctccggggaagcccggggcgggcggagcggggacgaggcggaccggctggcggaggaggaggcgaaggagacggcaggaggcggcgacgacggtgcccgggctcgggcgcacggcggggcccgattcgcgcgtccggggcacgttccagggcgcgcggggcatgaagccggcggcgcgggaggcgcggctgcctccgcgctcgcccgggctgcgctgggcgctgccgctgctgctgctgctgctgcgcctgggccagatcctgtgcgcaggtggcacccctagtccaattcctgacccttcagtagcaactgttgccacaggggaaaatggcataacgcagatcagcagtacagcagaatcctttcataaacagaatggaactggaacacctcaggtggaaacaaacaccagtgaggatggtgaaagctctggagccaacgatagtttaagaacacctgaacaaggatctaatgggactgatggggcatctcaaaaaactcccagtagcactgggcccagtcctgtgtttgacattaaagctgtttccatcagtccaaccaatgtgatcttaacttggaaaagtaatgacacagctgcttctgagtacaagtatgtagtaaagcataagatggaaaatgagaagacaattactgttgtgcatcaaccatggtgtaacatcacaggcttacgtccagcgacttcatatgtattctccatcactccaggaataggcaatgagacttggggagatcccagagtcataaaagtcatcacagagccgatcccagtttctgatctccgtgttgccctcacgggtgtgaggaaggctgctctctcctggagcaatggcaatggcactgcctcctgccgggttcttcttgaaagcattggaagccatgaggagttgactcaagactcaagacttcaggtcaatatctcgggcctgaagccaggggttcaatacaacatcaacccgtatcttctacaatcaaataagacaaagggagaccccttgggcacagaaggtggcttggatgccagcaatacagagagaagccgggcagggagccccaccgcccctgtgcatgatgagtccctcgtgggacctgtggacccatcctccggccagcagtcccgagacacggaagtcctgcttgtcgggttagagcctggcacccgatacaatgccaccgtttattcccaagcagcgaatggcacagaaggacagccccaggccatagagttcaggacaaatgctattcaggtttttgacgtcaccgctgtgaacatcagtgccacaagcctgaccctgatctggaaagtcagcgataacgagtcgtcatctaactatacctacaagatacatgtggcgggggagacagattcttccaatctcaacgtcagtgagcctcgcgctgtcatccccggactccgctccagcaccttctacaacatcacagtgtgtcctgtcctaggtgacatcgagggcacgccgggcttcctccaagtgcacaccccccctgttccagtttctgacttccgagtgacagtggtcagcacgacggagatcggcttagcatggagcagccatgatgcagaatcatttcagatgcatatcacacaggagggagctggcaattctcgggtagaaataaccaccaaccaaagtattatcattggtggcttgttccctggaaccaagtattgctttgaaatagttccaaaaggaccaaatgggactgaaggggcatctcggacagtttgcaatagaactggatgatttgaacacctgcctggaattccatcatctgaaacagagttggcagataagaatggcccctatgccaaatttggctcattgtctgtttttgtaaataaagttttattggatcacagccatgttcatttgcttatgtactgtctatggctactttggtgctagaattgagtagtggcagcagagaacgtgtggcttgtgaagcctgagatatttattttctggccattacagagaatgtttgctgacctctgggctagatcagtggttttcaaattgtggtccagggctctctagggatccctaggttctttcaaggggtctccaaggtagtattatcataacaatactaaaatgttatttggctttttcattctcattctcttttggagttttccaactttgatccgatatgggatgacattgtctctcaggtctaatggaatatatgctgtggattcttacattttaaaaatttcttcattttaaatccctgatatagtaaatattaataaatataacctatgtaaatacaaattctctgagagccttaataacttttaagatggtaaagaagtcctgagagcaaaaagtttaagaacctctggtcaagatgtgttagaaattaactactgtgctgtgttgggcaggtggactgttcacagtctttcctaaacaacactgtgatgagatactttgttagttctagaaggctaattgaaattgataaaatcattttatagtcagctacggtggcctgcacccatcgtcccagctacttgagaggctgcggcaggaggattgcttggcccaacagttgcagactagcaccagcctgggagaccctgtctcaaaaaaaaatttttttttatagaaacagtttaaattattaaattatttctaggcctacaggagaaacttctgggaaatcctagagagtaatgttcattattgttgttttaaaattttgaaataattgttttttggaaaggttgaaaaacatacagtcttccttgatctaagattcaagatagttgaaatcttttatacagagggtagaataaagatatacctaatgtaaatgatgagttaatgggtgcagcacaccaacatggcacatgtatacatatgtaacaaacctgcacgttgtgcacatgtaccctagaacttaaagtataataaaaacatatatatatatataaaagaaa

SEQ ID NO: 16927 - DNA, 546 bp, Homo sapiens
  ENST00000534219
gcggccgccgccgccgctgccatgtctccggggaagcccggggcgggcggagcggggacgaggcggaccggctggcggaggaggaggcgaaggagacggcaggaggcggcgacgacggtgcccgggctcgggcgcacggcggggcccgattcgcgcgtccggggcacgttccagggcgcgcggggcatgaagccggcggcgcgggaggcgcggctgcctccgcgctcgcccgggctgcgctgggcgctgccgctgctgctgctgctgctgcgcctgggccagatcctgtgcgcaggtggcaggcccagtcctgtgtttgacattaaagctgtttccatcagtccaaccaatgtgatcttaacttggaaaagtaatgacacagctgcttctgagtacaagtatgtagtaaagcataagatggaaaatgagaagacaattactgttgtgcatcaaccatggtgtaacatcacaggcttacgtccagcgacttcatatgtattctccatcactccaggaataggcaatgagacttggggagatcccaga

SEQ ID NO: 16928 - DNA, 626 bp, Homo sapiens
  ENST00000527952
gcggccgccgccgccgctgccatgtctccggggaagcccggggcgggcggagcggggacgaggcggaccggctggcggaggaggaggcgaaggagacggcaggaggcggcgacgacggtgcccgggctcgggcgcacggcggggcccgattcgcgcgtccggggcacgttccagggcgcgcggggcatgaagccggcggcgcgggaggcgcggctgcctccgcgctcgcccgggctgcgctgggcgctgccgctgctgctgctgctgctgcgcctgggccagatcctgtgcgcaggtggcacccctagtccaattcctgacccttcagtagcaactgttgccacaggggaaaatggcataacgcagatcagcagtacagcagaatcctttcataaacagaatggaactggaacacctcaggtggaaacaaacaccagtgaggatggtgaaagctctggagccaacgatagtttaagaacacctgaacaaggatctaatgggactgatggggcatctcaaaaaactcccagtagcactgagccgatcccagtttctgatctccgtgttgccctcacgggtgtgaggaaggctgctctctcctggagcaatggcaatggcactgcctc

SEQ ID NO: 16929 - DNA, 571 bp, Homo sapiens
  ENST00000526550
cttcacggttggcgttggccttgttcactgctgtgtgccaagctgctgacagcatctggctatcgcagtagagatggggttttgccatgttgcccatgctggtcttgaactcccggcctcaagagatcctcttgtctccaaatcgcttcgcagaagtgctgggattacagatcctgtgcgcaggtggcacccctagtccaattcctgacccttcagtagcaactgttgccacaggggaaaatggcataacgcagatcagcagtacagcagaatcctttcataaacagaatggaactggaacacctcaggtggaaacaaacaccagtgaggatggtgaaagctctggagccaacgatagtttaagaacacctgaacaaggatctaatgggactgatggggcatctcaaaaaactcccagtagcactgggcccagtcctgtgtttgacattaaagctgtttccatcagtccaaccaatgtgatcttaacttggaaaagtaatgacacagctgcttctgagtacaagtatgtagtaaagcataagatggaaaatgagaagacaattactgttgt

SEQ ID NO: 16930 - DNA, 555 bp, Homo sapiens
  ENST00000527026
gtccttcagtcgctactcagatgctgtttccttgccccaggatccaggtgtcatctgtggagcggtttttggctgtatctttggtgccctggttattgtgactgtgggaggcttcatcttctggagaaagaagaggaaagatgcaaagaataatgaagtgtccttttctcaaattaagtaagtctctcaaattatgagctttattttaaatcctccaatctgttcggtgactatctataaataatttttgatggaacttgctgtcatttttcctgattggcacattttgaccatgaccatctggaagtttttgctagctctgttttctgcaaggaatctatgttttattagtctcctgaagctggcttccttgtcatgttctactcttctaccaataaatacggatttcttgattaaaaaaacgtcaaataggttatcaagatccaggggagagaagaacttacttaaagtcacaaaaccaattagttacaaagtagggtctagaaatcagatttcctgaatcatattttagtgttttgtgaataatagtactct

SEQ ID NO: 16931 - DNA, 7851 bp, Homo sapiens
  ENST00000613246
cagccccagccgcatgacgcgcggaggaggcagcgggagcagccgcgggagccgggaccgggtagccgcgcgctgggggtgggcgccgctcgctccgccccgcgaagcccctgcgcgctcagggacgcggcccccccgcggcagccgcgctaggctccggcgtgtggccgcggccgccgccgccgctgccatgtctccggggaagcccggggcgggcggagcggggacgaggcggaccggctggcggaggaggaggcgaaggagacggcaggaggcggcgacgacggtgcccgggctcgggcgcacggcggggcccgattcgcgcgtccggggcacgttccagggcgcgcggggcatgaagccggcggcgcgggaggcgcggctgcctccgcgctcgcccgggctgcgctgggcgctgccgctgctgctgctgctgctgcgcctgggccagatcctgtgcgcaggtggcacccctagtccaattcctgacccttcagtagcaactgttgccacaggggaaaatggcataacgcagatcagcagtacagcagaatcctttcataaacagaatggaactggaacacctcaggtggaaacaaacaccagtgaggatggtgaaagctctggagccaacgatagtttaagaacacctgaacaaggatctaatgggactgatggggcatctcaaaaaactcccagtagcactgggcccagtcctgtgtttgacattaaagctgtttccatcagtccaaccaatgtgatcttaacttggaaaagtaatgacacagctgcttctgagtacaagtatgtagtaaagcataagatggaaaatgagaagacaattactgttgtgcatcaaccatggtgtaacatcacaggcttacgtccagcgacttcatatgtattctccatcactccaggaataggcaatgagacttggggagatcccagagtcataaaagtcatcacagagccgatcccagtttctgatctccgtgttgccctcacgggtgtgaggaaggctgctctctcctggagcaatggcaatggcactgcctcctgccgggttcttcttgaaagcattggaagccatgaggagttgactcaagactcaagacttcaggtcaatatctcgggcctgaagccaggggttcaatacaacatcaacccgtatcttctacaatcaaataagacaaagggagaccccttgggcacagaaggtggcttggatgccagcaatacagagagaagccgggcagggagccccaccgcccctgtgcatgatgagtccctcgtgggacctgtggacccatcctccggccagcagtcccgagacacggaagtcctgcttgtcgggttagagcctggcacccgatacaatgccaccgtttattcccaagcagcgaatggcacagaaggacagccccaggccatagagttcaggacaaatgctattcaggtttttgacgtcaccgctgtgaacatcagtgccacaagcctgaccctgatctggaaagtcagcgataacgagtcgtcatctaactatacctacaagatacatgtggcgggggagacagattcttccaatctcaacgtcagtgagcctcgcgctgtcatccccggactccgctccagcaccttctacaacatcacagtgtgtcctgtcctaggtgacatcgagggcacgccgggcttcctccaagtgcacaccccccctgttccagtttctgacttccgagtgacagtggtcagcacgacggagatcggcttagcatggagcagccatgatgcagaatcatttcagatgcatatcacacaggagggagctggcaattctcgggtagaaataaccaccaaccaaagtattatcattggtggcttgttccctggaaccaagtattgctttgaaatagttccaaaaggaccaaatgggactgaaggggcatctcggacagtttgcaatagaactgttcccagtgcagtgtttgacatccacgtggtctacgtcaccaccacggagatgtggctggactggaagagccctgacggtgcttccgagtatgtctaccatttagtcatagagtccaagcatggctctaaccacacaagcacgtatgacaaagcgattactctccagggcctgattccgggcaccttatataacatcaccatctctccagaagtggaccacgtctggggggaccccaactccactgcacagtacacacggcccagcaatgtgtccaacattgatgtaagtaccaacaccacagcagcaactttaagttggcagaactttgatgacgcctctcccacgtactcctactgccttcttattgagaaggctggaaattccagcaacgcaacacaagtagtcacggacattggaattactgacgctacagtcactgaattaatacctggctcatcatacacagtggagatctttgcacaagtaggggatgggatcaagtcactggaacctggccggaagtcattctgtacagatcctgcgtccatggcctccttcgactgcgaagtggtccccaaagagccagccctggttctcaaatggacctgccctcctggcgccaatgcaggctttgagctggaggtcagcagtggagcctggaacaatgcgacccacctggagagctgctcctctgagaatggcactgagtatagaacggaagtcacgtatttgaatttttctacctcgtacaacatcagcatcaccactgtgtcctgtggaaagatggcagcccccacccggaacacctgcactactggcatcacagatccccctcctccagatggatcccctaatattacatctgtcagtcacaattcagtaaaggtcaagttcagtggatttgaagccagccacggacccatcaaagcctatgctgtcattctcaccaccggggaagctggtcacccttctgcagatgtcctgaaatacacgtatgaggatttcaaaaagggagcctcagatacttatgtgacatacctcataagaacagaagaaaagggacgttctcagagcttgtctgaagttttgaaatatgaaattgacgttgggaatgagtcaaccacacttggttattacaatgggaagctggaacctctgggctcctaccgggcttgtgtggctggcttcaccaacattaccttccaccctcaaaacaaggggctcattgatggggctgagagctatgtgtccttcagtcgctactcagatgctgtttccttgccccaggatccaggtgtcatctgtggagcggtttttggctgtatctttggtgccctggttattgtgactgtgggaggcttcatcttctggagaaagaagaggaaagatgcaaagaataatgaagtgtccttttctcaaattaagtctctcaaaagatctaagttaatcagagtggagaattttgaggcctacttcaagaagcagcaagctgactccaactgtgggttcgcagaggaatacgaagatctgaagcttgttggaattagtcaacctaaatatgcagcagaactggctgagaatagaggaaagaatcgctataataatgttctgccctatgatatttcccgtgtcaaactttcggtccagacccattcaacggatgactacatcaatgccaactacatgcctggctaccactccaagaaagattttattgccacacaaggacctttaccgaacactttgaaagatttttggcgtatggtttgggagaaaaatgtatatgccatcattatgttgactaaatgtgttgaacagggaagaaccaaatgtgaggagtattggccctccaagcaggctcaggactatggagacataactgtggcaatgacatcagaaattgttcttccggaatggaccatcagagatttcacagtgaaaaatatccagacaagtgagagtcaccctctgagacagttccatttcacctcctggccagaccacggtgttcccgacaccactgacctgctcatcaacttccggtacctcgttcgtgactacatgaagcagagtcctcccgaatcgccgattctggtgcattgcagtgctggggtcggaaggacgggcactttcattgccattgatcgtctcatctaccagatagagaatgagaacaccgtggatgtgtatgggattgtgtatgaccttcgaatgcataggcctttaatggtgcagacagaggaccagtatgttttcctcaatcagtgtgttttggatattgtcagatcccagaaagactcaaaagtagatcttatctaccagaacacaactgcaatgacaatctatgaaaaccttgcgcccgtgaccacatttggaaagaccaatggttacatcgcctaattccaaaggaataacctttctggagtgaaccagaccgtcgcacccacagcgaaggcacatgccccgatgtcgacatgtttttatatgtctaatatcttaattctttgttctgttttgtgagaactaattttgagggcatgaagctgcatatgatagatgacaaattggggctgtcgggggctgtggatgggtggggagcaaatcatctgcattcctgatgaccaatgggatgaggtcactttttttttttttcccccttgaggattgtggaaaaccaggaaaagggagctatgatttttttttccaaaacaatttcttttttaaaaaagactattttatatgattcacatgctaaagccaggattgtgttgggttgaatatattttaagtatcagaggtctatttttacctactgtgtcttggaatctagccgatggaaaatacctaattgtggatgatgattgcgcagggaggggtacgtggcacctcttccgaatgggttttctatttgaacatgtgccttttctgaattatgcttccacaggcaaaactcagtagagatctatatttttgtactgaatctcataattggaatatacggaatatttaaacagtagcttagcatcagaggtttgcttcctcagtaacatttctgttctcatttgatcaggggaggcctctttgccccgactccgcttcccctgccccctgtacatttgtgctccattttttcttcccttttccctcccagttttctccaaagactcttctgttggcaacattttcaacccattggttgggtgagaatggcgactcaaatatcaccttgagaatttctgtgggtgggaatgggagaagcagaggaatcctacagtggcagaaatccttttcttgtccctgtattatcctttttctcatgtctgtatttggtatgaaggattatttaaaggtgcaatatgtgaattagtgattcatgatgttctaggtttttagtaacgttttactcaggttggcattttatgtgtctgtgtctgtatgtgtgtgtgtatgttcagaagcgtggcaatctgtgaacacttcagcgtgaattcagtgtcagattaatccctccttccccaaagtccactggctttcgtctctctctgccgtgacacatatcggaatctactgtgtatatatatatatatatatatatatatatatatatatatatatatatacactaagctctcaaaaacagtcattcctatgaattgaggtgtacaaagtttgaatttgtatcaaagatgtaattattatttttaaaaccttttcactatactgctgctgtaattactttgatttttaaaatgtagattaatttttttttttttgcttcaggtgtgtatccaccaagaatttcaaatttatgtggatttattttattggtacataatctgtaaacttcttaaggcattaacatgaaaagattttttctttttattttatattgtggctcaggttatattttgaagatgttttgagtttatcctccaataggcaatgaagttgacaaggttttatgaaggaataaccaagtccctggagtcctgtggctgttgccacagtaatgtgtcctgctgtaaacaggacaggtgtgtcctgttgagaatgtgagcgggctcttccagcctcctggtccctcctgactctgccacgcccctcacctcactggcacttcgataactgactggacgtgttaatgggtcttttagggttctaaagggtgaaccacacttttaaagccccggctgtggttcggagggttagtgctgtatgccttttatttccctttccctttgaggtactgaaaggatgaaaaggtggtgtcatgttttggggagaatcttacttctcaaatggaaattgcactttttgctgaatcctttgcatttttttggtagtaagcagttcattgagtatcaggtcctcaaaggaatgagttggcccggctagggtgggccctcttgacctaacttcagagggggccttggctcagtaggtgtgaatcagggaagccacattgtcctcagggtgctgtatgaagctgggtgtgggcggattcctcccacaccttcacactggcctgcctccaactcatacagatctcggagcggtcggtacttcattcataggtccctgttcaggcagcagttctgtgggctgtggccctctcccctccaatatgtccgaaaccattgtgatgggtggcaaatcccagggagctcctaagccctgctctgcccacatcactgccacagagaagtcagaggaagggacttgttgctaaaaaatcctttaaaaggttaaatactttaaaagattaaagcaacataactgtaaacatattgtataaaaatgaaaaacacaggaaccctcttcccttccgcctggtgtgggcttgggaaatgggcaagcggccccagcaatcatgggaggaactcttgcgggggagcggtctgggattccaaatgggcaggtcacacgaaggtcacgatgcttctctgcatcctgaaaagggctggggacagggccagtgggggtggtaagggtatttatagcacagtgcttgaaaagggaagattaatgtgtaaatataaaggacacacaggctgggggttggtcagaggcaagaggagggtgcctctgagcttcaacccctcccaggaacaatgagctcaaattggaagagtccagtggaatcggggggatggtgtgagcacccctgttcagtctttgacaattgcatacagaaaagcagctggtatgggtttgggtgtcaatgaaagggccaaagactggtggccagctggtttgggggatttgggccattgatagcatctcccaggaacaacgactttttgcctccaaagttggatctagtgatgatcagcaccagcaggaaatgacatttggtgtctgcccactgcagccatactgtgacctccagccagacttccgcctaattgactccactggatttgtgctctgttgagtcagaggctcccgggggttggggatcgaggggcgggggtcagctatgcagcccatcacgtgtgtttttcatctgggatgaaaaagcctggttctcttttgaaatgcttgattgtacttattgagctaaacaagtcttggtgactgttgttgatttgcctcaaaagttttaagtcctgggttttcagactactgtgtagcagctgtgtgtttaacatactgtagctttttctcccttgggggcacatacaaataggatgtgttgatgtggactctaaactgtaattttcctgtaactattttggaatgatgcatatttctaatgtttgttatacttgtacagagtattgctgttggttgctttttttttttttaaggaaaaaatggcctgaaaacatttttttaaagacttacaaataccaaatataaaaaaatgtcaatgcatt

SEQ ID NO: 16932 - DNA, 4773 bp, Homo sapiens
  ENST00000615445
gcatgacgcgcggaggaggcagcgggagcagccgcgggagccgggaccgggtagccgcgcgctgggggtgggcgccgctcgctccgccccgcgaagcccctgcgcgctcagggacgcggcccccccgcggcagccgcgctaggctccggcgtgtggccgcggccgccgccgccgctgccatgtctccggggaagcccggggcgggcggagcggggacgaggcggaccggctggcggaggaggaggcgaaggagacggcaggaggcggcgacgacggtgcccgggctcgggcgcacggcggggcccgattcgcgcgtccggggcacgttccagggcgcgcggggcatgaagccggcggcgcgggaggcgcggctgcctccgcgctcgcccgggctgcgctgggcgctgccgctgctgctgctgctgctgcgcctgggccagatcctgtgcgcaggtggcacccctagtccaattcctgacccttcagtagcaactgttgccacaggggaaaatggcataacgcagatcagcagtacagcagaatcctttcataaacagaatggaactggaacacctcaggtggaaacaaacaccagtgaggatggtgaaagctctggagccaacgatagtttaagaacacctgaacaaggatctaatgggactgatggggcatctcaaaaaactcccagtagcactgggcccagtcctgtgtttgacattaaagctgtttccatcagtccaaccaatgtgatcttaacttggaaaagtaatgacacagctgcttctgagtacaagtatgtagtaaagcataagatggaaaatgagaagacaattactgttgtgcatcaaccatggtgtaacatcacaggcttacgtccagcgacttcatatgtattctccatcactccaggaataggcaatgagacttggggagatcccagagtcataaaagtcatcacagagccgatcccagtttctgatctccgtgttgccctcacgggtgtgaggaaggctgctctctcctggagcaatggcaatggcactgcctcctgccgggttcttcttgaaagcattggaagccatgaggagttgactcaagactcaagacttcaggtcaatatctcgggcctgaagccaggggttcaatacaacatcaacccgtatcttctacaatcaaataagacaaagggagaccccttgggcacagaaggtggcttggatgccagcaatacagagagaagccgggcagggagccccaccgcccctgtgcatgatgagtccctcgtgggacctgtggacccatcctccggccagcagtcccgagacacggaagtcctgcttgtcgggttagagcctggcacccgatacaatgccaccgtttattcccaagcagcgaatggcacagaaggacagccccaggccatagagttcaggacaaatgctattcaggtttttgacgtcaccgctgtgaacatcagtgccacaagcctgaccctgatctggaaagtcagcgataacgagtcgtcatctaactatacctacaagatacatgtggcgggggagacagattcttccaatctcaacgtcagtgagcctcgcgctgtcatccccggactccgctccagcaccttctacaacatcacagtgtgtcctgtcctaggtgacatcgagggcacgccgggcttcctccaagtgcacaccccccctgttccagtttctgacttccgagtgacagtggtcagcacgacggagatcggcttagcatggagcagccatgatgcagaatcatttcagatgcatatcacacaggagggagctggcaattctcgggtagaaataaccaccaaccaaagtattatcattggtggcttgttccctggaaccaagtattgctttgaaatagttccaaaaggaccaaatgggactgaaggggcatctcggacagtttgcaatagaactgttcccagtgcagtgtttgacatccacgtggtctacgtcaccaccacggagatgtggctggactggaagagccctgacggtgcttccgagtatgtctaccatttagtcatagagtccaagcatggctctaaccacacaagcacgtatgacaaagcgattactctccagggcctgattccgggcaccttatataacatcaccatctctccagaagtggaccacgtctggggggaccccaactccactgcacagtacacacggcccagcaatgtgtccaacattgatgtaagtaccaacaccacagcagcaactttaagttggcagaactttgatgacgcctctcccacgtactcctactgccttcttattgagaaggctggaaattccagcaacgcaacacaagtagtcacggacattggaattactgacgctacagtcactgaattaatacctggctcatcatacacagtggagatctttgcacaagtaggggatgggatcaagtcactggaacctggccggaagtcattctgtacagatcctgcgtccatggcctccttcgactgcgaagtggtccccaaagagccagccctggttctcaaatggacctgccctcctggcgccaatgcaggctttgagctggaggtcagcagtggagcctggaacaatgcgacccacctggagagctgctcctctgagaatggcactgagtatagaacggaagtcacgtatttgaatttttctacctcgtacaacatcagcatcaccactgtgtcctgtggaaagatggcagcccccacccggaacacctgcactactggcatcacagatccccctcctccagatggatcccctaatattacatctgtcagtcacaattcagtaaaggtcaagttcagtggatttgaagccagccacggacccatcaaagcctatgctgtcattctcaccaccggggaagctggtcacccttctgcagatgtcctgaaatacacgtatgaggatttcaaaaagggagcctcagatacttatgtgacatacctcataagaacagaagaaaagggacgttctcagagcttgtctgaagttttgaaatatgaaattgacgttgggaatgagtcaaccacacttggttattacaatgggaagctggaacctctgggctcctaccggtgtcttctgagggcttgtgtggctggcttcaccaacattaccttccaccctcaaaacaaggggctcattgatggggctgagagctatgtgtccttcagtcgctactcagatgctgtttccttgccccaggatccaggtgtcatctgtggagcggtttttggctgtatctttggtgccctggttattgtgactgtgggaggcttcatcttctggagaaagaagaggaaagatgcaaagaataatgaagtgtccttttctcaaattaagtctctcaaaagatctaagttaatcagagtggagaattttgaggcctacttcaagaagcagcaagctgactccaactgtgggttcgcagaggaatacgaagatctgaagcttgttggaattagtcaacctaaatatgcagcagaactggctgagaatagaggaaagaatcgctataataatgttctgccctatgatatttcccgtgtcaaactttcggtccagacccattcaacggatgactacatcaatgccaactacatgcctggctaccactccaagaaagattttattgccacacaaggacctttaccgaacactttgaaagatttttggcgtatggtttgggagaaaaatgtatatgccatcattatgttgactaaatgtgttgaacagggaagaaccaaatgtgaggagtattggccctccaagcaggctcaggactatggagacataactgtggcaatgacatcagaaattgttcttccggaatggaccatcagagatttcacagtgaaaaatatccagacaagtgagagtcaccctctgagacagttccatttcacctcctggccagaccacggtgttcccgacaccactgacctgctcatcaacttccggtacctcgttcgtgactacatgaagcagagtcctcccgaatcgccgattctggtgcattgcagtgctggggtcggaaggacgggcactttcattgccattgatcgtctcatctaccagatagagaatgagaacaccgtggatgtgtatgggattgtgtatgaccttcgaatgcataggcctttaatggtgcagacagaggaccagtatgttttcctcaatcagtgtgttttggatattgtcagatcccagaaagactcaaaagtagatcttatctaccagaacacaactgcaatgacaatctatgaaaaccttgcgcccgtgaccacatttggaaagaccaatggttacatcgcctaattccaaaggaataacctttctggagtgaaccagaccgtcgcacccacagcgaaggcacatgccccgatgtcgacatgtttttatatgtctaatatcttaattctttgttctgttttgtgagaactaattttgagggcatgaagctgcatatgatagatgacaaattggggctgtcgggggctgtggatgggtggggagcaaatcatctgcattcctgatgaccaatgggatgaggtcactttttttttttttcccccttgaggattgtggaaaaccaggaaaagggagctatgatttttttttccaaaacaatttcttttttaaaaaagactattttatatgattcacatgctaaagccaggattgtgttgggttgaatatattttaagtatcagaggtc

SEQ ID NO: 16933 - DNA, 6087 bp, Homo sapiens
  ENST00000368226
agaagcgcccggagcccgcggggcgacgtcacccccggctccgcccccgtccctccccgagcaaagtaactcttgactaacaggagcagcctccgccgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagatatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttagttgggtgagactctttaaagtgcatccatgaagaaacctgtccatctattgagccagcagctgttgtacctgttacacttgtgcagaaagattttaatgtggggggtgggagacttttacatttgagaggtaaaagtattttttttatgaagttgtgtatcttaataaaaaggactgaattagtttttattactatattaaagcatcaacatttcatgccacataaattatatttaataagaaccagattgaaatgagaacgtattggtgtttgtacagtgaacatgccaccttttttctcatggtttcagtagagcagctaccacatgttgcatgagttcatactttctacgtggcatttttctccctttctaaaatgaaagctgatgaatcttaaaaggaagaagaaaagaaaagctgtgcaaattcatagtaaagttcgttttttatatgtttccagtgtagcagatctctatataaatatataaatatatataactggcttattttcttttaatgtgcaatgatggctggatcatttaaagttctttttagaaaataacataagccaaagactcaagtgtaaatatgtctatatggagaaagcacattatatttattggttacttacattccttttttgatggctaaaatactaccaccacacaatcatcttttttttcctgaagaaagctttttctttagctaaaatcaattgtaaacgatttttgtagattattttttgtatgttttagtgtaagtagaagataaactttttattcataaaccaggaagcaatgttctttatagtgattctcttgtgtacatgcttgtgaattaaatttgtgtaaaatcccttggcaattgggtcttttaatataggaccaaattaaaacattttgctgaatatgtatagtttttcacaatttcattaggtaaataatggtttggtgatcatacatgagaaatgtacacattaaaaggccttgctgacaacttgcacaatgttgaacatagcctttaagcatcatttaaattttaaaggaatggagtttttcagcctgtggcccagcactggtcaagaaaacaagatggcaacatatatgctttcagggtcaaatttgagcaaactgtaaactgtcagggtgataaaatgtttctcttgatgtttacatgcacaagctttgcgttctgactataaaaagtgtgaacaaatcaatgccagattcctgttttgcgcattgtcatgggattcttaagtgaacctttctaaatgtggtcttgttcacatgctccacgtagctgtaacttcacatcatcagcttgcagtttgtaattgactaaagcattccagtgtcctctttctagattgccagctcatgacatggtgcttataaagatttaattaaagtaagaatgaaataaagtttttataattataacagtta

SEQ ID NO: 16934 - DNA, 5757 bp, Homo sapiens
  ENST00000532331
ggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagattgcccaatgatccacttgtaccgactgctgtgttagttcctataacagatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatatttggctgtacagggatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttagttgggtgagactctttaaagtgcatccatgaagaaacctgtccatctattgagccagcagctgttgtacctgttacacttgtgcagaaagattttaatgtggggggtgggagacttttacatttgagaggtaaaagtattttttttatgaagttgtgtatcttaataaaaaggactgaattagtttttattactatattaaagcatcaacatttcatgccacataaattatatttaataagaaccagattgaaatgagaacgtattggtgtttgtacagtgaacatgccaccttttttctcatggtttcagtagagcagctaccacatgttgcatgagttcatactttctacgtggcatttttctccctttctaaaatgaaagctgatgaatcttaaaaggaagaagaaaagaaaagctgtgcaaattcatagtaaagttcgttttttatatgtttccagtgtagcagatctctatataaatatataaatatatataactggcttattttcttttaatgtgcaatgatggctggatcatttaaagttctttttagaaaataacataagccaaagactcaagtgtaaatatgtctatatggagaaagcacattatatttattggttacttacattccttttttgatggctaaaatactaccaccacacaatcatcttttttttcctgaagaaagctttttctttagctaaaatcaattgtaaacgatttttgtagattattttttgtatgttttagtgtaagtagaagataaactttttattcataaaccaggaagcaatgttctttatagtgattctcttgtgtacatgcttgtgaattaaatttgtgtaaaatcccttggcaattgggtcttttaatataggaccaaattaaaacattttgctgaatatgtatagtttttcacaatttcattaggtaaataatggtttggtgatcatacatgagaaatgtacacattaaaaggccttgctgacaacttgcacaatgttgaacatagcctttaagcatcatttaaattttaaaggaatggagtttttcagcctgtggcccagcactggtcaagaaaacaagatggcaacatatatgctttcagggtcaaatttgagcaaactgtaaactgtcagggtgataaaatgtttctcttgatgtttacatgcacaagctttgcgttctgactataaaaagtgtgaacaaatcaatgccagattcctgttttgcgcattgtcatgg

SEQ ID NO: 16935 - DNA, 5816 bp, Homo sapiens
  ENST00000368213
tccgccgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagatatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatatttggctgtacagggatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttagttgggtgagactctttaaagtgcatccatgaagaaacctgtccatctattgagccagcagctgttgtacctgttacacttgtgcagaaagattttaatgtggggggtgggagacttttacatttgagaggtaaaagtattttttttatgaagttgtgtatcttaataaaaaggactgaattagtttttattactatattaaagcatcaacatttcatgccacataaattatatttaataagaaccagattgaaatgagaacgtattggtgtttgtacagtgaacatgccaccttttttctcatggtttcagtagagcagctaccacatgttgcatgagttcatactttctacgtggcatttttctccctttctaaaatgaaagctgatgaatcttaaaaggaagaagaaaagaaaagctgtgcaaattcatagtaaagttcgttttttatatgtttccagtgtagcagatctctatataaatatataaatatatataactggcttattttcttttaatgtgcaatgatggctggatcatttaaagttctttttagaaaataacataagccaaagactcaagtgtaaatatgtctatatggagaaagcacattatatttattggttacttacattccttttttgatggctaaaatactaccaccacacaatcatcttttttttcctgaagaaagctttttctttagctaaaatcaattgtaaacgatttttgtagattattttttgtatgttttagtgtaagtagaagataaactttttattcataaaccaggaagcaatgttctttatagtgattctcttgtgtacatgcttgtgaattaaatttgtgtaaaatcccttggcaattgggtcttttaatataggaccaaattaaaacattttgctgaatatgtatagtttttcacaatttcattaggtaaataatggtttggtgatcatacatgagaaatgtacacattaaaaggccttgctgacaacttgcacaatgttgaacatagcctttaagcatcatttaaattttaaaggaatggagtttttcagcctgtggcccagcactggtcaagaaaacaagatggcaacatatatgctttcagggtcaaatttgagcaaactgtaaactgtcagggtgataaaatgtttctcttgatgtttacatgcacaagctttgcgttctgactataaaaagtgtgaacaaatcaatgccagattcctgttttgcgcattgtcatgg

SEQ ID NO: 16936 - DNA, 5025 bp, Homo sapiens
  ENST00000368210
gagcaaagtaactcttgactaacaggagcagcctccgccgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagattgcccaatgatccacttgtaccgactgctgtgttagatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatatttggctgtacagggatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttagttgggtgagactctttaaagtgcatccatgaagaaacctgtccatctattgagccagcagctgttgtacctgttacacttgtgcagaaagattttaatgtggggggtgggagacttttacatttgagaggtaaaagtattttttttatgaagttgtgtatcttaataaaaaggactgaattagtttttattactatattaaagcatcaacatttcatgccacataaattatatttaataagaaccagattgaaatgagaacgtattggtgtttgtacagtgaacatgccaccttttttctcatggtttcagtagagcagctaccacatgttgcatgagttcatactttctacgtggcatttttctccctttctaaaatgaaagctgatga

SEQ ID NO: 16937 - DNA, 4651 bp, Homo sapiens
  ENST00000368215
atggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagatatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttagttgggtgagactctttaaagtgcatccatgaagaaacctgtccatctattgagccagcagctgttgtacctgttacacttgtgcagaaagattttaatgtggggggtgggagacttttacatttgagaggtaaaagtattttttttatgaagttgtgtatcttaataaaaaggactgaattagtttttattactatattaaagcatcaacatttcatgccacataaattatatttaataagaaccagattgaaatgagaacgtattggtgtttgtacagtgaacatgccaccttttttctcatggtttcagtagagcagctaccacatgtt

SEQ ID NO: 16938 - DNA, 4758 bp, Homo sapiens
  ENST00000368207
tccgccgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcagcagcaacagaagaaccagaagtgatcccagatcccgccaagcagacagacagagtggtgaaaatagcaggaattagtgctggaattttggtgttcatcctccttctcctagttgtcatattaattgtaaaaaagaggaggagctactattcttactcctactacctcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagattgcccaatgatccacttgtaccgactgctgtgttagttcctataacagatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatatttggctgtacagggatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttagttgggtgagactctttaaagtgcatccatgaagaaacctgtccatctattgagccagcagctgttgtacctgttacacttgtgcagaaagattttaatgtggggggtgggagac

SEQ ID NO: 16939 - DNA, 1029 bp, Homo sapiens
  ENST00000415046
caaaagcagcagcaacagaagaaccagaagtgatcccagatcccgccaagcagacagacagagtggtgaaaatagcaggaattagtgctggaattttggtgttcatcctccttctcctagttgtcatattaattgtaaaaaagaggaggagctactattcttactcctactacctcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagattgcccaatgatccacttgtaccgactgctgtgttagatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctg

SEQ ID NO: 16940 - DNA, 782 bp, Homo sapiens
  ENST00000415055
tggagaagacacatctgcattagaaacattaggaggagctactattcttactcctactacctcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagattgcccaatgatccacttgtaccgactgctgtgttagttcctataacagatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctga

SEQ ID NO: 16941 - DNA, 2515 bp, Homo sapiens
  ENST00000531050
gtgcatgttagtgctcaagagcctcattatctaccacccgagatgccccaaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagatatatatgttggagaagacacatctgcattagaaacattaggaggagctactattcttactcctactacctcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagattgcccaatgatccacttgtaccgactgctgtgttagttcctataacaggaagaaaaaatgtttatcatggggacaacaattcattttttgctatatcctatttgtagagttggtgatagaacaggcaaatgtactagcacttgaaatatgtttatctgttaattaaatatcattctctacagtatgcattatcattaaaaaaaaagttcccctaagagtgtattttctcttctgttaatgagtatgacggtataatgcttttcaaagtaacaccccttaaaacatttgtttttttttttaagtggtaagtttaaatgtgataaatatgagcatgcttctcgttgtaatgtttagtacttcggtcattaaagtactgtttattcttcataggc

SEQ ID NO: 16942 - DNA, 3157 bp, Homo sapiens
  ENST00000524481
actaacaggagcagcctccgccgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcagcagcaacagaagaaccagaagtgatcccagatcccgccaagcagacagacagagtggtgaaaatagcaggaattagtgctggaattttggtgttcatcctccttctcctagttgtcatattaattgtaaaaaagaggaggagctactattcttactcctactacctcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagattgcccaatgatccacttgtaccgactgctgtgttagttcctataacaggaagaaaaaatgtttatcatggggacaacaattcattttttgctatatcctatttgtagagttggtgatagaacaggcaaatgtactagcacttgaaatatgtttatctgttaattaaatatcattctctacagtatgcattatcattaaaaaaaaagttcccctaagagtgtattttctcttctgttaatgagtatgacggtataatgcttttcaaagtaacaccccttaaaacatttgtttttttttttaagtggtaagtttaaatgtgataaatatgagcatgcttctcgttgtaatgtttagtacttcggtcattaaagtactgtttattcttcataggc

SEQ ID NO: 16943 - DNA, 311 bp, Homo sapiens
  ENST00000531466
tcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagatgtaagtttttcattaaaattttaataaatgatgttacaactcatttcactttgaattctacacgataccttttgagtaatgagagagagtaggaaagtgaggggaga

SEQ ID NO: 16944 - DNA, 555 bp, Homo sapiens
  ENST00000434424
ccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcatttttccacatatgaaaagctaaccctgtttctacaaaaactaaaaaaaatgagccaggcatggtgacttgtgcctgtagctccagctacttggaagatgggaagattgcttcagcctaggaatttgaggctgcagtgagctatgattgtaccactgcactccagcctgggtgacagagtgagactatgtctcaaaaggaaaaaaaaaagaaaagaaaagaaatgaaaaagaaaaactaccacatttgttaaagtaacatcaacttattgcctgactacattttaaactaacatgcaagtatggtcagctttggtgtgaaatttttcaatatgaaaataaaaagttttctgacaggg

SEQ ID NO: 16945 - DNA, 2441 bp, Homo sapiens
  ENST00000524534
agtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagatttaaagtagaaccaaaattgtaaaagtgtcccacattgacctctgaagttctttagatatgtcatgctatgtttctgtaactgagaaa

SEQ ID NO: 16946 - DNA, 662 bp, Homo sapiens
  ENST00000368205
agttcgtaaattgagaactgctgctttagttcatgttctaactcaagaattccttattttaaatctcttcctgagagataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcag

SEQ ID NO: 16947 - DNA, 612 bp, Homo sapiens
  ENST00000490332
tgaatcctggcactttgaacatattagttagggtgaataaaggacctcttgccaatccaatttggaatgtgactggattcacgggtagagattggcttcgggctgagctagcagtgagcaccttttggcccaatgaatatcagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcag

SEQ ID NO: 16948 - DNA, 524 bp, Homo sapiens
  ENST00000498284
tgggataggaaccgaaggagaaggatcttactgaagtggaaggttcaccatgaggagtggaggactatacaagcctggcagtcatggaagttcaaggattgctttttatcgatatctagaaataatttacttctctttctgtgcaagaacaatatgctctcctgtttgcagagctgccccttcagtgtgtttctagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaaccc

SEQ ID NO: 16949 - DNA, 746 bp, Homo sapiens
  ENST00000495748
gttttcagtgtctgtgcttgtggtcggtaacttttgctgctgttgttctgctgctgtctgccattccattcgccatctatcacgcacacagaaccctggccaggatcatgaagggcgattgaaaaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagta

SEQ ID NO: 16950 - DNA, 558 bp, Homo sapiens
  ENST00000429595
ggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagattttcagactgtgattgacagaaggtaactgcaactgcccaaagtgcgaccttggataaggaaggatgtctgtattcctgaggaacgttcaatgatacggaatttgtgattcataacttgaagctatgataaagctctacttatgggaaataagatcaaaagtgaaattataacatataatttatactgaaatgaaataataaaaagcatttggttatattctt

SEQ ID NO: 16951 - DNA, 1722 bp, Homo sapiens
  ENST00000525459
agcctccgccgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatcatctgtacttttctggtgtatgttttgatgtcatcagttctcactatatgtgtaatacatagatgtaaatatgcatctcatggtaatgagagattgccctcttgcctcccccacccccattattggggaagtgtcatacatagatatacatatgcatcccatggtaatgagagattgcccctctttcttccccaccctgttgatgaggaagtgtttggagacattggcacaaaaccttcaaactagagaaagtatttctatgtgttaaaataagtttaggtccaaaatttgttggtggtttgacaaagagctacttattgacagattctttcctacagctttgttcaggaagaaatagcctttttgagtttattgtaatcttcagactggactgatttactgactttttgaaagtaacatttgggaaataaatgtgatgtagagtttcatgaactatgttaagggggaggcattttcattaattattttaattttgattaattaattgaataaattaaatgacatataaaaataagccaaaaaggataagttattcacaaagctttggatgtttgtttcagaaatgattcattgaattatgattaaatcagacaatcaatagtgtcagtacccactttatgattctgtgactgagtttatatgctcttaacaaaaaaaaggttcatttactagtttggagagtttgttcagtaaccctcactatgaggttccgtccctggatgctgttatttctttaaaaggtcaattttgtgttagaccttgagatttaaacttttaaaggacttgtttatttgtagcttattataaagcctaaagagaatacatttatgtaaaagtatattttatgatggtcagcaagcaatatataaactaatagttttatttctgccttttaaaaatgaattatgtctttaagttaggtttgtctttattcttgaaggggaaaaaagaaatgctttgctttaattgct

SEQ ID NO: 16952 - DNA, 1456 bp, Homo sapiens
  ENST00000392449
ctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcagtgtctgtgcttgtggtcggtaacttttgctgctgttgttctgctgctgtctgccattccattcgccatctatcacgcacacagaaccctggccaggatcatgaagggcgattgaaaaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatcatctgtacttttctggtgtatgttttgatgtcatcagttctcactatatgtgtaatacatagatgtaaatatgcatctcatggtaatgagagattgccctcttgcctcccccacccccattattggggaagtgtcatacatagatatacatatgcatcccatggtaatgagagattgcccctctttcttccccaccctgttgatgaggaagtgtttggagacattggcacaaaaccttcaaactagagaaagtatttctatgtgttaaaataagtttaggtccaaaatttgttggtggtttgacaaagagctacttattgacagattctttcctacagctttgttcaggaagaaatagcctttttgagtttattgtaatcttcagactggactgatttactgactttttgaaagtaacatttgggaaataaatgtgatgtagagtttcatgaactatgttaagggggaggcattttcattaattattttaattttgattaattaattgaataaattaaatgacatataaaaataagccaaaaaggataagttattcacaaagctttggatgtttgtttcagaaatgattcattgaattatgattaaatcagacaatcaatagtgtcagta

SEQ ID NO: 16953 - DNA, 563 bp, Homo sapiens
  ENST00000532751
actaacaggagcagcctccgccgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcagaaaaggcctgcagttactgaaatgacaagtgaaaaggaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagc

SEQ ID NO: 16954 - DNA, 526 bp, Homo sapiens
  ENST00000368202
gagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcagcttcgcttggctggcgagcgcatctgctgctggggttcgcggtgcagatggagacgcagtggtggccagagggtgatggagaagacgggaaaagcgacagccacgctcctggctgaagccgcaggacgcaaataacttactttgtacctgacagtttctcacgttgttgtggaggccctgtttcctggaaataaactcaaattgttgttttctg

SEQ ID NO: 16955 - DNA, 6087 bp, Homo sapiens; identical to SEQ ID NO: 16933
  ENST00000618924

SEQ ID NO: 16956 - DNA, 5757 bp, Homo sapiens; identical to SEQ ID NO: 16934
  ENST00000619256

SEQ ID NO: 16957 - DNA, 5816 bp, Homo sapiens; identical to SEQ ID NO: 16935
  ENST00000618215

SEQ ID NO: 16958 - DNA, 5025 bp, Homo sapiens; identical to SEQ ID NO: 16936
  ENST00000625760

SEQ ID NO: 16959 - DNA, 4651 bp, Homo sapiens; identical to SEQ ID NO: 16937
  ENST00000628183

SEQ ID NO: 16960 - DNA, 4758 bp, Homo sapiens; identical to SEQ ID NO: 16938
  ENST00000626594

SEQ ID NO: 16961 - DNA, 941 bp, Homo sapiens
  ENST00000625615
cagcagcaacagaagaaccagaagtgatcccagatcccgccaagcagacagacagagtggtgaaaatagcaggaattagtgctggaattttggtgttcatcctccttctcctagttgtcatattaattgtaaaaaagaggaggagctactattcttactcctactacctcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagattgcccaatgatccacttgtaccgactgctgtgttagatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatat

SEQ ID NO: 16962 - DNA, 782 bp, Homo sapiens; identical to SEQ ID NO: 16940
  ENST00000625418

SEQ ID NO: 16963 - DNA, 2515 bp, Homo sapiens; identical to SEQ ID NO: 16941
  ENST00000628245

SEQ ID NO: 16964 - DNA, 3157 bp, Homo sapiens; identical to SEQ ID NO: 16942
  ENST00000626859

SEQ ID NO: 16965 - DNA, 311 bp, Homo sapiens; identical to SEQ ID NO: 16943
  ENST00000628763

SEQ ID NO: 16966 - DNA, 555 bp, Homo sapiens; identical to SEQ ID NO: 16944
  ENST00000631016

SEQ ID NO: 16967 - DNA, 2441 bp, Homo sapiens; identical to SEQ ID NO: 16945
  ENST00000629317

SEQ ID NO: 16968 - DNA, 662 bp, Homo sapiens; identical to SEQ ID NO: 16946
  ENST00000627900

SEQ ID NO: 16969 - DNA, 612 bp, Homo sapiens; identical to SEQ ID NO: 16947
  ENST00000628824

SEQ ID NO: 16970 - DNA, 524 bp, Homo sapiens; identical to SEQ ID NO: 16948
  ENST00000627390

SEQ ID NO: 16971 - DNA, 746 bp, Homo sapiens; identical to SEQ ID NO: 16949
  ENST00000627786

SEQ ID NO: 16972 - DNA, 558 bp, Homo sapiens; identical to SEQ ID NO: 16950
  ENST00000629834

SEQ ID NO: 16973 - DNA, 1722 bp, Homo sapiens; identical to SEQ ID NO: 16951
  ENST00000628472

SEQ ID NO: 16974 - DNA, 1456 bp, Homo sapiens; identical to SEQ ID NO: 16952
  ENST00000621720

SEQ ID NO: 16975 - DNA, 563 bp, Homo sapiens; identical to SEQ ID NO: 16953
  ENST00000627768

SEQ ID NO: 16976 - DNA, 526 bp, Homo sapiens; identical to SEQ ID NO: 16954
  ENST00000625700

SEQ ID NO: 16977 - DNA, 5941 bp, Homo sapiens
  ENST00000580170
gcggcgtagagaagctcgcagccctccggagcctcagcgatctcctggctcgcttttcccgcagccgccgagcagcgcaggcccggcgactccgggtgcagctggccctgtgcggtgacatcgccgtccggcgccaggctcgaagccgcctggccgcgcccgcggggtcgcaggccgctggtcccgcccggccgcgctcacaaactactcgcggctcgtgacccgggacaaacttctggcggcggcgcagcctcttccacagtcaccctccccagagccagctaccaaaatagaagacgcggccggggcgaggaggtgggcggggggagcccggtggccgctcctccccgcgcggctgacgcccgcttcggcggcggtagtggctgtggccgcggggccgcccccagccgagctcccggaggcgctcgggcgcgggccggcggggcacgggcgctcacgccctctagcgggccgcggcggcgccgggcggccgtgacgtgagcgctcccttcagccggcctgcggggcaccgccagtcagtcggggagcaagagccccgcgcgcagccggcgcgggctcggtcatcggcgcgccgccgcccggggctgggcttggggctgcctgtggagaggcggcgggcggaacgcgcgcggccacggccacggccaccgccacggccacggccggcagctcgggtcccgggtcccgggcaggggaaggggagaggcggcgagctcagcaaccggaaccgagggaagattttggctccgcgggctcgccctccgctccctctgccagcggcgccagacgccgagtggggccagggacaggggaggaggacccaggaccctgtgcccgcgcccctggagccgctggagttcggacttctgcaactgttggcactttgggggcttggcttagcgctctgctgtttacccgtctctcctcgctgcctcggaaccaaagctcccggccccctccgccctcgcgcgcccacccaccgccgccggggagcggcccggcccgcactcagcaccatgaggggacttgggacttgcctggcgactttggccggacttttgctaactgcggcgggcgagacgttctcaggtggctgcctctttgatgagccgtatagcacatgtggatatagtcaatctgaaggtgatgacttcaattgggagcaagtgaacaccttgactaaaccgacttctgatccatggatgccatcaggttctttcatgctggtgaatgcctctgggagacctgaggggcagagagcccacctgctcttaccccaacttaaagaaaatgacacccactgcatcgattttcactattttgtgtccagcaagagtaattctcctccggggttactcaatgtctacgtgaaggtcaataacgggccactggggaatcctatctggaatatatctggagacccaacacgtacatggaacagggcagaactggccattagtactttctggcctaacttttatcaggtgatttttgaagtgataacttctggacatcaaggctatctcgctatcgatgaggtgaaggtgttaggacatccatgtaccaggactcctcacttcctgcggattcagaatgtggaagttaatgctggccagtttgctaccttccagtgcagtgccatcggcaggaccgtggcaggagacaggctctggttacagggcattgatgtgcgagatgctcctctgaaggaaatcaaggtgaccagctcccgacgcttcattgcttcatttaatgttgtgaataccaccaaacgagatgctggaaagtaccgctgcatgattcgcactgaaggaggtgttggaatatcaaactatgcagagttggtagttaaagaaccacccgttcctattgccccacctcagctcgcctctgtaggagccacctacctgtggatacagctcaacgccaactccatcaatggggatgggcccattgtggcccgagaggtggagtactgcacggccagtgggagctggaatgaccggcagccagtcgattccacgagctataaaattggacaccttgacccagatacagaatatgagattagtgtgctcctgaccaggccaggggagggtggcactggctctcctggtccagctctcaggacaagaacaaagtgtgctgatcccatgcgaggcccaagaaaactagaagtagtggaggtcaaatctcggcaaatcactatccgctgggagccatttggatataatgtaactcgttgccacagttataatctcactgtccactactgttaccaagttggaggacaagaacaagtgcgagaagaagtaagctgggatacagaaaactcacaccctcaacacacgatcactaacctgtcaccatacaccaatgtcagtgtgaaactgatcctcatgaacccagagggccggaaggaaagccaagaactcatagtgcagacagatgaagacctcccaggtgctgttcccactgaatccatacaaggaagtacctttgaagagaagatatttcttcagtggagagaaccaactcaaacatatggtgtaatcactttatatgagatcacctacaaagcagtcagttcctttgacccagaaatagatttatccaatcagagtggaagagtttcaaagctgggaaatgaaacccattttctgttttttggactgtatccggggaccacatactcctttaccatccgagctagcacagctaagggttttgggcctccagcaacaaaccagttcaccaccaaaatatcagcaccctctatgccagcttatgaacttgagacacctttgaatcaaactgacaataccgtgacagtcatgctgaaacctgcccacagcagaggagcacctgtcagtgtctatcaaatagttgttgaggaagaacgtcctcgaagaactaaaaagacgacagaaatcttaaagtgctacccagtgccaattcacttccagaatgcttctctgctgaactcacagtactactttgctgcagaatttcctgcagacagcctccaagctgcgcagccttttacaattggtgataataagacatataatggatactggaacactccccttctcccctataaaagctacagaatttatttccaagctgctagtagagccaatggggaaaccaaaatagactgtgtccaagtggccacaaaaggagctgccactccgaaaccagtcccagaacccgagaaacagacagaccatacagttaaaattgctggagtcatcgcgggcatcttgctgttcgtgattatatttcttggagttgtgttggtaatgaagaaaaggaaactggccaagaagcggaaagagaccatgagcagcacccgacaggagatgactgtgatggtgaactcaatggacaagagctatgctgagcagggcacaaactgcgacgaggctttctcattcatggacacgcacaatctgaatgggagatctgtgtcttcaccatcgtccttcacaatgaaaacaaatacactgagcacatcggtgcctaattcctattacccagacccatttgtgccaactgcaattttagtgccaataaatgatgaaacccacacaatggccagcgataccagcagcctggtgcagtcccatacttacaagaagcgagagccggccgacgtgccctatcagactgggcagctccaccccgccatccgggtggcagacctccttcagcacatcacacagatgaagtgtgcggagggctacggcttcaaggaggaatacgagagcttctttgaagggcagtctgcaccatgggactcggctaagaaagatgagaacagaatgaagaacagatacgggaatatcattgcatacgatcattcccgagtgaggctgcagacaatagaaggagacacaaactcagactatatcaatggcaattatatcgatggttatcatcgacccaatcattacattgctacccaagggccaatgcaggaaaccatctatgacttctggaggatggtgtggcacgaaaacactgcaagtatcatcatggtgaccaatcttgtggaagtgggaagggtcaaatgctgcaaatactggccagatgacacagagatatataaagacattaaagttaccctaatagaaacagaactactggcagaatatgtgataagaacatttgctgttgaaaagagaggtgtgcatgaaatccgagagatcagacagtttcacttcactggctggccggatcatggggtcccctaccatgccaccggcctgctgggattcgtgcggcaagtcaagtccaagagcccgcccagtgcaggcccactggtggtgcactgcagtgctggtgcagggaggactggctgtttcatcgtcattgatatcatgttggacatggccgaaagggaaggggtcgtagacatctacaactgcgtcagggagctgcggtcacggagggtgaacatggtgcaaacagaggagcagtatgtgtttatccacgatgcgatcctggaagcctgtctttgtggggacacctctgtgcctgcttcccaagttaggtctctgtattatgacatgaacaaactggatccacagacaaactcaagccagattaaagaggaattccggacgctaaacatggtgacaccaacgctgcgagtagaggactgcagcatcgcactgttgccccggaaccatgagaaaaaccggtgcatggacatcctgcccccagaccgctgcctgcccttcctcatcaccatcgatggggagagcagcaactacatcaatgctgccctcatggacagctataaacagccttcagcttttatagtcacccagcatcctttgccaaacacagtgaaagacttttggagactggtcctggattatcactgcacatccgtagttatgctaaatgatgtggatcctgcccagttgtgtccacagtactggccagaaaacggagtacacagacacggccccatccaggtggaatttgtctctgctgacctggaagaggacatcatcagcaggatattccgcatttacaatgccgccagaccccaagatggatatcggatggtgcagcaattccagttcctgggctggccgatgtacagggacacaccagtgtctaagcgctccttcttgaagctcattcgccaggtggacaagtggcaagaggagtacaatggcggggaaggccgcacggttgtgcactgcttgaacgggggaggccgcagtgggacgttctgcgccatcagcatcgtatgtgagatgctccggcaccagagaaccgtggatgtctttcacgctgtgaagacactgaggaacaacaagcccaacatggtcgacctcctggatcagtacaagttctgctacgaggtggccctggaatacttgaattctggctgatggtgtaaacagctctgcaaacaatccctttcataccacaaagccaagacgttccatggtatttgtgcaaaagagatgaagacttctcaatatgcttattttgctttgcataattggctctttttaagagcccaagaaagtgtttctaaaattgcttgcactgcccaatcccagtaatgctgctgcctgacagaaacacacacacagccacagttgccaaatcccgtactccttgccaccggcttcctagagcagcgtagacagctggtaaactgaagagcacaactatattcttatgaaggaatttgtacctttggggtattattttgtggcccgtgaccctcgttattgttacagctgagtgtatgtttttgttctgtggagaatgctatctggcattatggtaatatattattttaggtaatatttgtactttaacatgttgcataatatatgcttatgtagctttccaggactaacagataaatgtgtaatgaacaaagata

SEQ ID NO: 16978 - DNA, 6095 bp, Homo sapiens
  ENST00000332175
gcggcgtagagaagctcgcagccctccggagcctcagcgatctcctggctcgcttttcccgcagccgccgagcagcgcaggcccggcgactccgggtgcagctggccctgtgcggtgacatcgccgtccggcgccaggctcgaagccgcctggccgcgcccgcggggtcgcaggccgctggtcccgcccggccgcgctcacaaactactcgcggctcgtgacccgggacaaacttctggcggcggcgcagcctcttccacagtcaccctccccagagccagctaccaaaatagaagacgcggccggggcgaggaggtgggcggggggagcccggtggccgctcctccccgcgcggctgacgcccgcttcggcggcggtagtggctgtggccgcggggccgcccccagccgagctcccggaggcgctcgggcgcgggccggcggggcacgggcgctcacgccctctagcgggccgcggcggcgccgggcggccgtgacgtgagcgctcccttcagccggcctgcggggcaccgccagtcagtcggggagcaagagccccgcgcgcagccggcgcgggctcggtcatcggcgcgccgccgcccggggctgggcttggggctgcctgtggagaggcggcgggcggaacgcgcgcggccacggccacggccaccgccacggccacggccggcagctcgggtcccgggtcccgggcaggggaaggggagaggcggcgagctcagcaaccggaaccgagggaagattttggctccgcgggctcgccctccgctccctctgccagcggcgccagacgccgagtggggccagggacaggggaggaggacccaggaccctgtgcccgcgcccctggagccgctggagttcggacttctgcaactgttggcactttgggggcttggcttagcgctctgctgtttacccgtctctcctcgctgcctcggaaccaaagctcccggccccctccgccctcgcgcgcccacccaccgccgccggggagcggcccggcccgcactcagcaccatgaggggacttgggacttgcctggcgactttggccggacttttgctaactgcggcgggcgagacgttctcaggtggctgcctctttgatgagccgtatagcacatgtggatatagtcaatctgaaggtgatgacttcaattgggagcaagtgaacaccttgactaaaccgacttctgatccatggatgccatcaggttctttcatgctggtgaatgcctctgggagacctgaggggcagagagcccacctgctcttaccccaacttaaagaaaatgacacccactgcatcgattttcactattttgtgtccagcaagagtaattctcctccggggttactcaatgtctacgtgaaggtcaataacgggccactggggaatcctatctggaatatatctggagacccaacacgtacatggaacagggcagaactggccattagtactttctggcctaacttttatcaggtgatttttgaagtgataacttctggacatcaaggctatctcgctatcgatgaggtgaaggtgttaggacatccatgtaccaggactcctcacttcctgcggattcagaatgtggaagttaatgctggccagtttgctaccttccagtgcagtgccatcggcaggaccgtggcaggagacaggctctggttacagggcattgatgtgcgagatgctcctctgaaggaaatcaaggtgaccagctcccgacgcttcattgcttcatttaatgttgtgaataccaccaaacgagatgctggaaagtaccgctgcatgattcgcactgaaggaggtgttggaatatcaaactatgcagagttggtagttaaagaaccacccgttcctattgccccacctcagctcgcctctgtaggagccacctacctgtggatacagctcaacgccaactccatcaatggggatgggcccattgtggcccgagaggtggagtactgcacggccagtgggagctggaatgaccggcagccagtcgattccacgagctataaaattggacaccttgacccagatacagaatatgagattagtgtgctcctgaccaggccaggggagggtggcactggctctcctggtccagctctcaggacaagaacaaagtgtgctgatcccatgcgaggcccaagaaaactagaagtagtggaggtcaaatctcggcaaatcactatccgctgggagccatttggatataatgtaactcgttgccacagttataatctcactgtccactactgttaccaagttggaggacaagaacaagtgcgagaagaagtaagctgggatacagaaaactcacaccctcaacacacgatcactaacctgtcaccatacaccaatgtcagtgtgaaactgatcctcatgaacccagagggccggaaggaaagccaagaactcatagtgcagacagatgaagacctcccaggtgctgttcccactgaatccatacaaggaagtacctttgaagagaagatatttcttcagtggagagaaccaactcaaacatatggtgtaatcactttatatgagatcacctacaaagcagtcagttcctttgacccagaaatagatttatccaatcagagtggaagagtttcaaagctgggaaatgaaacccattttctgttttttggactgtatccggggaccacatactcctttaccatccgagctagcacagctaagggttttgggcctccagcaacaaaccagttcaccaccaaaatatcagcaccctctatgccagcttatgaacttgagacacctttgaatcaaactgacaataccgtgacagtcatgctgaaacctgcccacagcagaggagcacctgtcagtgtctatcaaatagttgttgaggaagaacgtcctcgaagaactaaaaagacgacagaaatcttaaagtgctacccagtgccaattcacttccagaatgcttctctgctgaactcacagtactactttgctgcagaatttcctgcagacagcctccaagctgcgcagccttttacaattggtgataataagacatataatggatactggaacactccccttctcccctataaaagctacagaatttatttccaagctgctagtagagccaatggggaaaccaaaatagactgtgtccaagtggccacaaaaggagctgccactccgaaaccagtcccagaacccgagaaacagacagaccatacagttaaaattgctggagtcatcgcgggcatcttgctgttcgtgattatatttcttggagttgtgttggtaatgaagaaaaggaaactggccaagaagcggaaagagaccatgagcagcacccgacaggagatgactgtgatggtgaactcaatggacaagagctatgctgagcagggcacaaactgcgacgaggctttctcattcatggacacgcacaatctgaatgggagatctgtgtcttcaccatcgtccttcacaatgaaaacaaatacactgagcacatcggtgcctaattcctattacccagatgaaacccacacaatggccagcgataccagcagcctggtgcagtcccatacttacaagaagcgagagccggccgacgtgccctatcagactgggcagctccaccccgccatccgggtggcagacctccttcagcacatcacacagatgaagtgtgcggagggctacggcttcaaggaggaatacgagagcttctttgaagggcagtctgcaccatgggactcggctaagaaagatgagaacagaatgaagaacagatacgggaatatcattgcatacgatcattcccgagtgaggctgcagacaatagaaggagacacaaactcagactatatcaatggcaattatatcgatggttatcatcgacccaatcattacattgctacccaagggccaatgcaggaaaccatctatgacttctggaggatggtgtggcacgaaaacactgcaagtatcatcatggtgaccaatcttgtggaagtgggaagggtcaaatgctgcaaatactggccagatgacacagagatatataaagacattaaagttaccctaatagaaacagaactactggcagaatatgtgataagaacatttgctgttgaaaagagaggtgtgcatgaaatccgagagatcagacagtttcacttcactggctggccggatcatggggtcccctaccatgccaccggcctgctgggattcgtgcggcaagtcaagtccaagagcccgcccagtgcaggcccactggtggtgcactgcagtgctggtgcagggaggactggctgtttcatcgtcattgatatcatgttggacatggccgaaagggaaggggtcgtagacatctacaactgcgtcagggagctgcggtcacggagggtgaacatggtgcaaacagaggagcagtatgtgtttatccacgatgcgatcctggaagcctgtctttgtggggacacctctgtgcctgcttcccaagttaggtctctgtattatgacatgaacaaactggatccacagacaaactcaagccagattaaagaggaattccggacgctaaacatggtgacaccaacgctgcgagtagaggactgcagcatcgcactgttgccccggaaccatgagaaaaaccggtgcatggacatcctgcccccagaccgctgcctgcccttcctcatcaccatcgatggggagagcagcaactacatcaatgctgccctcatggacagctataaacagccttcagcttttatagtcacccagcatcctttgccaaacacagtgaaagacttttggagactggtcctggattatcactgcacatccgtagttatgctaaatgatgtggatcctgcccagttgtgtccacagtactggccagaaaacggagtacacagacacggccccatccaggtggaatttgtctctgctgacctggaagaggacatcatcagcaggatattccgcatttacaatgccgccagaccccaagatggatatcggatggtgcagcaattccagttcctgggctggccgatgtacagggacacaccagtgtctaagcgctccttcttgaagctcattcgccaggtggacaagtggcaagaggagtacaatggcggggaaggccgcacggttgtgcactgcttgaacgggggaggccgcagtgggacgttctgcgccatcagcatcgtatgtgagatgctccggcaccagagaaccgtggatgtctttcacgctgtgaagacactgaggaacaacaagcccaacatggtcgacctcctggatcagtacaagttctgctacgaggtggccctggaatacttgaattctggctgatggtgtaaacagctctgcaaacaatccctttcataccacaaagccaagacgttccatggtatttgtgcaaaagagatgaagacttctcaatatgcttattttgctttgcataattggctctttttaagagcccaagaaagtgtttctaaaattgcttgcactgcccaatcccagtaatgctgctgcctgacagaaacacacacacagccacagttgccaaatcccgtactccttgccaccggcttcctagagcagcgtagacagctggtaaactgaagagcacaactatattcttatgaaggaatttgtacctttggggtattattttgtggcccgtgaccctcgttattgttacagctgagtgtatgtttttgttctgtggagaatgctatctggcattatggtaatatattattttaggtaatatttgtactttaacatgttgcataatatatgcttatgtagctttccaggactaacagataaatgtgtaatgaacaaagatatgttgtatgagtcgtcgtttctgtcagatttgtattgtttccaagggaaaagcttgggggaggactcagttcacaaaatgcaaaactcaacgatcagattcacggacccagagcttttccatgtgtttatattgtaaatatttttgatttcatcaaattatttattcattaaaagaaatttttgtgaagcaca

SEQ ID NO: 16979 - DNA, 5292 bp, Homo sapiens
  ENST00000400053
gtgctgtggcccaatcctgtgcgtgtctcctcttcaggctcctgccggagcatgcttctctaatcttaccatttatcactgacccttcggtgaaactctcttctgtttaaatttaccagggtacactttgtaatacttgggaccaagaatttgaagatagtaatcagacaaatcaaacaactagtagtagtggagagacacgtagccctacaggaaggggtagaattatcattaaaaacacagacaaaccagagactgcctgaaaaaaaaaaaaagatgaactggaaagattcaaagtaggctctattggaggtggctgcctctttgatgagccgtatagcacatgtggatatagtcaatctgaaggtgatgacttcaattgggagcaagtgaacaccttgactaaaccgacttctgatccatggatgccatcaggttctttcatgctggtgaatgcctctgggagacctgaggggcagagagcccacctgctcttaccccaacttaaagaaaatgacacccactgcatcgattttcactattttgtgtccagcaagagtaattctcctccggggttactcaatgtctacgtgaaggtcaataacgggccactggggaatcctatctggaatatatctggagacccaacacgtacatggaacagggcagaactggccattagtactttctggcctaacttttatcaggtgatttttgaagtgataacttctggacatcaaggctatctcgctatcgatgaggtgaaggtgttaggacatccatgtaccaggactcctcacttcctgcggattcagaatgtggaagttaatgctggccagtttgctaccttccagtgcagtgccatcggcaggaccgtggcaggagacaggctctggttacagggcattgatgtgcgagatgctcctctgaaggaaatcaaggtgaccagctcccgacgcttcattgcttcatttaatgttgtgaataccaccaaacgagatgctggaaagtaccgctgcatgattcgcactgaaggaggtgttggaatatcaaactatgcagagttggtagttaaagaaccacccgttcctattgccccacctcagctcgcctctgtaggagccacctacctgtggatacagctcaacgccaactccatcaatggggatgggcccattgtggcccgagaggtggagtactgcacggccagtgggagctggaatgaccggcagccagtcgattccacgagctataaaattggacaccttgacccagatacagaatatgagattagtgtgctcctgaccaggccaggggagggtggcactggctctcctggtccagctctcaggacaagaacaaagtgtgctgatcccatgcgaggcccaagaaaactagaagtagtggaggtcaaatctcggcaaatcactatccgctgggagccatttggatataatgtaactcgttgccacagttataatctcactgtccactactgttaccaagttggaggacaagaacaagtgcgagaagaagtaagctgggatacagaaaactcacaccctcaacacacgatcactaacctgtcaccatacaccaatgtcagtgtgaaactgatcctcatgaacccagagggccggaaggaaagccaagaactcatagtgcagacagatgaagacctcccaggtgctgttcccactgaatccatacaaggaagtacctttgaagagaagatatttcttcagtggagagaaccaactcaaacatatggtgtaatcactttatatgagatcacctacaaagcagtcagttcctttgacccagaaatagatttatccaatcagagtggaagagtttcaaagctgggaaatgaaacccattttctgttttttggactgtatccggggaccacatactcctttaccatccgagctagcacagctaagggttttgggcctccagcaacaaaccagttcaccaccaaaatatcagcaccctctatgccagcttatgaacttgagacacctttgaatcaaactgacaataccgtgacagtcatgctgaaacctgcccacagcagaggagcacctgtcagtgtctatcaaatagttgttgaggaagaacgtcctcgaagaactaaaaagacgacagaaatcttaaagtgctacccagtgccaattcacttccagaatgcttctctgctgaactcacagtactactttgctgcagaatttcctgcagacagcctccaagctgcgcagccttttacaattggtgataataagacatataatggatactggaacactccccttctcccctataaaagctacagaatttatttccaagctgctagtagagccaatggggaaaccaaaatagactgtgtccaagtggccacaaaaggagctgccactccgaaaccagtcccagaacccgagaaacagacagaccatacagttaaaattgctggagtcatcgcgggcatcttgctgttcgtgattatatttcttggagttgtgttggtaatgaagaaaaggaaactggccaagaagcggaaagagaccatgagcagcacccgacaggagatgactgtgatggtgaactcaatggacaagagctatgctgagcagggcacaaactgcgacgaggctttctcattcatggacacgcacaatctgaatgggagatctgtgtcttcaccatcgtccttcacaatgaaaacaaatacactgagcacatcggtgcctaattcctattacccagatgaaacccacacaatggccagcgataccagcagcctggtgcagtcccatacttacaagaagcgagagccggccgacgtgccctatcagactgggcagctccaccccgccatccgggtggcagacctccttcagcacatcacacagatgaagtgtgcggagggctacggcttcaaggaggaatacgagagcttctttgaagggcagtctgcaccatgggactcggctaagaaagatgagaacagaatgaagaacagatacgggaatatcattgcatacgatcattcccgagtgaggctgcagacaatagaaggagacacaaactcagactatatcaatggcaattatatcgatggttatcatcgacccaatcattacattgctacccaagggccaatgcaggaaaccatctatgacttctggaggatggtgtggcacgaaaacactgcaagtatcatcatggtgaccaatcttgtggaagtgggaagggtcaaatgctgcaaatactggccagatgacacagagatatataaagacattaaagttaccctaatagaaacagaactactggcagaatatgtgataagaacatttgctgttgaaaagagaggtgtgcatgaaatccgagagatcagacagtttcacttcactggctggccggatcatggggtcccctaccatgccaccggcctgctgggattcgtgcggcaagtcaagtccaagagcccgcccagtgcaggcccactggtggtgcactgcagtgctggtgcagggaggactggctgtttcatcgtcattgatatcatgttggacatggccgaaagggaaggggtcgtagacatctacaactgcgtcagggagctgcggtcacggagggtgaacatggtgcaaacagaggagcagtatgtgtttatccacgatgcgatcctggaagcctgtctttgtggggacacctctgtgcctgcttcccaagttaggtctctgtattatgacatgaacaaactggatccacagacaaactcaagccagattaaagaggaattccggacgctaaacatggtgacaccaacgctgcgagtagaggactgcagcatcgcactgttgccccggaaccatgagaaaaaccggtgcatggacatcctgcccccagaccgctgcctgcccttcctcatcaccatcgatggggagagcagcaactacatcaatgctgccctcatggacagctataaacagccttcagcttttatagtcacccagcatcctttgccaaacacagtgaaagacttttggagactggtcctggattatcactgcacatccgtagttatgctaaatgatgtggatcctgcccagttgtgtccacagtactggccagaaaacggagtacacagacacggccccatccaggtggaatttgtctctgctgacctggaagaggacatcatcagcaggatattccgcatttacaatgccgccagaccccaagatggatatcggatggtgcagcaattccagttcctgggctggccgatgtacagggacacaccagtgtctaagcgctccttcttgaagctcattcgccaggtggacaagtggcaagaggagtacaatggcggggaaggccgcacggttgtgcactgcttgaacgggggaggccgcagtgggacgttctgcgccatcagcatcgtatgtgagatgctccggcaccagagaaccgtggatgtctttcacgctgtgaagacactgaggaacaacaagcccaacatggtcgacctcctggatcagtacaagttctgctacgaggtggccctggaatacttgaattctggctgatggtgtaaacagctctgcaaacaatccctttcataccacaaagccaagacgttccatggtatttgtgcaaaagagatgaagacttctcaatatgcttattttgctttgcataattggctctttttaagagcccaagaaagtgtttctaaaattgcttgcactgcccaatcccagtaatgctgctgcctgacagaaacacacacacagccacagttgccaaatcccgtactccttgccaccggcttcctagagcagcgtagacagctggtaaactgaagagcacaactatattcttatgaaggaatttgtacctttggggtattattttgtggcccgtgaccctcgttattgttacagctgagtgtatgtttttgttctgtggagaatgctatctggcattatggtaatatattattttaggtaatatttgtactttaacatgttgcataatatatgcttatgtagctttccaggactaacagataaatgtgtaatgaacaaagatatgttgtatgagtcgtcgtttctgtcagatttgtattgtttccaagggaaaagcttgggggaggactcagttcacaaaatgcaaaactcaacgatcagattcacggacccagagcttttccatgtgtttatattgtaaatatttttgatttcatcaaattatttattcattaaaagaaatttttgtgaa

SEQ ID NO: 16980 - DNA, 604 bp, Homo sapiens
  ENST00000578916
tttctcactgcccaagctgaagctgcctgggaggaagggctgagcatgcctagcccagccccttctttggggagctgactgcctatgggaaccctctccctccatcctggcattgatgtgcgagatgctcctctgaaggaaatcaaggtgaccagctcccgacgcttcattgcttcatttaatgttgtgaataccaccaaacgagatgctggaaagtaccgctgcatgattcgcactgaaggaggtgttggaatatcaaactatgcagagttggtagttaaagaaccacccgttcctattgccccacctcagctcgcctctgtaggagccacctacctgtggatacagctcaacgccaactccatcaatggggatgggcccattgtggcccgagaggtggagtactgcacggccagtgggagctggaatgaccggcagccagtcgattccacgagctataaaattggacaccttgacccagatacagaatatgagattagtgtgctcctgaccaggccaggggagggtggcactggctctcctggtccagctctcaggacaagaacaaagtgtgctgatcccatgcgaggcccaagaaaactag

SEQ ID NO: 16981 - DNA, 578 bp, Homo sapiens
  ENST00000578600
aagaactttgtagctcaaaggtctctgcactacatccaccaagcattcatggaaaacctgggacgtaaatagggaactgtgcttgggaagtacagagataaaacaattctggccccacctcgcaaggagcttacagccttaaaaagaatgatcatagaaactgttaggtacaaatggaaacttcttgctaaatacaagaactactaaaatgttacatgacccaagagaatgggccaatgctgaagcccatgtcagctaaggctgaggtgaggaagtggtctttttgccaagccttgaaggacagatcccatgcgaggcccaagaaaactagaagtagtggaggtcaaatctcggcaaatcactatccgctgggagccatttggatataatgtaactcgttgccacagttataatctcactgtccactactgttaccaagttggaggacaagaacaagtgcgagaagaagtaagctgggatacagaaaactcacaccctcaacacacgatcactaacctgtcaccatacaccaatgtcagtgtgaaactgatcctcatgaacccagagggccggaagga

SEQ ID NO: 16982 - DNA, 1106 bp, Homo sapiens
  ENST00000578571
acatccaccaagcattcatggaaaacctgggacgtaaatagggaactgtgcttgggaagtacagagataaaacaattctggccccacctcgcaaggagcttacagccttaaaaagaatgatcatagaaactgttaggtacaaatggaaacttcttgctaaatacaagaactactaaaatgttacatgacccaagagaatgggccaatgctgaagcccatgtcagctaaggctgagatcccatgcgaggcccaagaaaactagaagtagtggaggtcaaatctcggcaaatcactatccgctgggagccatttggatataatgtaactcgttgccacagttataatctcactgtccactactgttaccaagttggaggacaagaacaagtgcgagaagaagtaagctgggatacagaaaactcacaccctcaacacacgatcactaacctgtcaccatacaccaatgtcagtgtgaaactgatcctcatgaacccagagggccggaaggaaagccaagaactcatagtgcagacagatgaagacctcccaggtgctgttcccactgaatccatacaaggaagtacctttgaagagaagatatttcttcagtggagagaaccaactcaaacatatggtgtaatcactttatatgagatcacctacaaagcagtcagttcctttgacccagaaatagatttatccaatcagagtggaagagtttcaaagctgggaaatgaaacccattttctgttttttggactgtatccggggaccacatactcctttaccatccgagctagcacagctaagggttttgggcctccagcaacaaaccagttcaccaccaaaatatcagcaccctctatgccagcttatgaacttgagacacctttgaatcaaactgacaataccgtgacagtcatgctgaaacctgcccacagcagaggagcacctgtcagtgtctatcaaatagttgttgaggaagaacgtcctcgaagaactaaaaagacgacagaaatcttaaagtgctacccagtgccaattcacttccagaatgcttctctgctgaactcacagtactactttgctgcagaatttcctgcaga

SEQ ID NO: 16983 - DNA, 486 bp, Homo sapiens
  ENST00000578698
acagaaaagcacaacagagatgtgagtcacaacacagaaacttggaaaggcttttcacagaaaatagatcccatgcgaggcccaagaaaactagaagtagtggaggtcaaatctcggcaaatcactatccgctgggagccatttggatataatgtaactcgttgccacagttataatctcactgtccactactgttaccaagttggaggacaagaacaagtgcgagaagaagtaagctgggatacagaaaactcacaccctcaacacacgatcactaacctgtcaccatacaccaatgtcagtgtgaaactgatcctcatgaacccagagggccggaaggaaagccaagaactcatagtgcagacagatgaagacctcccaggtgctgttcccactgaatccatacaaggaagtacctttgaagagaagatatttcttcagtggagagaaccaactcaaacatatggtgtaatcactttatatgag

SEQ ID NO: 16984 - DNA, 792 bp, Homo sapiens
  ENST00000583289
cagaaatagatttatccaatcagagtggaagagtttcaaagctgggaaatgaaacccattttctgttttttggactgtatccggggaccacatactcctttaccatccgagctagcacagctaagggttttgggcctccagcaacaaaccagttcaccaccaaaatatcagcaccctctatgccagcttatgaacttgagacacctttgaatcaaactgacaataccgtgacagtcatgctgaaacctgcccacagcagaggagcacctgtcagtgtctatcaaatagttgttgaggaagaacgtcctcgaagaactaaaaagacgacagaaatcttaaagtgctacccagtgccaattcacttccagaatgcttctctgctgaactcacagtactactttgctgcagaatttcctgcagacagcctccaagctgcgcagccttttacaattggtgataataagacatataatggatactggaacactccccttctcccctataaaagctacagaatttatttccaagctgctagtagagccaatggggaaaccaaaatagactgtgtccaagtggccacaaaagctgcgataatcgtgactcagcttacaacaccttacattcgcatcgcccccgctgcaggcgacggccaactaacaggagctgccactccgaaaccagtcccagaacccgagaaacagacagaccatacagttaaaattgctggagtcatcgcgggcatcttgctgttcgtgattatatttcttggagttgtgttggtaatgaagaaaa

SEQ ID NO: 16985 - DNA, 701 bp, Homo sapiens
  ENST00000577468
cacttccagaatgcttctctgctgaactcacagtactactttgctgcagaatttcctgcagacagcctccaagctgcgcagccttttacaattggtgataataagacatataatggatactggaacactccccttctcccctataaaagctacagaatttatttccaagctgctagtagagccaatggggaaaccaaaatagactgtgtccaagtggccacaaaaggagctgccactccgaaaccagtcccagaacccgagaaacagacagaccatacagttaaaattgctggagtcatcgcgggcatcttgctgttcgtgattatatttcttggagttgtgttggtaatgaagaaaaggaaactggccaagaagcggaaagagaccatgagcagcacccgacaggagatgactgtgatggtgaactcaatggacaagagctatgctgagcagggcacaaactgcgacgaggctttctcattcatggacacgcacaatctgaatgggagatctgtgtcttcaccatcgtccttcacaatgaaaacaaatacactgagcacatcggtgcctaattcctattacccagacccatttgtgccaactgcaattttagagcttctttgaagggcagtctgcaccatgggactcggctaagaaagatgagaacagaatgaagaacagatacgggaatatcattgcat

SEQ ID NO: 16986 - DNA, 4640 bp, Homo sapiens
  ENST00000577827
accagaattaacaatgaatctttcagcaccacactcaatttcaattggaaacactgctcagtcttcacctttatttaggatgaatgtttttggttttgttttcctttttttcttcttcagttgatctatccaagatctcagccaaaccttgcaactgtgtcatagttagaaatccaactgcctgactagagcttgtttaagggaaaagaattcagaatattcagcaccttgctatgttttttttttctttttttccttttctttttgttgttgttagaacaaagttgagacaatttgatatactgatggggattcttcttgctagcctagcttcagtctggcttttttttccctcatgcatgctgacctggaaatcctcctttgccttagctgcgataatcgtgactcagcttacaacaccttacattcgcatcgcccccgctgcaggcgacggccaactaacaggagctgccactccgaaaccagtcccagaacccgagaaacagacagaccatacagttaaaattgctggagtcatcgcgggcatcttgctgttcgtgattatatttcttggagttgtgttggtaatgaagaaaaggaaactggccaagaagcggaaagagaccatgagcagcacccgacaggagatgactgtgatggtgaactcaatggacaagagctatgctgagcagggcacaaactgcgacgaggctttctcattcatggacacgcacaatctgaatgggagatctgtgtcttcaccatcgtccttcacaatgaaaacaaatacactgagcacatcggtgcctaattcctattacccagagcttctttgaagggcagtctgcaccatgggactcggctaagaaagatgagaacagaatgaagaacagatacgggaatatcattgcatacgatcattcccgagtgaggctgcagacaatagaaggagacacaaactcagactatatcaatggcaattatatcgatggttatcatcgacccaatcattacattgctacccaagggccaatgcaggaaaccatctatgacttctggaggatggtgtggcacgaaaacactgcaagtatcatcatggtgaccaatcttgtggaagtgggaagggtcaaatgctgcaaatactggccagatgacacagagatatataaagacattaaagttaccctaatagaaacagaactactggcagaatatgtgataagaacatttgctgttgaaaagagaggtgtgcatgaaatccgagagatcagacagtttcacttcactggctggccggatcatggggtcccctaccatgccaccggcctgctgggattcgtgcggcaagtcaagtccaagagcccgcccagtgcaggcccactggtggtgcactgcagtgctggtgcagggaggactggctgtttcatcgtcattgatatcatgttggacatggccgaaagggaaggggtcgtagacatctacaactgcgtcagggagctgcggtcacggagggtgaacatggtgcaaacagaggtactcccgctcatcacctagcctggggccttggtccctgggctccctcctgcatctccccatttcagggccaagggcacaaggaatccaggcaattatctgttcaagtgatctacctggcattccctgttccttccctccctccctcccttccccctttttgtttttcctctcataaacaaaccaaacaaacccaggagttttccaggtaacagaatcaagagcccaaatttgcacacttttctgtattaagggacccaaaaaagtctctgttaagtgctcagactttcaataccatttccttttattatctcttttaaactagctggtaaccagagcaagaccgctcctgagaatagtggctgaagggttatctctgtgcactttgttcttctcccagggtcctgggaagaacagaagcctcctgaccctaaaaattctgcccagtgtctggcgtcctggggatttgcccattttgtgaagtactgtatactaactagtaactctgtaagtggaaattcaaggtatatcgggaatttccattttttcagaagcaatgttacatcctgctcttaggacattcgtatttttactcatatttgattgttttaagtaggcgtcacaccgaccacctggaaaatgattcatgaagtgaagtgaagaagaagtaagaatcccttacatttagatggtgcatttaagtttatgaaagcctctgggaaacctaatcccatttttttagctaacataaaaataacagaaactttaaatgctgctttcatgggttcttttccttagaaaggggatactgtgtttgaaagataataatcgtaataatttatcttttaatgtactttatagtcaatcaaatgttgccactcgcatttctcacttggatcttccattttcaggtgttgtttactggtagtgtgctgtttttgggaatcaatctgttggacaagaggttgttgaaaaaaaataattaaaggtcatatttatgtatagaaaaaaccgaattaactgtaataagaggctttttaaacttcccatataactaaagattaataataaatatgataagactctaccaatgaattttaagaaaagtcagtgccaaatcagaattagaggccccatatttacactgtgaactcattgaagatatatatgagaacagctctctgtacttctaagaggtttcataatcatattaacttttatgttctgaaataagaacttctaagtacttttatgttttgaattaagaacttccagacttcttgtcttcacagtaatgccaagtttttctggaccttctttgcactattattttgaccagcaaatcctaccatagacaaaattctgctcattcctcatgtgaaatactgagttccaagtgagtaggatcagaatgacagaggtcttcagccacagttttcatggtgctgcagtgcgtgtggtggtttgtattgggtccgattggttttaatcaatctgtgtaatatttggcattgcaccccagtctcctagcacttgagcccttggaccgtgtttctctctggaggaactgtctccactctcttgatgatgtggggctaaaattgataccgtctttcctccttctctggttctctaaagttagtaactcgttccatctccttctccaggagcagtatgtgtttatccacgatgcgatcctggaagcctgtctttgtggggacacctctgtgcctgcttcccaagttaggtctctgtattatgacatgaacaaactggatccacagacaaactcaagccagattaaagaggaattccggacgctaaacatggtgacaccaacgctgcgagtagaggactgcagcatcgcactgttgccccggaaccatgagaaaaaccggtgcatggacatcctgcccccagaccgctgcctgcccttcctcatcaccatcgatggggagagcagcaactacatcaatgctgccctcatggacagctataaacagccttcagcttttatagtcacccagcatcctttgccaaacacagtgaaagacttttggagactggtcctggattatcactgcacatccgtagttatgctaaatgatgtggatcctgcccagttgtgtccacagtactggccagaaaacggagtacacagacacggccccatccaggtggaatttgtctctgctgacctggaagaggacatcatcagcaggatattccgcatttacaatgccgccagaccccaagatggatatcggatggtgcagcaattccagttcctgggctggccgatgtacagggacacaccagtgtctaagcgctccttcttgaagctcattcgccaggtggacaagtggcaagaggagtacaatggcggggaaggccgcacggttgtgcactgcttgaacgggggaggccgcagtgggacgttctgcgccatcagcatcgtatgtgagatgctccggcaccagagaaccgtggatgtctttcacgctgtgaagacactgaggaacaacaagcccaacatggtcgacctcctggatcagtacaagttctgctacgaggtggccctggaatacttgaattctggctgatggtgtaaacagctctgcaaacaatccctttcataccacaaagccaagacgttccatggtatttgtgcaaaagagatgaagacttctcaatatgcttattttgctttgcataattggctctttttaagagcccaagaaagtgtttctaaaattgcttgcactgcccaatcccagtaatgctgctgcctgacagaaacacacacacagccacagttgccaaatcccgtactccttgccaccggcttcctagagcagcgtagacagctggtaaactgaagagcacaactatattcttatgaaggaatttgtacctttggggtattattttgtggcccgtgaccctcgttattgttacagctgagtgtatgtttttgttctgtggagaatgctatctggcattatggtaatatattattttaggtaatatttgtactttaacatgttgcataatatatgcttatgtagctttccaggactaacagataaatgtgtaatgaacaaaga

SEQ ID NO: 16987 - DNA, 464 bp, Homo sapiens
  ENST00000578093
ggaaactggccaagaagcggaaagagaccatgagcagcacccgacaggagatgactgtgatggtgaactcaatggacaagagctatgctgagcagggcacaaactgcgacgaggctttctcattcatggacacgcacaatctgaatgggagatctgtgtcttcaccatcgtccttcacaatgaaaacaaatacactgagcacatcggtgcctaattcctattacccagacccatttgtgccaactgcaattttagccacgttgtagtgatccaggtgccatttcagcaacagcaacatagctacacacttgtgtaccacctttcataccatgcatccccaggtgctttgcgatgcagatagaagtgaggttcccaaaccaggccctgctcatcaagcacccttggactaaattttcttcagagctgaacttctccgtaaaaaataaataacatatgaataacta

SEQ ID NO: 16988 - DNA, 676 bp, Homo sapiens
  ENST00000580838
aaaacaaatacactgagcacatcggtgcctaattcctattacccagatgaaacccacacaatggccagcgataccagcagcctggtgcagtcccatacttacaagaagcgagagccggccgacgtgccctatcagactgggcagctccaccccgccatccgggtggcagacctccttcagcacatcacacagatgaagtgtgcggagggctacggcttcaaggaggaatacgaggacccactacaaagcagtcaatgacattttcgatatgaaacaaagacataagcaacaaaaccaaaagtagcaagtaggtttatatcaaagtacaaaacttctgtacagcaaaggaaacaatcaacaaagagaaaaagcaacctacagaatgagagcatatatttgaagaccgtatatctgataagagggttaatattcaagatatataagaaattcatacaactcaatagcaaaaaaaaaaaaatccttaagaatgagcaaataacctgatacatttttccaaggaagatatacaaatggtcaataggtataataaaaggtgattaacatcactaatcatcaaggaaatgcaaatcaaaaccacaatgagatatcacctcacacctttcagaatgacaaatcaacctaagtgttggcaaggatgtggaggaaaaggaactct

SEQ ID NO: 16989 - DNA, 713 bp, Homo sapiens
  ENST00000583153
aagacattaaagttaccctaatagaaacagaactactggcagaatatgtgataagaacatttgctgttgaaaagggaggggccggaggtgaagcaaactgcagtccatccagagaagtgtcacagagaggtgtgcatgaaatccgagagatcagacagtttcacttcactggctggccggatcatggggtcccctaccatgccaccggcctgctgggattcgtgcggcaagtcaagtccaagagcccgcccagtgcaggcccactggtggtgcactgcagtgctggtgcagggaggactggctgtttcatcgtcattgatatcatgttggacatggccgaaagggaaggggtcgtagacatctacaactgcgtcagggagctgcggtcacggagggtgaacatggtgcaaacagaggagcagtatgtgtttatccacgatgcgatcctggaagcctgtctttgtggggacacctctgtgcctgcttcccaagttaggtctctgtattatgacatgaacaaactggatccacagacaaactcaagccagattaaagaggaattccggacgctaaacatggtgacaccaacgctgcgagtagaggactgcagcatcgcactgttgccccggaaccatgagaaaaaccggtgcatggacatcctgcccccagaccgctgcctgcccttcctcatcaccatcgatggggagagcagc

SEQ ID NO: 16990 - DNA, 687 bp, Homo sapiens
  ENST00000580949
agatccggatccctcctcccagctccaagcctgctgatgttcaaccaccctacaaggagccccccaagctttctcccagcctagaggctggacaccagcggggctctcagggttcatgatgtgtggaaaaggatcagtacaagttctgctacgaggtggccctggaatacttgaattctggctgatggtgtaaacagctctgcaaacaatccctttcataccacaaagccaagacgttccatggtatttgtgcaaaagagatgaagacttctcaatatgcttattttgctttgcataattggctctttttaagagcccaagaaagtgtttctaaaattgcttgcactgcccaatcccagtaatgctgctgcctgacagaaacacacacacagccacagttgccaaatcccgtactccttgccaccggcttcctagagcagcgtagacagctggtaaactgaagagcacaactatattcttatgaaggaatttgtacctttggggtattattttgtggcccgtgaccctcgttattgttacagctgagtgtatgtttttgttctgtggagaatgctatctggcattatggtaatatattattttaggtaatatttgtactttaacatgttgcataatatatgcttatgtagctttccaggactaacagataaatgtgtaatgaacaaa

SEQ ID NO: 16991 - DNA, 5030 bp, Homo sapiens
  ENST00000400060
acattttaggtggctgcctctttgatgagccgtatagcacatgtggatatagtcaatctgaaggtgatgacttcaattgggagcaagtgaacaccttgactaaaccgacttctgatccatggatgccatcaggttctttcatgctggtgaatgcctctgggagacctgaggggcagagagcccacctgctcttaccccaacttaaagaaaatgacacccactgcatcgattttcactattttgtgtccagcaagagtaattctcctccggggttactcaatgtctacgtgaaggtcaataacgggccactggggaatcctatctggaatatatctggagacccaacacgtacatggaacagggcagaactggccattagtactttctggcctaacttttatcaggtgatttttgaagtgataacttctggacatcaaggctatctcgctatcgatgaggtgaaggtgttaggacatccatgtaccaggactcctcacttcctgcggattcagaatgtggaagttaatgctggccagtttgctaccttccagtgcagtgccatcggcaggaccgtggcaggagacaggctctggttacagggcattgatgtgcgagatgctcctctgaaggaaatcaaggtgaccagctcccgacgcttcattgcttcatttaatgttgtgaataccaccaaacgagatgctggaaagtaccgctgcatgattcgcactgaaggaggtgttggaatatcaaactatgcagagttggtagttaaagaaccacccgttcctattgccccacctcagctcgcctctgtaggagccacctacctgtggatacagctcaacgccaactccatcaatggggatgggcccattgtggcccgagaggtggagtactgcacggccagtgggagctggaatgaccggcagccagtcgattccacgagctataaaattggacaccttgacccagatacagaatatgagattagtgtgctcctgaccaggccaggggagggtggcactggctctcctggtccagctctcaggacaagaacaaagtgtgctgatcccatgcgaggcccaagaaaactagaagtagtggaggtcaaatctcggcaaatcactatccgctgggagccatttggatataatgtaactcgttgccacagttataatctcactgtccactactgttaccaagttggaggacaagaacaagtgcgagaagaagtaagctgggatacagaaaactcacaccctcaacacacgatcactaacctgtcaccatacaccaatgtcagtgtgaaactgatcctcatgaacccagagggccggaaggaaagccaagaactcatagtgcagacagatgaagacctcccaggtgctgttcccactgaatccatacaaggaagtacctttgaagagaagatatttcttcagtggagagaaccaactcaaacatatggtgtaatcactttatatgagatcacctacaaagcagtcagttcctttgacccagaaatagatttatccaatcagagtggaagagtttcaaagctgggaaatgaaacccattttctgttttttggactgtatccggggaccacatactcctttaccatccgagctagcacagctaagggttttgggcctccagcaacaaaccagttcaccaccaaaatatcagcaccctctatgccagcttatgaacttgagacacctttgaatcaaactgacaataccgtgacagtcatgctgaaacctgcccacagcagaggagcacctgtcagtgtctatcaaatagttgttgaggaagaacgtcctcgaagaactaaaaagacgacagaaatcttaaagtgctacccagtgccaattcacttccagaatgcttctctgctgaactcacagtactactttgctgcagaatttcctgcagacagcctccaagctgcgcagccttttacaattggtgataataagacatataatggatactggaacactccccttctcccctataaaagctacagaatttatttccaagctgctagtagagccaatggggaaaccaaaatagactgtgtccaagtggccacaaaaggagctgccactccgaaaccagtcccagaacccgagaaacagacagaccatacagttaaaattgctggagtcatcgcgggcatcttgctgttcgtgattatatttcttggagttgtgttggtaatgaagaaaaggaaactggccaagaagcggaaagagaccatgagcagcacccgacaggagatgactgtgatggtgaactcaatggacaagagctatgctgagcagggcacaaactgcgacgaggctttctcattcatggacacgcacaatctgaatgggagatctgtgtcttcaccatcgtccttcacaatgaaaacaaatacactgagcacatcggtgcctaattcctattacccagacccatttgtgccaactgcaattttagtgccaataaatgatgaaacccacacaatggccagcgataccagcagcctggtgcagtcccatacttacaagaagcgagagccggccgacgtgccctatcagactgggcagctccaccccgccatccgggtggcagacctccttcagcacatcacacagatgaagtgtgcggagggctacggcttcaaggaggaatacgagagcttctttgaagggcagtctgcaccatgggactcggctaagaaagatgagaacagaatgaagaacagatacgggaatatcattgcatacgatcattcccgagtgaggctgcagacaatagaaggagacacaaactcagactatatcaatggcaattatatcgatggttatcatcgacccaatcattacattgctacccaagggccaatgcaggaaaccatctatgacttctggaggatggtgtggcacgaaaacactgcaagtatcatcatggtgaccaatcttgtggaagtgggaagggtcaaatgctgcaaatactggccagatgacacagagatatataaagacattaaagttaccctaatagaaacagaactactggcagaatatgtgataagaacatttgctgttgaaaagagaggtgtgcatgaaatccgagagatcagacagtttcacttcactggctggccggatcatggggtcccctaccatgccaccggcctgctgggattcgtgcggcaagtcaagtccaagagcccgcccagtgcaggcccactggtggtgcactgcagtgctggtgcagggaggactggctgtttcatcgtcattgatatcatgttggacatggccgaaagggaaggggtcgtagacatctacaactgcgtcagggagctgcggtcacggagggtgaacatggtgcaaacagaggagcagtatgtgtttatccacgatgcgatcctggaagcctgtctttgtggggacacctctgtgcctgcttcccaagttaggtctctgtattatgacatgaacaaactggatccacagacaaactcaagccagattaaagaggaattccggacgctaaacatggtgacaccaacgctgcgagtagaggactgcagcatcgcactgttgccccggaaccatgagaaaaaccggtgcatggacatcctgcccccagaccgctgcctgcccttcctcatcaccatcgatggggagagcagcaactacatcaatgctgccctcatggacagctataaacagccttcagcttttatagtcacccagcatcctttgccaaacacagtgaaagacttttggagactggtcctggattatcactgcacatccgtagttatgctaaatgatgtggatcctgcccagttgtgtccacagtactggccagaaaacggagtacacagacacggccccatccaggtggaatttgtctctgctgacctggaagaggacatcatcagcaggatattccgcatttacaatgccgccagaccccaagatggatatcggatggtgcagcaattccagttcctgggctggccgatgtacagggacacaccagtgtctaagcgctccttcttgaagctcattcgccaggtggacaagtggcaagaggagtacaatggcggggaaggccgcacggttgtgcactgcttgaacgggggaggccgcagtgggacgttctgcgccatcagcatcgtatgtgagatgctccggcaccagagaaccgtggatgtctttcacgctgtgaagacactgaggaacaacaagcccaacatggtcgacctcctggatcagtacaagttctgctacgaggtggccctggaatacttgaattctggctgatggtgtaaacagctctgcaaacaatccctttcataccacaaagccaagacgttccatggtatttgtgcaaaagagatgaagacttctcaatatgcttattttgctttgcataattggctctttttaagagcccaagaaagtgtttctaaaattgcttgcactgcccaatcccagtaatgctgctgcctgacagaaacacacacacagccacagttgccaaatcccgtactccttgccaccggcttcctagagcagcgtagacagctggtaaactgaagagcacaactatattcttatgaaggaatttgtacctttggggtattattttgtggcccgtgaccctcgttattgttacagctgagtgtatgtttttgttctgtggagaatgctatctggcattatggtaatatattattttaggtaatatttgtactttaacatgttgcataatatatgcttatgtagctttccaggactaacagataaatgtgtaatgaacaaagatatgttgtatgagtcgtcgtttctgtcagatttgtattgtttccaagggaaaagcttgggggaggactcagttcacaaaatgcaaaactcaacgatcagattcacggacccagagcttttccatgtgtttatattgtaaatatttttgatttcatcaaattatttattcattaaaagaaatttttgtgaagc

SEQ ID NO: 16992 - DNA, 3622 bp, Homo sapiens
  ENST00000409251
gtcgtcagcacccgcctgcggttggccgcgttgcagcgagaggggcatgtagaccccgcctcgtagggaggtggggagcggcaagccccgcctcagcccctctggcaggctcccgccagcgtcgctgcggctccggcccgggagcgagcgcccggagctcggaaagatgcggcgcccgcggcggcctgggggtctcgggggatccgggggtctccggctgctcctctgcctcctgctgctgagcagccgcccggggggctgcagcgccgttagtgcccacggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctccgcccctgctgcccagcatcggcttccacaaccaccagtgggcaaaggtggagctggggccagctcctctctgtcccctctgcaggctgagctgctcccgcctctcttggagcacctgctgctgcccccacagcctccccacccttcactgagttacgaacctgccttgctgcagccctacctgttccaccagtttggctcccgtgatggctccagggtctcagagggctccccagggatggtcagtgtcggccccctgcccaaggctgaagcccctgccctcttcagcagaactgcctccaagggcatatttggggaccaccctggccactcctacggggaccttccagggccttcacctgcccagctttttcaagactctgggctgctctatctggcccaggagttgccagcacccagcagggccagggtgccaaggctgccagagcaagggagcagcagccgggcagaggactccccagagggctatgagaaggaaggactaggggatcgtggagagaagcctgcttccccagctgtgcagccagatgcggctctgcagaggctggccgctgtgctggcgggctatggggtagagctgcgtcagctgacccctgagcagctctccacactcctgaccctgctgcagctactgcccaagggtgcaggaagaaatccgggaggggttgtaaatgttggagctgatatcaagaaaacaatggaggggccggtggagggcagagacacagcagagcttccagcccgcacatcccccatgcctggacaccccactgccagccctacctccagtgaagtccagcaggtgccaagccctgtctcctctgagcctcccaaagctgccagaccccctgtgacacctgtcctgctagagaagaaaagcccactgggccagagccagcccacggtggcaggacagccctcagcccgcccagcagcagaggaatatggctacatcgtcactgatcagaatgtggtgggaccagccctcaccttccgcatccggcacaatgagcagaacctgtctttggctgatgtgacccaacaagcagggctggtgaagtctgaactggaagcacagacagggctccaaatcttgcagacaggagtgggacagagggaggaggcagctgcagtccttccccaaactgcgcacagcacctcacccatgcgctcagtgctgctcactctggtggccctggcaggtgtggctgggctgctggtggctctggctgtggctctgtgtgtgcggcagcatgcgcggcagcaagacaaggagcgcctggcagccctggggcctgagggggcccatggtgacactacctttgagtaccaggacctgtgccgccagcacatggccacgaagtccttgttcaaccgggcagagggtccaccggagccttcacgggtgagcagtgtgtcctcccagttcagcgacgcagcccaggccagccccagctcccacagcagcaccccgtcctggtgcgaggagccggcccaagccaacatggacatctccacgggacacatgattctggcatacatggaggatcacctgcggaaccgggaccgccttgccaaggagtggcaggccctctgtgcctaccaagcagagccaaacacctgtgccaccgcgcagggggagggcaacatcaaaaagaaccggcatcctgacttcctgccctatgaccatgcccgcataaaactgaaggtggagagcagcccttctcggagcgattacatcaacgccagccccattattgagcatgaccctcggatgccagcctacatagccacgcagggcccgctgtcccataccatcgcagacttctggcagatggtgtgggagagcggctgcaccgtcatcgtcatgctgaccccgctggtggaggatggtgtcaagcagtgtgaccgctactggccagatgagggtgcctccctctaccacgtatatgaggtgaacctggtgtcggagcacatctggtgcgaggactttctggtgcggagcttctacctgaagaacgtgcagacccaggagacgcgcacgctcacgcagttccacttcctcagctggccggcagagggcacaccggcctccacgcggcccctgctggacttccgcaggaaggtgaacaagtgctaccggggccgctcctgccccatcatcgtgcactgcagtgatggtgcggggaggaccggcacctacatcctcatcgacatggtcctgaaccgcatggcaaaaggagtgaaggagattgacatcgctgccaccctggagcatgtccgtgaccagcggcctggccttgtccgctctaaggaccagtttgaatttgccctgacagccgtggcggaggaagtgaatgccatcctcaaggccctgccccagtgagaccctggggccccttggcgggcagcccagcctctgtccctctttgcctgtgtgagcatctctgtgtacccactcctcactgccccaccagccacctcttgggcatgctcagcccttcctagaagagtcaggaagggaaagccagaaggggcacgcctgcccagcctcgcatgccagagcctggggcatcccagagcccagggcatcccatgggggtgctgcagccaggaggagaggaaaggacatgggtagcaattctacccagagccttctcctgcctacattccctggcctggctctcctgtagctctcctggggttctgggagttccctgaacatctgtgtgtgtccccctatgctccagtatggaagaatggggtggagggtcgccacacccggctccccctgcttctcagccccgggcctgcctctgactcacacttgggcgctctgccctccctggcctcacgcccagcctcctcccaccaccctcccaccatgcgctgctcaacctctctccttctggcgcaagagaacatttctagaaaaaactacttttgtaccagtgtgaataaagttagtgtgttgtctgtgcagctgcaa

SEQ ID NO: 16993 - DNA, 3784 bp, Homo sapiens
  ENST00000295718
aggtaggtcccccgctccgacagggctcttacgccatatgtgacgcaaattagcttacgagccgggggtggaggtgtcgtcagcacccgcctgcggttggccgcgttgcagcgagaggggcatgtagaccccgcctcgtagggaggtggggagcggcaagccccgcctcagcccctctggcaggctcccgccagcgtcgctgcggctccggcccgggagcgagcgcccggagctcggaaagatgcggcgcccgcggcggcctgggggtctcgggggatccgggggtctccggctgctcctctgcctcctgctgctgagcagccgcccggggggctgcagcgccgttagtgcccacggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctccgcccctgctgcccagcatcggcttccacaaccaccagtgggcaaaggtggagctggggccagctcctctctgtcccctctgcaggctgagctgctcccgcctctcttggagcacctgctgctgcccccacagcctccccacccttcactgagttacgaacctgccttgctgcagccctacctgttccaccagtttggctcccgtgatggctccagggtctcagagggctccccagggatggtcagtgtcggccccctgcccaaggctgaagcccctgccctcttcagcagaactgcctccaagggcatatttggggaccaccctggccactcctacggggaccttccagggccttcacctgcccagctttttcaagactctgggctgctctatctggcccaggagttgccagcacccagcagggccagggtgccaaggctgccagagcaagggagcagcagccgggcagaggactccccagagggctatgagaaggaaggactaggggatcgtggagagaagcctgcttccccagctgtgcagccagatgcggctctgcagaggctggccgctgtgctggcgggctatggggtagagctgcgtcagctgacccctgagcagctctccacactcctgaccctgctgcagctactgcccaagggtgcaggaagaaatccgggaggggttgtaaatgttggagctgatatcaagaaaacaatggaggggccggtggagggcagagacacagcagagcttccagcccgcacatcccccatgcctggacaccccactgccagccctacctccagtgaagtccagcaggtgccaagccctgtctcctctgagcctcccaaagctgccagaccccctgtgacacctgtcctgctagagaagaaaagcccactgggccagagccagcccacggtggcaggacagccctcagcccgcccagcagcagaggaatatggctacatcgtcactgatcagaagcccctgagcctggctgcaggagtgaagctgctggagatcctggctgagcatgtgcacatgtcctcaggcagcttcatcaacatcagtgtggtgggaccagccctcaccttccgcatccggcacaatgagcagaacctgtctttggctgatgtgacccaacaagcagggctggtgaagtctgaactggaagcacagacagggctccaaatcttgcagacaggagtgggacagagggaggaggcagctgcagtccttccccaaactgcgcacagcacctcacccatgcgctcagtgctgctcactctggtggccctggcaggtgtggctgggctgctggtggctctggctgtggctctgtgtgtgcggcagcatgcgcggcagcaagacaaggagcgcctggcagccctggggcctgagggggcccatggtgacactacctttgagtaccaggacctgtgccgccagcacatggccacgaagtccttgttcaaccgggcagagggtccaccggagccttcacgggtgagcagtgtgtcctcccagttcagcgacgcagcccaggccagccccagctcccacagcagcaccccgtcctggtgcgaggagccggcccaagccaacatggacatctccacgggacacatgattctggcatacatggaggatcacctgcggaaccgggaccgccttgccaaggagtggcaggccctctgtgcctaccaagcagagccaaacacctgtgccaccgcgcagggggagggcaacatcaaaaagaaccggcatcctgacttcctgccctatgaccatgcccgcataaaactgaaggtggagagcagcccttctcggagcgattacatcaacgccagccccattattgagcatgaccctcggatgccagcctacatagccacgcagggcccgctgtcccataccatcgcagacttctggcagatggtgtgggagagcggctgcaccgtcatcgtcatgctgaccccgctggtggaggatggtgtcaagcagtgtgaccgctactggccagatgagggtgcctccctctaccacgtatatgaggtgaacctggtgtcggagcacatctggtgcgaggactttctggtgcggagcttctacctgaagaacgtgcagacccaggagacgcgcacgctcacgcagttccacttcctcagctggccggcagagggcacaccggcctccacgcggcccctgctggacttccgcaggaaggtgaacaagtgctaccggggccgctcctgccccatcatcgtgcactgcagtgatggtgcggggaggaccggcacctacatcctcatcgacatggtcctgaaccgcatggcaaaaggagtgaaggagattgacatcgctgccaccctggagcatgtccgtgaccagcggcctggccttgtccgctctaaggaccagtttgaatttgccctgacagccgtggcggaggaagtgaatgccatcctcaaggccctgccccagtgagaccctggggccccttggcgggcagcccagcctctgtccctctttgcctgtgtgagcatctctgtgtacccactcctcactgccccaccagccacctcttgggcatgctcagcccttcctagaagagtcaggaagggaaagccagaaggggcacgcctgcccagcctcgcatgccagagcctggggcatcccagagcccagggcatcccatgggggtgctgcagccaggaggagaggaaaggacatgggtagcaattctacccagagccttctcctgcctacattccctggcctggctctcctgtagctctcctggggttctgggagttccctgaacatctgtgtgtgtccccctatgctccagtatggaagaatggggtggagggtcgccacacccggctccccctgcttctcagccccgggcctgcctctgactcacacttgggcgctctgccctccctggcctcacgcccagcctcctcccaccaccctcccaccatgcgctgctcaacctctctccttctggcgcaagagaacatttctagaaaaaactacttttgtaccagtgtgaataaagttagtgtgttgtctgtgcagctgcaa

SEQ ID NO: 16994 - DNA, 2239 bp, Homo sapiens
  ENST00000460801
cacaacctagatccctcacatgtgcaggtcacgatagggttcgcacttctgtgagaatctattgcaatggctgatctaacaggaggcggagctcaggtggtaatgttcgcttgcctcctgctatgcggctcggttcccaacaggccatagactgacactggtccatggcccagggattggggacccctgctttagagggctgttgcaagatttgataaagtatgtaaaatctagtgtaagtgcctgatacatagcaagggctccgttaattctagatgctgcctattatcattattaaatgagcaaaaacaactattgtgattactcttctaccctagccctctgacgtaacagccaatgagctagaaaaccatgtggactcctatgaagccattctaagtcacctggtcctatagctgaaggactgtgaagttccaaacttcaatctgacaacccctaagaaggtcttccctggttctggcttgcagggatatcaggagtatgcaggtgactcccaaagcagaaaggtcataaaggacaagggcaggttagatgggtccattgagagacggagaagccccctgctcctcactgagttgtggtcaggggcagtggagaaaggtctgaggtccaaggggaccccaagtctgaatataacgcagccacagaatgcctgtgctgaagtgagactgctccagggagacaagcagtagcacaatgtcccgagttgaggggttggggttgtcctcccctggcccagggaacactatgcccagggcagcctgatgtcacaactggtaaggaccactggagcctgagtcgggaggaaaacagcctgggtggtcataaagaatggcagagggccagagcagggatgtggcaagactgacacccttgaagtcaccagaaagctatccccttggacttgggcagaagtgtctcttaatatgatgatgtattatcattaatagttgccacctgctaccatgtattgagcacctattgtgtgccagacctagcacttagctctttacatgggttatctcatgtgatcattgtaagaaccctaaggaggtttttcttactatcctccattttacaggtaagaaaactgaggctcaaagaggttaaatcagttgttccaggtgcatagcttgggcacctagcttgcaagtgacaaggcgagcccaatgccacccacaccagctctggttctttgcctccagccctggctcctttctccaaccatcttccctctctgccccgggcaggtggggagaaaaggaagaaagagaggcccacgtcatgtgtttcagcttccctttccctctctgctggtgcccactggccctcacacccatttcttgttgcaggaaggtgaacaagtgctaccggggccgctcctgccccatcatcgtgcactgcagtgatggtgcggggaggaccggcacctacatcctcatcgacatggtcctgaaccgcatggcaaaaggagtgaaggagattgacatcgctgccaccctggagcatgtccgtgaccagcggcctggccttgtccgctctaaggaccagtttgaatttgccctgacagccgtggcggaggaagtgaatgccatcctcaaggccctgccccagtgagaccctggggccccttggcgggcagcccagcctctgtccctctttgcctgtgtgagcatctctgtgtacccactcctcactgccccaccagccacctcttgggcatgctcagcccttcctagaagagtcaggaagggaaagccagaaggggcacgcctgcccagcctcgcatgccagagcctggggcatcccagagcccagggcatcccatgggggtgctgcagccaggaggagaggaaaggacatgggtagcaattctacccagagccttctcctgcctacattccctggcctggctctcctgtagctctcctggggttctgggagttccctgaacatctgtgtgtgtccccctatgctccagtatggaagaatggggtggagggtcgccacacccggctccccctgcttctcagccccgggcctgcctctgactcacacttgggcgctctgccctccctggcctcacgcccagcctcctcccaccaccctcccaccatgcgctgctcaacctctctccttctggcgcaagagaacatttctagaaaaaactacttttgtaccagtgtgaataaagttagtgtgttgtctgtgcagctgc

SEQ ID NO: 16995 - DNA, 5099 bp, Homo sapiens
  ENST00000462351
aggatgcttttccatatttgggaaggaaattcctctttcagaatttggccaaaacctctcctgcagtaattctatgaatctctctccctgcacctggaaggtttcttccctatcactcagttaagcaaacagaggcttttaaggatacagactcacaaattcttaaaatccaaaacaagatcccatgcttccttttaagaaattcaggcctgattcctactctcctcccagcttaaggccttctttagaatgaaagaataaattgcatctgcttctcccgttcccagcctgtccacccatctgcccattctctgtgagtgggtgtctgagcctctgctcaccttttcctctacaggctgtctatttgaccgcaggctctgctctcacctggaagtctgtattcagggtgagtgaggcccaagcatagaactcacaagatcggggggagaggggcaataaaaaacaagaaggggagagaaggcccagaaaggaagagggctactgggcttgagaagaaggaagacttgcctggaggaggagaggtaggggagaaagtgaagagagtacagtccatttgcaacctggactttggaaggcctcttattcaagccccctgctgacaccacttttgtgcccttagatggcttgtttgggcagtgccaggtgggagtggggcaggcccggccccttttgcaagtcacctccccagttctccaacgcttacaaggtgtgctccgacaactcatgtcccaaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctccgcccctgctgcccagcatcggcttccacaaccaccagtgggcaaaggtggagctggggccagctcctctctgtcccctctgcaggctgagctgctcccgcctctcttggagcacctgctgctgcccccacagcctccccacccttcactgagttacgaacctgccttgctgcagccctacctgttccaccagtttggctcccgtgatggctccagggtctcagagggctccccagggatggtcagtgtcggccccctgcccaaggctgaagcccctgccctcttcagcagaactgcctccaagggcatatttggggaccaccctggccactcctacggggaccttccagggccttcacctgcccagctttttcaagactctgggctgctctatctggcccaggagttgccagcacccagcagggccagggtgccaaggctgccagagcaagggagcagcagccgggcagaggactccccagagggctatgagaaggaaggactaggggatcgtggagagaagcctgcttccccagctgtgcagccagatgcggctctgcagaggctggccgctgtgctggcgggctatggggtagagctgcgtcagctgacccctgagcagctctccacactcctgaccctgctgcagctactgcccaagggtgcaggaagaaatccgggaggggttgtaaatgttggagctgatatcaagaaaacaatggaggggccggtggagggcagagacacagcagagcttccagcccgcacatcccccatgcctggacaccccactgccagccctacctccagtgaagtccagcaggtgccaagccctgtctcctctgagcctcccaaagctgccagaccccctgtgacacctgtcctgctagagaagaaaagcccactgggccagagccagcccacggtggcaggacagccctcagcccgcccagcagcagaggaatatggctacatcgtcactgatcagaagcccctgagcctggctgcaggagtgaagctgctggagatcctggctgagcatgtgcacatgtcctcaggcagcttcatcaacatcagtgtggtgggaccagccctcaccttccgcatccggcacaatgagcagaacctgtctttggctgatgtgacccaacaagcagggctggtgaagtctgaactggaagcacagacagggctccaaatcttgcagacaggagtgggacagagggaggaggcagctgcagtccttccccaaactgcgcacagcacctcacccatgcgctcagtgctgctcactctggtggccctggcaggtgtggctgggctgctggtggctctggctgtggctctgtgtgtgcggcagcatgcgcggcagcaagacaaggagcgcctggcagccctggggcctgagggggcccatggtgacactacctttgagtaccaggacctgtgccgccagcacatggccacgaagtccttgttcaaccgggcagagggtccaccggagccttcacgggtgagcagtgtgtcctcccagttcagcgacgcagcccaggccagccccagctcccacagcagcaccccgtcctggtgcgaggagccggcccaagccaacatggacatctccacgggacacatgattctggcatacatggaggatcacctgcggaaccgggaccgccttgccaaggagtggcaggccctctgtgcctaccaagcagagccaaacacctgtgccaccgcgcagggggagggcaacatcaaaaagaaccggcatcctgacttcctgccctatgaccatgcccgcataaaactgaaggtggagagcagcccttctcggagcgattacatcaacgccagccccattattgagcatgaccctcggatgccagcctacatagccacgcagggcccgctgtcccataccatcgcagacttctggcagatggtgtgggagagcggctgcaccgtcatcgtcatgctgaccccgctggtggaggatggtgtcaagcagtgtgaccgctactggccagatgagggtgcctccctctaccacgtatatgaggtcagcagggccccacagcaaggggacaatggatgtgggaagagtagatgatggccttttcgtaacgttttcttcaccaaatgagcactcaacagtctttttaaaaaggcttttattggccctgctcatgattcatacatatatgaatatatataaacacatatatgcatacccatatattcacatatatacatgtgtgtgtcctgtttacagaacatacatgtgtgtgtgtgtgtgtgtgtgtgtgtgtcctgtctagagtcaaaaagcgttcatagagacttatgataaaggcacagagatcaaactataaaaccaccaaaaccgaggtaagaagctaacagctaagtgtatattagacagggaagataaggatacccaaagactgagattaagacctacgttaattgaacctaatttagctctgagtttcctggtggccaaagcaaagaaagacataccacccgttacatacgttactaatgtaaaagagaaacaaactttttcattaggagagagactaggtggaggggtggagaaggagggggaactgggcagaggccaagcaggggaaagagaaatatttcagacaaatgggagaacgtgagtccccactaagacaaaaaaaccttaagaacacagcagaagcttctcatcaccagatgagcctgaatagtaattttttccccaccaaataagcacatgacggtttttttaaaaagcctttcattggtcctgctggtggttaacgaaaaaaatccagtaagaatactacagaatttcatccaagtttatggcacgtgtagcaccgatactctggtagaccctgcgaggaagagggaggagaaactccgacctcgagaggctcacaatagctgtgtctgggtggaaaagctactagtggtcctgagcagtagataagtgacaggcagccagggttcctgggaccgctggaacttagaatttgaaccggcctgggaggccgggcggtggttggagagaccgagaaggtcgcgaggagagcgcgcgcaacgcggggactggggcagcccgcggcgctcaggcctgggcccctgccgggcaggtgaacctggtgtcggagcacatctggtgcgaggactttctggtgcggagcttctacctgaagaacgtgcagacccaggagacgcgcacgctcacgcagttccacttcctcagctggccggcagagggcacaccggcctccacgcggcccctgctggacttccgcaggaaggtgaacaagtgctaccggggccgctcctgccccatcatcgtgcactgcagtgatggtgcggggaggaccggcacctacatcctcatcgacatggtcctgaaccgcatggcaaaaggagtgaaggagattgacatcgctgccaccctggagcatgtccgtgaccagcggcctggccttgtccgctctaaggaccagtttgaatttgccctgacagccgtggcggaggaagtgaatgccatcctcaaggccctgccccagtgagaccctggggccccttggcgggcagcccagcctctgtccctctttgcctgtgtgagcatctctgtgtacccactcctcactgccccaccagccacctcttgggcatgctcagcccttcctagaagagtcaggaagggaaagccagaaggggcacgcctgcccagcctcgcatgccagagcctggggcatcccagagcccagggcatcccatgggggtgctgcagccaggaggagaggaaaggacatgggtagcaattctacccagagccttctcctgcctacattccctggcctggctctcctgtagctctcctggggttctgggagttccctgaacatctgtgtgtgtccccctatgctccagtatggaagaatggggtggagggtcgccacacccggctccccctgcttctcagccccgggcctgcctctgactcacacttgggcgctctgccctccctggcctcacgcccagcctcctcccaccaccctcccaccatgcgctgctcaacctctctccttctggcgcaagagaacatttctagaaaaaactacttttgtaccagtgtgaataaagttagtgtgttgtctgtgcagctgc

SEQ ID NO: 16996 - DNA, 1051 bp, Homo sapiens
  ENST00000443981
tgtgggagagcggctgcaccgtcatcgtcatgctgaccccgctggtggaggatggtgtcaagcagtgtgaccgctactggccagatgagggtgcctccctctaccacgtatatgaggtgaacctggtgtcggagcacatctggtgcgaggactttctggtgcggagcttctacctgaagaacgtgcagacccaggagacgcgcacgctcacgcagttccacttcctcagctggccggcagagggcacaccggcctccacgcggcccctgctggacttccgcaggaaggtgaacaagtgctaccggggccgctcctgccccatcatcgtgcactgcagtgatggtgcggggaggaccggcacctacatcctcatcgacatggtcctgaaccgcatggcaaaaggaccagtttgaatttgccctgacagccgtggcggaggaagtgaatgccatcctcaaggccctgccccagtgagaccctggggccccttggcgggcagcccagcctctgtccctctttgcctgtgtgagcatctctgtgtacccactcctcactgccccaccagccacctcttgggcatgctcagcccttcctagaagagtcaggaagggaaagccagaaggggcacgcctgcccagcctcgcatgccagagcctggggcatcccagagcccagggcatcccatgggggtgctgcagccaggaggagaggaaaggacatgggtagcaattctacccagagccttctcctgcctacattccctggcctggctctcctgtagctctcctggggttctgggagttccctgaacatctgtgtgtgtccccctatgctccagtatggaagaatggggtggagggtcgccacacccggctccccctgcttctcagccccgggcctgcctctgactcacacttgggcgctctgccctccctggcctcacgcccagcctcctcccaccaccctcccaccatgcgctgctcaacctctctccttctggcgcaagagaacatttctagaaaaaactacttttgtaccagtgtgaataaag

SEQ ID NO: 16997 - DNA, 3313 bp, Homo sapiens
  ENST00000423636
attgcaggttcgggagaaggacacggggtgcatgtgggcagagggacttagagaccggctgcgagaccacaggagaagccacttgctccgaggcgcctgggaggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctccgcccctgctgcccagcatcggcttccacaaccaccagtgggcaaaggtggagctggggccagctcctctctgtcccctctgcaggctgagctgctcccgcctctcttggagcacctgctgctgcccccacagcctccccacccttcactgagttacgaacctgccttgctgcagccctacctgttccaccagtttggctcccgtgatggctccagggtctcagagggctccccagggatggtcagtgtcggccccctgcccaaggctgaagcccctgccctcttcagcagaactgcctccaagggcatatttggggaccaccctggccactcctacggggaccttccagggccttcacctgcccagctttttcaagactctgggctgctctatctggcccaggagttgccagcacccagcagggccagggtgccaaggctgccagagcaagggagcagcagccgggcagaggactccccagagggctatgagaaggaaggactaggggatcgtggagagaagcctgcttccccagctgtgcagccagatgcggctctgcagaggctggccgctgtgctggcgggctatggggtagagctgcgtcagctgacccctgagcagctctccacactcctgaccctgctgcagctactgcccaagggtgcaggaagaaatccgggaggggttgtaaatgttggagctgatatcaagaaaacaatggaggggccggtggagggcagagacacagcagagcttccagcccgcacatcccccatgcctggacaccccactgccagccctacctccagtgaagtccagcaggtgccaagccctgtctcctctgagcctcccaaagctgccagaccccctgtgacacctgtcctgctagagaagaaaagcccactgggccagagccagcccacggtggcaggacagccctcagcccgcccagcagcagaggaatatggctacatcgtcactgatcagaagcccctgagcctggctgcaggagtgaagctgctggagatcctggctgagcatgtgcacatgtcctcaggcagcttcatcaacatcagtgtggtgggaccagccctcaccttccgcatccggcacaatgagcagaacctgtctttggctgatgtgacccaacaagcagggctggtgaagtctgaactggaagcacagacagggctccaaatcttgcagacaggagtgggacagagggaggaggcagctgcagtccttccccaaactgcgcacagcacctcacccatgcgctcagtgctgctcactctggtggccctggcaggtgtggctgggctgctggtggctctggctgtggctctgtgtgtgcggcagcatgcgcggcagcaagacaaggagcgcctggcagccctggggcctgagggggcccatggtgacactacctttgagtaccaggacctgtgccgccagcacatggccacgaagtccttgttcaaccgggcagagggtccaccggagccttcacgggtgagcagtgtgtcctcccagttcagcgacgcagcccaggccagccccagctcccacagcagcaccccgtcctggtgcgaggagccggcccaagccaacatggacatctccacgggacacatgattctggcatacatggaggatcacctgcggaaccgggaccgccttgccaaggagtggcaggccctctgtgcctaccaagcagagccaaacacctgtgccaccgcgcagggggagggcaacatcaaaaagaaccggcatcctgacttcctgccctatgaccatgcccgcataaaactgaaggtggagagcagcccttctcggagcgattacatcaacgccagccccattattgagcatgaccctcggatgccagcctacatagccacgcagggcccgctgtcccataccatcgcagacttctggcagatggtgtgggagagcggctgcaccgtcatcgtcatgctgaccccgctggtggaggatggtgtcaagcagtgtgaccgctactggccagatgagggtgcctccctctaccacgtatatgaggtgaacctggtgtcggagcacatctggtgcgaggactttctggtgcggagcttctacctgaagaacgtgcagacccaggagacgcgcacgctcacgcagttccacttcctcagctggccggcagagggcacaccggcctccacgcggcccctgctggacttccgcaggaaggtgaacaagtgctaccggggccgctcctgccccatcatcgtgcactgcagtgatggtgcggggaggaccggcacctacatcctcatcgacatggtcctgaaccgcatggcaaaaggagtgaaggagattgacatcgctgccaccctggagcatgtccgtgaccagcggcctggccttgtccgctctaaggaccagtttgaatttgccctgacagccgtggcggaggaagtgaatgccatcctcaaggccctgccccagtgagaccctggggccccttggcgggcagcccagcctctgtccctctttgcctgtgtgagcatctctgtgtacccactcctcactgccccaccagccacctcttgggcatgctcagcccttcctagaagagtcaggaagggaaagccagaaggggcacgcctgcccagcctcgcatgccagagcctggggcatcccagagcccagggcatcccatgggggtgctgcagccaggaggagaggaaaggacatgggtagcaattctacccagagccttctcctgcctacattccctggcctggctctcctgtagctctcctggggttctgggagttccctgaacatctgtgtgtgtccccctatgctccagtatggaagaatggggtggagg

SEQ ID NO: 16998 - DNA, 701 bp, Homo sapiens
  ENST00000497977
cagccccattattgagcatgaccctcggatgccagcctacatagccacgcagggcccgctgtcccataccatcgcagacttctggcagatggtgtgggagagcggctgcaccgtcatcgtcatgctgaccccgctggtggaggatggtgtcaagcagtgtgaccgctactggccagatgagggtgcctccctctaccacgtatatgagctggccggcagagggcacaccggcctccacgcggcccctgctggacttccgcaggaaggtgaacaagtgctaccggggccgctcctgccccatcatcgtgcactgcagtgatggtgcggggaggaccggcacctacatcctcatcgacatggtcctgaaccgcatggcaaaaggagtgaaggagattgacatcgctgccaccctggagcatgtccgtgaccagcggcctggccttgtccgctctaaggaccagtttgaatttgccctgacagccgtggcggaggaagtgaatgccatcctcaaggccctgccccagtgagaccctggggccccttggcgggcagcccagcctctgtccctctttgcctgtgtgagcatctctgtgtacccactcctcactgccccaccagccacctcttgggcatgctcagcccttcctagaagagtcaggaagggaaagccagaaggggcacgcctgcccagcctcgcatgc

SEQ ID NO: 16999 - DNA, 563 bp, Homo sapiens
  ENST00000486480
tgaaggtacagccacacccagcccgttgctggccccacccagcatcttccttgcctaagatgcccctgtagggcatccccgatctgctccagccccatcctctaacggggagagggccagagctggcctcttttttgaagtctgcggtctggggtggagaaggcagtaacatagctcctatctggcagtgtggtgggaccagccctcaccttccgcatccggcacaatgagcagaacctgtctttggctgatgtgacccaacaagcagggctggtgaagtctgaactggaagcacagacagggctccaaatcttgcagacaggagtgggacagagggaggaggcagctgcagtccttccccaaactgcgcacagcacctcacccatgcgctcagtgctgctcactctggtggccctggcaggtgtggctgggctgctggtggctctggctgtggctctgtgtgtgcggcagcatgcgcggcagcaagacaaggagcgcctggcagccctggggcctgagggggcccatggtgacactacctttgagtaccaggacctgtgccg

SEQ ID NO: 17000 - DNA, 571 bp, Homo sapiens
  ENST00000489650
gatctgctccagccccatcctctaacggggagagggccagagctggcctcttttttgaagtctgcggtctggggtggagaaggcagtaacatagctcctatctggcagtgtggtgggaccagccctcaccttccgcatccggcacaatgagcagaacctgtctttggctgatgtgacccaacaagcaggtaaatatctctgcgacctcaatcccaggcttggccccagccccactcctaagaggatatatccaggcctgttgctgatgcccccttgaaatgttcccagcccacatgggccctgcctgctgcttggcagagcaagacagaggatggagaccacatggggctggagcaagcctgacctttgtcctccctgcagggctggtgaagtctgaactggaagcacagacagggctccaaatcttgcagacaggagtgggacagagggaggaggcagctgcagtccttccccaaactgcgcacagcacctcacccatgcgctcagtgctgctcactctggtggccctggcaggtgtggctgggctgctggtggctctggctgtggctct

SEQ ID NO: 17001 - DNA, 563 bp, Homo sapiens
  ENST00000412847
ctaagagaattgggctctggggaaaattgcaggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctccgcccctgctgcccagcatcggcttccacaaccaccagtgggcaaaggtggagctggggccagctcctctctgtcccctctgcaggctgagctgctcccgcctctcttggagcacctgctgctgcccccacagcctccccacccttcactgagttacgaacctgccttgctgcagccctacctgttccaccagtttggct

SEQ ID NO: 17002 - DNA, 606 bp, Homo sapiens
  ENST00000446182
gaagagggctacagggatggggccaagtgggaattctagcgaggcgcctactatttgatggaggagggatgggctaggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctccgcccctgctgcccagcatcggcttccacaaccaccagtgggcaaaggtggagctggggccagctcctctctgtcccctctgcaggctgagctgctcccgcctctcttggagcacctgctgctgcccccacagcctccccacccttcactgagttacgaacctgccttgctgcagccctacctgttccaccagtttgg

SEQ ID NO: 17003 - DNA, 579 bp, Homo sapiens
  ENST00000440552
agcttggggcctggagcgaaactcggtgggggtgagggtgaaatgtcatgaagctcggggagaatatgggttgggggaggcatgcgagatgaggaaggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctccgcccctgctgcccagcatcggcttccacaaccaccagtgggcaaaggtggagctggggccagctcctctctgtcccctctgcaggctgagctgctcccgcctctcttggagcacctgctgctgcccccacagcctccccacccttcactg

SEQ ID NO: 17004 - DNA, 582 bp, Homo sapiens
  ENST00000476930
taacaatcctaggaggtataaatccccattttattgatgagggaattgaggcttggagaggttcagcaacttgcccaaggttacataattcatcagtagcaaaggcaggattcaaacccaggtggtctggctccaatagctgtacctgagggtgggaagaagacagctcagatcacccactgagtttgtccctctactctgacaaaccccatgagctgcagggcagagggtacagttctgatccccagtggtccccgttactggatccccagactcctgaaccaacttacgctgtcctctttcctgacaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctccgcccctgctgcccagcatcggcttccacaaccaccagtgggcaaaggtggagctggggccagctcctctctgtcccctctgcaggctgagctgctcccgcctctc

SEQ ID NO: 17005 - DNA, 541 bp, Homo sapiens
  ENST00000442029
aagagaattgggctctggggaaaattgcaggttcgggagaaggacacggggtgcatgtgggcagagggacttagagaccggctgcgagaccacaggagaagccacttgctccgaggcgcctgggaggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctccgcccctgctgcccagcatcggcttccacaaccaccagtgggcaaaggtggagctggggccagctcctctctgtcccctctgca

SEQ ID NO: 17006 - DNA, 466 bp, Homo sapiens
  ENST00000451506
atatgtgacgcaaattagcttacgagccgggggtggaggtgtcgtcagcacccgcctgcggttggccgcgttgcagcgagaggggcatgtagaccccgcctcgtagggaggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctccgcccctgctgcccagcatcggctt

SEQ ID NO: 17007 - DNA, 592 bp, Homo sapiens
  ENST00000606213
agcgtcgctgcggctccggcccgggagcgagcgcccggagctcggaaagatgcggcgcccgcggcggcctgggggtctcgggggatccgggggtctccggctgctcctctgcctcctgctgctgagcagccgcccggggggctgcagcgccgttagtgcccacggttcgggagaaggacacggggtgcatgtgggcagagggacttagagaccggctgcgagaccacaggagaagccacttgctccgaggcgcctgggaggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctcc

SEQ ID NO: 17008 - DNA, 504 bp, Homo sapiens
  ENST00000468454
cgagaccacaggagaagccacttgctccgaggcgcctgggaggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaagagtaagaggtggaaccctagagatgggctattcacatttggactctctggagaagcccagaggagccttctaagaagaagtcactggaaaaggccagcttccatcttcttaggaccagttcctctcactggcattgtctgagtgctacagagccaagaactctggaatcctcagccaggataatattccactcacccaattcctcattcaacaagtatttattgagtacttactatgtagcaggcatagttttaggtatttggaatgtatcgggaataaaacaaagatctctgctta

SEQ ID NO: 17009 - DNA, 545 bp, Homo sapiens
  ENST00000484986
cccctctggcaggctcccgccagcgtcgctgcggctccggcccgggagcgagcgcccggagctcggaaagatgcggcgcccgcggcggcctgggggtctcgggggatccgggggtctccggctgctcctctgcctcctgctgctgagcagccgcccggggggctgcagcgccgttagtgcccacggctgtctatttgaccgcaggctctgctctcacctggaagtctgtattcagggtgagtgaggcccaagcatagaactcacaagatcggggggagaggggcaataaaaaacaagaaggggagagaaggcccagaaaggaagagggctactgggcttgagaagaaggaagacttgcctggaggaggagaggtaggggagaaagtgaagagagtacagtccatttgcaacctggactttggaaggcctcttattcaagccccctgctgacaccacttttgtgcccttagatggcttgtttgggcagtgccaggtgggagtggggcaggcccggccccttttgcaagtcacctccccagttctcc

SEQ ID NO: 17010 - DNA, 579 bp, Homo sapiens
  ENST00000477819
cttcagcaccgcggacagcgccagcggctcgggacagcgcgaggagagatgcctaagagacaccctccccagccccacccatgccctctttcccccgaccgggggaagtgtgctagaacctcttctgagttccaggccattataggatgcttttccatatttgggaaggaaattcctctttcagaatttggccaaaacctctcctgcagtaattctatgaatctctctccctgcacctggaaggtttcttccctatcactcagttaagcaaacagaggcttttaaggatacagactcacaaattcttaaaatccaaaacaagatcccatgcttccttttaagaaattcaggcctgattcctactctcctcccagcttaaggccttctttagaatgaaagaataaattgcatctgcttctcccgttcccagcctgtccacccatctgcccattctctgtgagtgggtgtctgagcctctgctcaccttttcctctacaggctgtctatttgaccgcaggctctgctctcacctggaagtctgtattcaggatggcttgtttgggcagtgccaggtgggag

SEQ ID NO: 17011 - DNA, 5301 bp, Homo sapiens
  ENST00000281171
cgcggggtccccgcctctcgctcaccacacagaccccgcgcctcctctggcagccgcggtggtggcggcggcagagcctcgcccactccaatccccaccctctccatccttagtcattaaagaacagcagcgcctggcacgttcttggaggaccccgggcgcagaggaggaaagggagcaggcgcagggggactggaaaggcagcatgcgctcgccaggagcaacctcggcgcccagggtctgaggctgcagccccagttcgccattgtgagccgccgccgggggagtccgctagcgcagccgtgcccccgagtccccgtccgcgcagcgatggggcacctgcccacggggatacacggcgcccgccgcctcctgcctctgctctggctctttgtgctgttcaagaatgctacagctttccatgtaactgtccaagatgataataacatcgttgtctcattagaagcttcagacgtcatcagtccagcatctgtgtatgttgtgaagataactggtgaatccaaaaattatttcttcgaatttgaggaattcaacagcactttgcctcctcctgttattttcaaggccagttatcatggcctttattatataatcactctggtagtggtaaatggaaatgtggtgaccaagccatccagatcaatcactgtgttaacaaaacctctacctgtaaccagtgtttccatatatgactataaaccttctcctgaaacaggagtcctgtttgaaatacattatccagaaaaatataacgttttcacaagagtgaacattagctactgggaaggtaaagacttccggacaatgctatataaagatttctttaagggaaaaacagtatttaatcactggctgccaggaatgtgttatagtaatatcacctttcagctggtatctgaggcaacttttaataaaagtacccttgttgagtacagtggtgtcagtcacgaacccaaacagcacagaactgccccttatccacctcaaaatatttccgttcgtatcgtaaacttgaacaaaaacaactgggaagaacagagtggcaatttcccagaagaatccttcatgagatcacaagatacaataggaaaagaaaaactcttccattttacagaagaaacccctgaaattccctcgggcaacatttcttccggttggcctgattttaatagcagtgactatgaaactacgtctcagccatattggtgggacagtgcatctgcagctcctgaaagtgaagatgaatttgtcagcgtacttcccatggaatacgaaaataacagtacactcagtgagacagagaagtcaacatcaggctctttctcctttttccctgtgcaaatgatattgacctggttaccacccaaaccacccactgcttttgatgggttccatatccatattgaacgagaagagaactttactgaatatttgatggtggatgaagaagcacatgaatttgttgcagaactgaaggaacctgggaaatataagttatctgtgacaacctttagttcctcaggatcttgtgaaactcgaaaaagtcagtcagcaaaatcactcagcttttatatcagtccttcaggagagtggattgaagaactgaccgagaagccgcagcacgtgagtgtccacgttttaagctcaaccactgccttgatgtcctggacatcttcccaagagaactacaacagcaccattgtgtctgtggtgtcgctgacctgccagaaacaaaaggagagccagaggcttgaaaagcagtactgcactcaggtgaactcaagcaaacctattattgaaaatctggttcctggtgcccagtaccaggttgtaatatacctaaggaaaggccctttgattggaccaccttcagatcctgtgacatttgctattgttcccacaggaataaaggatttaatgctctatcctttgggtcctacggccgtggttctgagctggaccagaccttatttaggcgtgttcagaaaatacgtggttgaaatgttttatttcaaccctgctacaatgacatcagagtggaccacctactatgaaatagcagcaactgtttccttaactgcatccgtgagaatagctaatctgctgccagcatggtactacaacttccgggttaccatggtgacgtggggagatccagaattgagctgctgtgacagctctaccatcagcttcataacagccccagtggctccggaaatcacttctgtggaatatttcaacagtctgttatatatcagttggacatatggggatgatacaacggacttgtcccattctagaatgcttcactggatggtggttgcagaaggaaaaaagaaaattaaaaagagtgtaacacgcaatgtcatgactgcaattctcagcttgcctccaggcgacatctataacctctcagtaactgcttgtactgaaagaggaagtaatacctccatgctccgccttgtcaagctagaaccagctccacccaaatcactcttcgcagtgaacaaaacccagacttcagtgactttgctgtgggtggaagagggagtagctgatttctttgaagttttctgtcaacaagttggctccagtcagaaaaccaaacttcaggaaccagttgctgtttcttcccatgtcgtgaccatctccagccttcttcctgccactgcctacaattgtagtgtcaccagctttagccatgacagccccagtgtccctacgttcatagccgtctcaacaatggttacagagatgaatcccaatgtggtagtgatctccgtgctggccatccttagcacacttttaattggactgttgcttgttaccctcattattcttaggaaaaagcatctgcagatggctagggagtgtggagctggtacatttgtcaattttgcatccttagagagggatggaaagcttccatacaactggcgtaggagtatatttgctttcttaaccctgctaccctcatgtctttggactgattatcttttggcattttatattaatccttggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggatacaactcaccccaggagtatattgccacccaggggccactgcctgaaaccagaaatgacttctggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcagtgctggcgtgggacggacaggaacattcattgccctggacaggctcttgcagcacattcgggatcatgagtttgttgacatcttagggctggtgtcagaaatgaggtcataccggatgtctatggtacagacagaggagcagtacatttttatccatcagtgtgtgcaactgatgtggatgaagaagaagcagcagttctgcatcagtgatgtcatatacgagaatgttagcaagtcctagttcagaatccggagcagagaggacatgatgtgcgcccatcctcccttgcttccagattgttttagtgggccctgatggtcatttttctaaacagaggccctgctttgtaatatgtggccaaggagataatttatctcacagaagcaccgggaagacttagccttaaagagcctacagtgtccttttggactctttcacttcgggacatttaataatggaccaaattcaacagaacaccaggaaggtcaagacgctctccaaagggcaggaagtacagcacttccgaagagtttagttggccctttgctggttgggctgagttttttatttttaagtgtttgtttttcagtgcaataatttttgtgtgtgtgtgattcttatcagaaagttgaattgttttctgcctacaccgttcatcagccccataacccaggaaggaacaggcattgttagcatcagattatacctcattattaaaaggaggcatggccacacatgaagaaatggtcattctacttcaaagaaattgagccagcactatctgtactccaacattaccggatctggattggggaggttggtcagggaagagaggggttctacccacagatcaactgtgtaatcttttactattcaagctataattcagcttcaaagtagagtagaaaaaaaattgtcttaactgttctagttcttgatggttttcttccttattaacagttggtgtttcttccttggcccttttggactaatgttactgtccaagttctttctcaagaaaccacatctggttcagaagagtgtcaagttggactctttgaactctgttgctgtctgagcaatcgtggtgcctagactttgcattccttgttctgttgacctgcatacatgtgagagctatttctttaagaactatataggctgtgaaaacgcactttctttcccccaaagagctgggaatttatgaagttatggcaatgaactgcagcatgctgggacaattatttgactacttttttttgtaatattgtcaaatgtctctatggattctgacagagatttctttttgttttgttattcttttggttgtcagtttcattttaacgagtgtaactagtaacattttattctttggattttgtataattacagtacatgattgtgtattgtgacatgaatgctgtcaaaatgacattgatggcattgtgaagcctgttactttgtgtcacttcctgataaataagaggtgatgacatggatatacaacagaaaacactttgagttgaaagtaaacacaagctggctgcttccctgtggcaa

SEQ ID NO: 17012 - DNA, 2070 bp, Homo sapiens
  ENST00000543886
ggaggaccccgggcgcagaggaggaaagggagcaggcgcagggggactggaaaggcagcatgcgctcgccaggagcaacctcggcgcccagggtctgaggctgcagccccagttcgccattgtgagccgccgccgggggagtccgctagcgcagccgtgcccccgagtccccgtccgcgcagcgatggggcacctgcccacggggatacacggcgcccgccgcctcctgcctctgctctggctctttgtgctgttcaagaatgctacagctttccatgtaactgtccaagatgataataacatcgttgtctcattagaagcttcagacgtcatcagtccagcatctgtgtatgttgtgaagataactggtgaatccaaaaattatttcttcgaatttgaggaattcaacagcactttgcctcctcctgttattttcaaggccagttatcatggcctttattatataatcactctggtagtggtaaatggaaatgtggtgaccaagccatccagatcaatcactgtgttaacaaaacctctacctgtaaccagtgtttccatatatgactataaaccttctcctgaaacaggagtcctgtttgaaatacattatccagaaaaatataacgttttcacaagagtgaacattagctactgggaaggtaaagacttccggacaatgctatataaagatttctttaagggaaaaacagtatttaatcactggctgccaggaatgtgttatagtaatatcacctttcagctggtatctgaggcaacttttaataaaagtacccttgttgagtacagtggtgtcagtcacgaacccaaacagcacagaactgccccttatccacctcaaaatatttccgttcgtatcgtaaacttgaacaaaaacaactgggaagaacagagtggcaatttcccagaagaatccttcatgagatcacaagatacaataggaaaagaaaaactcttccattttacagaagaaacccctgaaattccctcgggcaacatttcttccggttggcctgattttaatagcagtgactatgaaactacgtctcagccatattggtgggacagtgcatctgcagctcctgaaagtgaagatgaatttgtcagcgtacttcccatggaatacgaaaataacagtacactcagtgagacagagaagtcaacatcaggctctttctcctttttccctgtgcaaatgatattgacctggttaccacccaaaccacccactgcttttgatgggttccatatccatattgaacgagaagagaactttactgaatatttgatggtggatgaagaagcacatgaatttgttgcagaactgaaggaacctgggaaatataagttatctgtgacaacctttagttcctcaggatcttgtgaaactcgaaaaagtcagtcagcaaaatcactcagcttttatatcagtccttcaggagagtggattgaagaactgaccgagaagccgcagcacgtgagtgtccacgttttaagctcaaccactgccttgatgtcctggacatcttcccaagagaactacaacagcaccattgtgtctgtggtgtcgctgacctgccagaaacaaaaggagagccagaggcttgaaaagcagtactgcactcaggtgaactcaagcaaacctattattgaaaatctggttcctggtgcccagtaccaggttgtaatatacctaaggaaaggccctttgattggaccaccttcagatcctgtgacatttgctattgttcccacaggaataaaggatttaatgctctatcctttgggtcctacggccgtggttctgagctggaccagaccttatttaggcgtgttcagaaaatacgtggttgaaatgttttatttcaaccctgctacaatgacatcagagtggaccacctactatgaaatagcagcaactgtttccttaactgcatccgtggtaatcttcccttaaccaactgtcagtctttcctatgggaacaggcaaacctttatgtaccaaatgtgtctttaagaaattatctataaatttgattattttgtaaa

SEQ ID NO: 17013 - DNA, 5061 bp, Homo sapiens
  ENST00000348962
gggcgcagaggaggaaagggagcaggcgcagggggactggaaaggcagcatgcgctcgccaggagcaacctcggcgcccagggtctgaggctgcagccccagttcgccattgtgagccgccgccgggggagtccgctagcgcagccgtgcccccgagtccccgtccgcgcagcgatggggcacctgcccacggggatacacggcgcccgccgcctcctgcctctgctctggctctttgtgctgttcaagaatgctacagctttccatgtaactgtccaagatgataataacatcgttgtctcattagaagcttcagacgtcatcagtccagcatctgtgtatgttgtgaagataactggtgaatccaaaaattatttcttcgaatttgaggaattcaacagcactttgcctcctcctgttattttcaaggccagttatcatggcctttattatataatcactctggtagtggtaaatggaaatgtggtgaccaagccatccagatcaatcactgtgttaacaaaacctctacctgtaaccagtgtttccatatatgactataaaccttctcctgaaacaggagtcctgtttgaaatacattatccagaaaaatataacgttttcacaagagtgaacattagctactgggaaggtaaagacttccggacaatgctatataaagatttctttaagggaaaaacagtatttaatcactggctgccaggaatgtgttatagtaatatcacctttcagctggtatctgaggcaacttttaataaaagtacccttgttgagtacagtggtgtcagtcacgaacccaaacagcacagaactgccccttatccacctcaaaatatttccgttcgtatcgtaaacttgaacaaaaacaactgggaagaacagagtggcaatttcccagaagaatccttcatgagatcacaagatacaataggaaaagaaaaactcttccattttacagaagaaacccctgaaattccctcgggcaacatttcttccggttggcctgattttaatagcagtgactatgaaactacgtctcagccatattggtgggacagtgcatctgcagctcctgaaagtgaagatgaatttgtcagcgtacttcccatggaatacgaaaataacagtacactcagtgagacagagaagtcaacatcaggctctttctcctttttccctgtgcaaatgatattgacctggttaccacccaaaccacccactgcttttgatgggttccatatccatattgaacgagaagagaactttactgaatatttgatggtggatgaagaagcacatgaatttgttgcagaactgaaggaacctgggaaatataagttatctgtgacaacctttagttcctcaggatcttgtgaaactcgaaaaagtcagtcagcaaaatcactcagcttttatatcagtccttcaggagagtggattgaagaactgaccgagaagccgcagcacgtgagtgtccacgttttaagctcaaccactgccttgatgtcctggacatcttcccaagagaactacaacagcaccattgtgtctgtggtgtcgctgacctgccagaaacaaaaggagagccagaggcttgaaaagcagtactgcactcaggtgaactcaagcaaacctattattgaaaatctggttcctggtgcccagtaccaggttgtaatatacctaaggaaaggccctttgattggaccaccttcagatcctgtgacatttgctattgttcccacaggaataaaggatttaatgctctatcctttgggtcctacggccgtggttctgagctggaccagaccttatttaggcgtgttcagaaaatacgtggttgaaatgttttatttcaaccctgctacaatgacatcagagtggaccacctactatgaaatagcagcaactgtttccttaactgcatccgtgagaatagctaatctgctgccagcatggtactacaacttccgggttaccatggtgacgtggggagatccagaattgagctgctgtgacagctctaccatcagcttcataacagccccagtggctccggaaatcacttctgtggaatatttcaacagtctgttatatatcagttggacatatggggatgatacaacggacttgtcccattctagaatgcttcactggatggtggttgcagaaggaaaaaagaaaattaaaaagagtgtaacacgcaatgtcatgactgcaattctcagcttgcctccaggcgacatctataacctctcagtaactgcttgtactgaaagaggaagtaatacctccatgctccgccttgtcaagctagaaccagctccacccaaatcactcttcgcagtgaacaaaacccagacttcagtgactttgctgtgggtggaagagggagtagctgatttctttgaagttttctgtcaacaagttggctccagtcagaaaaccaaacttcaggaaccagttgctgtttcttcccatgtcgtgaccatctccagccttcttcctgccactgcctacaattgtagtgtcaccagctttagccatgacagccccagtgtccctacgttcatagccgtctcaacaatggttacagagatgaatcccaatgtggtagtgatctccgtgctggccatccttagcacacttttaattggactgttgcttgttaccctcattattcttaggaaaaagcatctgcagatggctagggagtgtggagctggtacatttgtcaattttgcatccttagagagggatggaaagcttccatacaactggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggatacaactcaccccaggagtatattgccacccaggggccactgcctgaaaccagaaatgacttctggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcagtgctggcgtgggacggacaggaacattcattgccctggacaggctcttgcagcacattcgggatcatgagtttgttgacatcttagggctggtgtcagaaatgaggtcataccggatgtctatggtacagacagaggagcagtacatttttatccatcagtgtgtgcaactgatgtggatgaagaagaagcagcagttctgcatcagtgatgtcatatacgagaatgttagcaagtcctagttcagaatccggagcagagaggacatgatgtgcgcccatcctcccttgcttccagattgttttagtgggccctgatggtcatttttctaaacagaggccctgctttgtaatatgtggccaaggagataatttatctcacagaagcaccgggaagacttagccttaaagagcctacagtgtccttttggactctttcacttcgggacatttaataatggaccaaattcaacagaacaccaggaaggtcaagacgctctccaaagggcaggaagtacagcacttccgaagagtttagttggccctttgctggttgggctgagttttttatttttaagtgtttgtttttcagtgcaataatttttgtgtgtgtgtgattcttatcagaaagttgaattgttttctgcctacaccgttcatcagccccataacccaggaaggaacaggcattgttagcatcagattatacctcattattaaaaggaggcatggccacacatgaagaaatggtcattctacttcaaagaaattgagccagcactatctgtactccaacattaccggatctggattggggaggttggtcagggaagagaggggttctacccacagatcaactgtgtaatcttttactattcaagctataattcagcttcaaagtagagtagaaaaaaaattgtcttaactgttctagttcttgatggttttcttccttattaacagttggtgtttcttccttggcccttttggactaatgttactgtccaagttctttctcaagaaaccacatctggttcagaagagtgtcaagttggactctttgaactctgttgctgtctgagcaatcgtggtgcctagactttgcattccttgttctgttgacctgcatacatgtgagagctatttctttaagaactatataggctgtgaaaacgcactttctttcccccaaagagctgggaatttatgaagttatggcaatgaactgcagcatgctgggacaattatttgactacttttttttgtaatattgtcaaatgtctctatggattctgacagagatttctttttgttttgttattcttttggttgtcagtttcattttaacgagtgtaactagtaacattttattctttggattttgtataattacagtacatgattgtgtattgtgacatgaatgctgtcaaaatgacattgatggcattgtgaagcctgttactttgtgtcacttcctgataaataagaggtgatgacatggatatacaacagaaaacactttgagttgaaagtaaacacaagctggctgcttccctgtggcaa

SEQ ID NO: 17014 - DNA, 512 bp, Homo sapiens
  ENST00000545023
gctctggctctttgtgctgttcaaggagtgcctgtgaggatgtttccaggagagataagtattggaattgatggaccaagtaaagcaggtggcatactccaatatggatgggcatgattcaatccattgagggctcgaatagagcaaaaagacagaagaatgctgggttcacctgctctctgctggactacttgggttgggacatctatcttcttctgcctttgatgcttctggttctcaggccttgagatttagcctggaatctacaccattgaccctctagctttcaggcctttaaacttcacttgaccttcctgcatgtccagattgcagacagcagattctgggatttcttagcctccataatcatgtgagccaatatgtgataataaatttctttaaaaatatggattagtaaaatttgcatcctaatgaaaatgtaagcattgtgacagagaatgctttagtcagtctcaaatcctaaatttgagattgaaatttaagatagctta

SEQ ID NO: 17015 - DNA, 3030 bp, Homo sapiens
  ENST00000442921
aagtaaaaaaatggaagggggaaaaggcaaagtattctgccttccaagttagatagctatctttatgaaaggacatatttcaaaggcaatataaagtctttatggtgctcttacctacctatatttgaattgggggatgcttcacctgcttattagtgaaagaagaaagaatacacttagtaaattaaattttttttaaaactttgtctttgctcagaaccagctccacccaaatcactcttcgcagtgaacaaaacccagacttcagtgactttgctgtgggtggaagagggagtagctgatttctttgaagttttctgtcaacaagttggctccagtcagaaaaccaaacttcaggaaccagttgctgtttcttcccatgtcgtgaccatctccagccttcttcctgccactgcctacaattgtagtgtcaccagctttagccatgacagccccagtgtccctacgttcatagccgtctcaacaatggttacagagatgaatcccaatgtggtagtgatctccgtgctggccatccttagcacacttttaattggactgttgcttgttaccctcattattcttaggaaaaagcatctgcagatggctagggagtgtggagctggtacatttgtcaattttgcatccttagagagggatggaaagcttccatacaactggcgtaggagtatatttgctttcttaaccctgctaccctcatgtctttggactgattatcttttggcattttatattaatccttggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggatacaactcaccccaggagtatattgccacccaggggccactgcctgaaaccagaaatgacttctggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcagtgctggcgtgggacggacaggaacattcattgccctggacaggctcttgcagcacattcgggatcatgagtttgttgacatcttagggctggtgtcagaaatgaggtcataccggatgtctatggtacagacagaggagcagtacatttttatccatcagtgtgtgcaactgatgtggatgaagaagaagcagcagttctgcatcagtgatgtcatatacgagaatgttagcaagtcctagttcagaatccggagcagagaggacatgatgtgcgcccatcctcccttgcttccagattgttttagtgggccctgatggtcatttttctaaacagaggccctgctttgtaatatgtggccaaggagataatttatctcacagaagcaccgggaagacttagccttaaagagcctacagtgtccttttggactctttcacttcgggacatttaataatggaccaaattcaacagaacaccaggaaggtcaagacgctctccaaagggcaggaagtacagcacttccgaagagtttagttggccctttgctggttgggctgagttttttatttttaagtgtttgtttttcagtgcaataatttttgtgtgtgtgtgattcttatcagaaagttgaattgttttctgcctacaccgttcatcagccccataacccaggaaggaacaggcattgttagcatcagattatacctcattattaaaaggaggcatggccacacatgaagaaatggtcattctacttcaaagaaattgagccagcactatctgtactccaacattaccggatctggattggggaggttggtcagggaagagaggggttctacccacagatcaactgtgtaatcttttactattcaagctataattcagcttcaaagtagagtagaaaaaaaattgtcttaactgttctagttcttgatggttttcttccttattaacagttggtgtttcttccttggcccttttggactaatgttactgtccaagttctttctcaagaaaccacatctggttcagaagagtgtcaagttggactctttgaactctgttgctgtctgagcaatcgtggtgcctagactttgcattccttgttctgttgacctgcatacatgtgagagctatttctttaagaactatataggctgtgaaaacgcactttctttcccccaaagagctgggaatttatgaagttatggcaatgaactgcagcatgctgggacaattatttgactacttttttttgtaatattgtcaaatgtctctatggattctgacagagatttctttttgttttgttattcttttggttgtcagtttcattttaacgagtgtaactagtaacattttattctttggattttgtataattacagtacatgattgtgtattgtgacatgaatgctgtcaaaatgacattgatggcattgtgaagcctgttactttgtgtcacttcctgataaataagaggtgatgacatggatatacaacagaaaacactttgagttgaaagtaaacacaagctggctgcttccctgtggcaactgtgg

SEQ ID NO: 17016 - DNA, 2946 bp, Homo sapiens
  ENST00000542557
aagtaaaaaaatggaagggggaaaaggcaaagtattctgccttccaagttagatagctatctttatgaaaggacatatttcaaaggcaatataaagtctttatggtgctcttacctacctatatttgaattgggggatgcttcacctgcttattagtgaaagaagaaagaatacacttagtaaattaaattttttttaaaactttgtctttgctcagaaccagctccacccaaatcactcttcgcagtgaacaaaacccagacttcagtgactttgctgtgggtggaagagggagtagctgatttctttgaagttttctgtcaacaagttggctccagtcagaaaaccaaacttcaggaaccagttgctgtttcttcccatgtcgtgaccatctccagccttcttcctgccactgcctacaattgtagtgtcaccagctttagccatgacagccccagtgtccctacgttcatagccgtctcaacaatggttacagagatgaatcccaatgtggtagtgatctccgtgctggccatccttagcacacttttaattggactgttgcttgttaccctcattattcttaggaaaaagcatctgcagatggctagggagtgtggagctggtacatttgtcaattttgcatccttagagagggatggaaagcttccatacaactggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggatacaactcaccccaggagtatattgccacccaggggccactgcctgaaaccagaaatgacttctggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcagtgctggcgtgggacggacaggaacattcattgccctggacaggctcttgcagcacattcgggatcatgagtttgttgacatcttagggctggtgtcagaaatgaggtcataccggatgtctatggtacagacagaggagcagtacatttttatccatcagtgtgtgcaactgatgtggatgaagaagaagcagcagttctgcatcagtgatgtcatatacgagaatgttagcaagtcctagttcagaatccggagcagagaggacatgatgtgcgcccatcctcccttgcttccagattgttttagtgggccctgatggtcatttttctaaacagaggccctgctttgtaatatgtggccaaggagataatttatctcacagaagcaccgggaagacttagccttaaagagcctacagtgtccttttggactctttcacttcgggacatttaataatggaccaaattcaacagaacaccaggaaggtcaagacgctctccaaagggcaggaagtacagcacttccgaagagtttagttggccctttgctggttgggctgagttttttatttttaagtgtttgtttttcagtgcaataatttttgtgtgtgtgtgattcttatcagaaagttgaattgttttctgcctacaccgttcatcagccccataacccaggaaggaacaggcattgttagcatcagattatacctcattattaaaaggaggcatggccacacatgaagaaatggtcattctacttcaaagaaattgagccagcactatctgtactccaacattaccggatctggattggggaggttggtcagggaagagaggggttctacccacagatcaactgtgtaatcttttactattcaagctataattcagcttcaaagtagagtagaaaaaaaattgtcttaactgttctagttcttgatggttttcttccttattaacagttggtgtttcttccttggcccttttggactaatgttactgtccaagttctttctcaagaaaccacatctggttcagaagagtgtcaagttggactctttgaactctgttgctgtctgagcaatcgtggtgcctagactttgcattccttgttctgttgacctgcatacatgtgagagctatttctttaagaactatataggctgtgaaaacgcactttctttcccccaaagagctgggaatttatgaagttatggcaatgaactgcagcatgctgggacaattatttgactacttttttttgtaatattgtcaaatgtctctatggattctgacagagatttctttttgttttgttattcttttggttgtcagtttcattttaacgagtgtaactagtaacattttattctttggattttgtataattacagtacatgattgtgtattgtgacatgaatgctgtcaaaatgacattgatggcattgtgaagcctgttactttgtgtcacttcctgataaataagaggtgatgacatggatatacaacagaaaacactttgagttgaaagtaaacacaagctggctgcttccctgtggcaactgtgg

SEQ ID NO: 17017 - DNA, 4062 bp, Homo sapiens
  ENST00000445537
aagtaaaaaaatggaagggggaaaaggcaaagtattctgccttccaagttagatagctatctttatgaaaggacatatttcaaaggcaatataaagtctttatggtgctcttacctacctatatttgaattgggggatgcttcacctgcttattagtgaaagaagaaagaatacacttagtaaattaaattttttttaaaactttgtctttgctcagaaccagctccacccaaatcactcttcgcagtgaacaaaacccagacttcagtgactttgctgtgggtggaagagggagtagctgatttctttgaagttttctgtcaacaagttggctccagtcagaaaaccaaacttcaggaaccagttgctgtttcttcccatgtcgtgaccatctccagccttcttcctgccactgcctacaattgtagtgtcaccagctttagccatgacagccccagtgtccctacgttcatagccgtctcaacaatggttacagagatgaatcccaatgtggtagtgatctccgtgctggccatccttagcacacttttaattggactgttgcttgttaccctcattattcttaggaaaaagcatctgcagatggctagggagtgtggagctggtacatttgtcaattttgcatccttagagagggatggaaagcttccatacaactggcgtaggagtatatttgctttcttaaccctgctaccctcatgtctttggactgattatcttttggcattttatattaatccttggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggatacaactcaccccaggagtatattgccacccaggggccactgcctgaaaccagaaatgacttctggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcagtgctggcgtgggacggacaggaacattcattgccctggacaggctcttgcagcacattcgggatcatgagtttgttgacatcttagggctggtgtcagaaatgaggtcataccggatgtctatggtacagacagaggagcagtacatttttatccatcagtgtgtgcaactgatgtggatgaagaagaagcagcagttctgcatcagtgatgtcatatacgagaatgttagcaagtcctagttcagaatccggagcagtaagtggagaagagctctccacgagtgctcagtcttagaactattagagggggatgtgatggatgggacaaaagacagcagtagccatttgtattgactctgacttcacatgagtatttcttcccagctcctggcctcacatgggtggtcacagggagaaacaagtactgtagcagatctttgagtttcaatgcaccttggttggtgttggcaacaaacaggagcttctgcacatcatgatgactttacctccattccctctacccagaaccctaaattattctgttattggatctgtgcctgtaatatcaggatactaccatccaaatctatctagatatcttgtgcaaatattttattgattacaagggctgtatacggggttacaaaaagacatgagctggattggacactcctaaaaccaaaaacaacagtgacaatagagtctcaggatagcagagtctgaaaataccttggtctcccccattatgtgagcccttacttgagagcttcatgaagacacttgtaacatattcaacgtcctgtactccagttttgactacgagatcagattttggaggtgtaagtaaacttggctgaggtaacagtaatctgcccatttagttcagtaaacagactgtagagtgtctgactatactgggggaagaggagccaatgacagggtagggagatgacagtggtgcatgatgggagaatcatgaaagtctgggaagcatatggaccagtgggaaggataggattagcactgcacctctacatccatcaagagagacagagcgcacaatggagcaggaaggataaaaaataaagaaagacagagagaaacaaatttgctgggagagggaaagacattcagacccacagaaaggaggcagcacacagagaaagatgcacagatcaacccacatctgcatgggttgtgagactgagcatagtgagagcagtggtggagcaatagaagattgctgtgacaccaggctgcttactgtctttctttgtctcattcacaggagaggacatgatgtgcgcccatcctcccttgcttccagattgttttagtgggccctgatggtcatttttctaaacagaggccctgctttgtaatatgtggccaaggagataatttatctcacagaagcaccgggaagacttagccttaaagagcctacagtgtccttttggactctttcacttcgggacatttaataatggaccaaattcaacagaacaccaggaaggtcaagacgctctccaaagggcaggaagtacagcacttccgaagagtttagttggccctttgctggttgggctgagttttttatttttaagtgtttgtttttcagtgcaataatttttgtgtgtgtgtgattcttatcagaaagttgaattgttttctgcctacaccgttcatcagccccataacccaggaaggaacaggcattgttagcatcagattatacctcattattaaaaggaggcatggccacacatgaagaaatggtcattctacttcaaagaaattgagccagcactatctgtactccaacattaccggatctggattggggaggttggtcagggaagagaggggttctacccacagatcaactgtgtaatcttttactattcaagctataattcagcttcaaagtagagtagaaaaaaaattgtcttaactgttctagttcttgatggttttcttccttattaacagttggtgtttcttccttggcccttttggactaatgttactgtccaagttctttctcaagaaaccacatctggttcagaagagtgtcaagttggactctttgaactctgttgctgtctgagcaatcgtggtgcctagactttgcattccttgttctgttgacctgcatacatgtgagagctatttctttaagaactatataggctgtgaaaacgcactttctttcccccaaagagctgggaatttatgaagttatggcaatgaactgcagcatgctgggacaattatttgactacttttttttgtaatattgtcaaatgtctctatggattctgacagagatttctttttgttttgttattcttttggttgtcagtttcattttaacgagtgtaactagtaacattttattctttggattttgtataattacagtacatgattgtgtattgtgacatgaatgctgtcaaaatgacattgatggcattgtgaagcctgttactttgtgtcacttcctgataaataagaggtgatgacatggatatacaacagaaaacactttgagttgaaagtaaacacaagctggctgcttccctgtggcaactgtgg

SEQ ID NO: 17018 - DNA, 3978 bp, Homo sapiens
  ENST00000544244
aagtaaaaaaatggaagggggaaaaggcaaagtattctgccttccaagttagatagctatctttatgaaaggacatatttcaaaggcaatataaagtctttatggtgctcttacctacctatatttgaattgggggatgcttcacctgcttattagtgaaagaagaaagaatacacttagtaaattaaattttttttaaaactttgtctttgctcagaaccagctccacccaaatcactcttcgcagtgaacaaaacccagacttcagtgactttgctgtgggtggaagagggagtagctgatttctttgaagttttctgtcaacaagttggctccagtcagaaaaccaaacttcaggaaccagttgctgtttcttcccatgtcgtgaccatctccagccttcttcctgccactgcctacaattgtagtgtcaccagctttagccatgacagccccagtgtccctacgttcatagccgtctcaacaatggttacagagatgaatcccaatgtggtagtgatctccgtgctggccatccttagcacacttttaattggactgttgcttgttaccctcattattcttaggaaaaagcatctgcagatggctagggagtgtggagctggtacatttgtcaattttgcatccttagagagggatggaaagcttccatacaactggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggatacaactcaccccaggagtatattgccacccaggggccactgcctgaaaccagaaatgacttctggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcagtgctggcgtgggacggacaggaacattcattgccctggacaggctcttgcagcacattcgggatcatgagtttgttgacatcttagggctggtgtcagaaatgaggtcataccggatgtctatggtacagacagaggagcagtacatttttatccatcagtgtgtgcaactgatgtggatgaagaagaagcagcagttctgcatcagtgatgtcatatacgagaatgttagcaagtcctagttcagaatccggagcagtaagtggagaagagctctccacgagtgctcagtcttagaactattagagggggatgtgatggatgggacaaaagacagcagtagccatttgtattgactctgacttcacatgagtatttcttcccagctcctggcctcacatgggtggtcacagggagaaacaagtactgtagcagatctttgagtttcaatgcaccttggttggtgttggcaacaaacaggagcttctgcacatcatgatgactttacctccattccctctacccagaaccctaaattattctgttattggatctgtgcctgtaatatcaggatactaccatccaaatctatctagatatcttgtgcaaatattttattgattacaagggctgtatacggggttacaaaaagacatgagctggattggacactcctaaaaccaaaaacaacagtgacaatagagtctcaggatagcagagtctgaaaataccttggtctcccccattatgtgagcccttacttgagagcttcatgaagacacttgtaacatattcaacgtcctgtactccagttttgactacgagatcagattttggaggtgtaagtaaacttggctgaggtaacagtaatctgcccatttagttcagtaaacagactgtagagtgtctgactatactgggggaagaggagccaatgacagggtagggagatgacagtggtgcatgatgggagaatcatgaaagtctgggaagcatatggaccagtgggaaggataggattagcactgcacctctacatccatcaagagagacagagcgcacaatggagcaggaaggataaaaaataaagaaagacagagagaaacaaatttgctgggagagggaaagacattcagacccacagaaaggaggcagcacacagagaaagatgcacagatcaacccacatctgcatgggttgtgagactgagcatagtgagagcagtggtggagcaatagaagattgctgtgacaccaggctgcttactgtctttctttgtctcattcacaggagaggacatgatgtgcgcccatcctcccttgcttccagattgttttagtgggccctgatggtcatttttctaaacagaggccctgctttgtaatatgtggccaaggagataatttatctcacagaagcaccgggaagacttagccttaaagagcctacagtgtccttttggactctttcacttcgggacatttaataatggaccaaattcaacagaacaccaggaaggtcaagacgctctccaaagggcaggaagtacagcacttccgaagagtttagttggccctttgctggttgggctgagttttttatttttaagtgtttgtttttcagtgcaataatttttgtgtgtgtgtgattcttatcagaaagttgaattgttttctgcctacaccgttcatcagccccataacccaggaaggaacaggcattgttagcatcagattatacctcattattaaaaggaggcatggccacacatgaagaaatggtcattctacttcaaagaaattgagccagcactatctgtactccaacattaccggatctggattggggaggttggtcagggaagagaggggttctacccacagatcaactgtgtaatcttttactattcaagctataattcagcttcaaagtagagtagaaaaaaaattgtcttaactgttctagttcttgatggttttcttccttattaacagttggtgtttcttccttggcccttttggactaatgttactgtccaagttctttctcaagaaaccacatctggttcagaagagtgtcaagttggactctttgaactctgttgctgtctgagcaatcgtggtgcctagactttgcattccttgttctgttgacctgcatacatgtgagagctatttctttaagaactatataggctgtgaaaacgcactttctttcccccaaagagctgggaatttatgaagttatggcaatgaactgcagcatgctgggacaattatttgactacttttttttgtaatattgtcaaatgtctctatggattctgacagagatttctttttgttttgttattcttttggttgtcagtttcattttaacgagtgtaactagtaacattttattctttggattttgtataattacagtacatgattgtgtattgtgacatgaatgctgtcaaaatgacattgatggcattgtgaagcctgttactttgtgtcacttcctgataaataagaggtgatgacatggatatacaacagaaaacactttgagttgaaagtaaacacaagctggctgcttccctgtggcaactgtgg

SEQ ID NO: 17019 - DNA, 533 bp, Homo sapiens
  ENST00000535311
agtgactttgctgtgggtggaagagggagtagctgatttctttgaagttttctgtcaacaagttggctccagtcagaaaaccaaacttcaggaaccagttgctgtttcttcccatgtcgtgaccatctccagccttcttcctgccactgcctacaattgtagtgtcaccagctttagccatgacagccccagtgtccctacgttcatagccgtctcaacaatggggagtgtggagctggtacatttgtcaattttgcatccttagagagggatggaaagcttccatacaactggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccat

SEQ ID NO: 17020 - DNA, 580 bp, Homo sapiens
  ENST00000538907
tttggcaaatgggaagtataaagtgcagatatgttcatgcaatctagtagagttttaaaaaatgaatctgaaattattattatcttctcatgtaaggaaaagtaaacaaacctgatatgtgtttaatgaaaattaaataaaactgaggtacctgatgtaattatttaaagctgttcaagtttaattattatgttaatcaattcttctgcccagataaatttgtcttttcttttttaattatcaggagtaaaaatggtttaaagaagaggaaactgacaaacccggttcaactggatgactttgatgcctatattaaggatatggccaaagactctgactataaattttctcttcagtttgaggagttgaaattgattggactggatatcccacactttgctgcagatcttccactgaatcgatgtaaaaaccgttacacaaacatcctaccatatgacttcagccgtgtgagattagtctccatgaatgaagaggaaggtgcagactacatcaatgccaactatattcctggatacaactcaccccaggagtatattgccacccaggggccactgcctga

SEQ ID NO: 17021 - DNA, 472 bp, Homo sapiens
  ENST00000535322
tggaagatggtcctgcaacaaaagtctcagattattgtcatgctcactcagtgtaatgagaaaaggagggtgaaatgtgaccattactggccattcacggaagaacctatagcctatggagacatcactgtggagatgatttcagaggaagagcaggacgactgggcctgtagacacttccggatcaactatgctgacgagatgcaggatgtgatgcattttaactacactgcatggcctgatcatggtgtgcccacagcaaatgctgcagaaagtatcctgcagtttgtacacatggtccgacagcaagctaccaagagcaaaggtcccatgatcattcactgcaggtaacctcatcaactgcattttctattaaatattaggagttggttttgtaaggggaacagctcaccattccataagcccttatcaggtttagttgaaaattaaataaactctgatgttttttaaa

SEQ ID NO: 17022 - DNA, 905 bp, Homo sapiens
  ENST00000544706
aagtactgtagcagatctttgagtttcaatgcaccttggttggtgttggcaacaaacaggagcttctgcacatcatgatgactttacctccattccctctacccagaaccctaaattattctgttattggatctgtgcctgtaatatcaggatactaccatccaaatctatctagatatcttgtgcaaatattttattgattacaagggctgtatacggggttacaaaaagacatgagctggattggacactcctaaaaccaaaaacaacagtgacaatagagtctcaggatagcagagtctgaaaataccttggtctcccccattatgtgagcccttacttgagagcttcatgaagacacttgtaacatattcaacgtcctgtactccagttttgactacgagatcagattttggaggtgagaggacatgatgtgcgcccatcctcccttgcttccagattgttttagtgggccctgatggtcatttttctaaacagaggccctgctttgtaatatgtggccaaggagataatttatctcacagaagcaccgggaagacttagccttaaagagcctacagtgtccttttggactctttcacttcgggacatttaataatggaccaaattcaacagaacaccaggaaggtcaagacgctctccaaagggcaggaagtacagcacttccgaagagtttagttggccctttgctggttgggctgagttttttatttttaagtgtttgtttttcagtgcaataatttttgtgtgtgtgtgattcttatcagaaagttgaattgttttctgcctacaccgttcatcagccccataacccaggaaggaacaggcattgttagcatcagattatacctcattattaaaaggaggcatggccacacatgaag

SEQ ID NO: 17023 - DNA, 2818 bp, Homo sapiens
  ENST00000440835
acttaaaacagagtaaggaaatcagaaacaatttcctccacacagaaaagaacagaactctcttacctatgaaccaggtagtttccaagagagacgctgagggatgtttagaaagcctgggacctgcagatgccatgtcaggcacgcttgctcctgcataggagactaaataatctcgatatataaggatggcagtctgttgtcttagatcagtttgagaagcagctctggcagcggggggtgtaggtgtgttgcactacactgaatggaataaggctaaaaatatgtttagtgtctgataagaacgccagttttctcaagctctcatttaacgtcggactttctgttttgcttttaaagaaaaatgttttacaagggcagcatgaagcggacaaaatctggagcaaagaaggattttatgctgttgtcatttttctcagcatctttgttattatagtaacgtgtttgatgattctttacagattaaaagaaagatttcagctttccttaagacaagacaaagagaaaaaccaggagatccacctatcgcccatcacattacagccagcactgtccgaggcaaagacagtccacagcatggtccaacctgagcaggccccaaaggtactgaatgttgtcgtggaccctcaaggccgaggtgctcctgagatcaaagctaccaccgctacctctgtttgcccttctcctttcaaaatgaagcccataggacttcaagagagaagagggtccaacgtatctcttacattggacatgagtagcttggggaacattgaaccctttgtgtctataccaacaccacgggagaaggtagcaatggagtatctgcagtcagccagccgaattctcacaaggtctcagctgagggacgtcgtggcaagttcacatttactccaaagtgaattcatggaaataccaatgaactttgtggatcccaaagaaattgatattccgcgtcatggaactaaaaatcgctataagaccattttaccaaatcccctcagcagagtgtgtttaagaccaaaaaatgtaaccgattcattgagcacctacattaatgctaattatattaggggctacagtggcaaggagaaagccttcattgccacgcagggccccatgatcaacaccgtggatgatttctggcagatggtttggcaggaagacagccctgtgattgttatgatcacaaaactcaaagaaaaaaatgagaaatgtgtgctatactggccggaaaagagagggatatatggaaaagttgaggttctggttatcagtgtaaatgaatgtgataactacaccattcgaaaccttgtcttaaagcaaggaagccacacccaacatgtgaagcattactggtacacctcatggcctgatcacaagactccagacagtgcccagcccctcctacagctcatgctggatgtagaagaagacagacttgcttcccagggccgagggcctgtggttgtccactgcagtgcaggaataggtagaacagggtgttttattgctacatccattggctgtcaacagctgaaagaagaaggagttgtggatgcactaagcattgtctgccagcttcgtatggatagaggtggaatggtgcaaaccagtgagcagtatgaatttgtgcaccatgctctgtgcctgtatgagagcagactttcagcagagactgtccagtgagtcattgaagacttgtcagaccatcaatctcttggggtgattaatcaaattacccacccaaggcttctagaaggagcttcctgcaatggaaggaaggagaagctctgaagcccatgtatggcatggattgtggaagactgggcaacatatttaagatttccagctccttgtgtatatgaatgcatttgtaagcatcccccaaattattctgaaggttttttgatgatggaggtatgataggtttatcacacagcctaaggcagattttgttttgtctgtactgactctatctgccacacagaatgtatgtatgtaatattcagtaataaatgtcatcaggtgatgactggatgagctgctgaagacattcgtattatgtgttagatgctttaatgtttgcaaaatctgtcttgtgaatggactgtcagctgttaaactgttcctgttttgaagtgctattacctttctcagttaccagaatcttgctgctaaagttgcaagtgattgataatggatttttaacagagaagtctttgtttttgaaaaacaaaaatcaaaaacagtaactattttatatggaaatgtgtcttgataatattacctattaaatgtgtatttatagtccctcctatcaaacaattacagagcacaatgattgtcattgggtatatatgtatttactctctattattgggcataaaggtggcttctgctccagaactctatccactgtatttccacatcgtgagtcattttactttaaaagggaaaaacaaatttgtagcaactctgaagtatcaagagttttaactacttgtctctcttttgctaagaagggatttttgaatatgctatctacctggaatctctctctcaacaaaaggtatatgccttcaggaatgatataatctgtcccattttcgaggctccttataaggacatttccatgtatgtccttacatttctgaaagctttcaatcttcaagagacaaaaaaaattaaaataactaccctcagcaaacactagctgttctgctcatatatgaatttttaatgcagcaatgttgactttgtttcatactgccaataaactcttaatactaaatactga

SEQ ID NO: 17024 - DNA, 1927 bp, Homo sapiens
  ENST00000537619
agaagcgagcagcatttccatttatcaagtaggtgcagaagcctgtgcaagtattaagagtcagggtgcaggcggcaagctcctgctttgcagcttttcttactggttttgagagccaccttcctaaagagggccctgctgctcaggtctgatcgtggacaatggggcacgtacgccagactgctggactactgaatgaatgcctctttctttgttcaataccttttccaagattctttgtcattcttcttggactcatcgggaggcatgggttttaagatacacagtagctcgggtcttacagcgaaataattgatgcttcattgaaagaaaccaggcaaattgaaatgtgtgctatactggccggaaaagagagggatatatggaaaagttgaggttctggttatcagtgtaaatgaatgtgataactacaccattcgaaaccttgtcttaaagcaaggaagccacacccaacatgtgaagcattactggtacacctcatggcctgatcacaagactccagacagtgcccagcccctcctacagctcatgctggatgtagaagaagacagacttgcttcccagggccgagggcctgtggttgtccactgcagtgcaggaataggtagaacagggtgttttattgctacatccattggctgtcaacagctgaaagaagaaggagttgtggatgcactaagcattgtctgccagcttcgtatggatagaggtggaatggtgcaaaccagtgagcagtatgaatttgtgcaccatgctctgtgcctgtatgagagcagactttcagcagagactgtccagtgagtcattgaagacttgtcagaccatcaatctcttggggtgattaatcaaattacccacccaaggcttctagaaggagcttcctgcaatggaaggaaggagaagctctgaagcccatgtatggcatggattgtggaagactgggcaacatatttaagatttccagctccttgtgtatatgaatgcatttgtaagcatcccccaaattattctgaaggttttttgatgatggaggtatgataggtttatcacacagcctaaggcagattttgttttgtctgtactgactctatctgccacacagaatgtatgtatgtaatattcagtaataaatgtcatcaggtgatgactggatgagctgctgaagacattcgtattatgtgttagatgctttaatgtttgcaaaatctgtcttgtgaatggactgtcagctgttaaactgttcctgttttgaagtgctattacctttctcagttaccagaatcttgctgctaaagttgcaagtgattgataatggatttttaacagagaagtctttgtttttgaaaaacaaaaatcaaaaacagtaactattttatatggaaatgtgtcttgataatattacctattaaatgtgtatttatagtccctcctatcaaacaattacagagcacaatgattgtcattgggtatatatgtatttactctctattattgggcataaaggtggcttctgctccagaactctatccactgtatttccacatcgtgagtcattttactttaaaagggaaaaacaaatttgtagcaactctgaagtatcaagagttttaactacttgtctctcttttgctaagaagggatttttgaatatgctatctacctggaatctctctctcaacaaaaggtatatgccttcaggaatgatataatctgtcccattttcgaggctccttataaggacatttccatgtatgtccttacatttctgaaagctttcaatcttcaagagacaaaaaaaattaaaataactaccctcagcaaacactagctgttctgctcatatatgaatttttaatgcagcaatgttgactttgtttcatactgccaataaactcttaatactaaa

SEQ ID NO: 17025 - DNA, 2966 bp, Homo sapiens
  ENST00000551219
gaaccaggtagtttccaagagagacgctgagggatgtttagaaagcctgggacctgcagatgccatgtcaggcacgcttgctcctgcataggagactaaataatctcgatatataaggatggcagtctgttgtcttagatcagtttgagaagcagctctggcagcggggggtgtaggtgtgttgcactacactgaatggaataaggctaaaaatatgtttagtgtctgataagaacgccagttttctcaagctctcatttaacgtcggactttctgttttgcttttaaagaaaaatgttttacaagggcagcatgaagcggacaaaatctggagcaaagaaggattttatgctgttgtcatttttctcagcatctttgttattatagtaacgtgtttgatgattctttacagattaaaagaaagatttcagctttccttaagacaagacaaagagaaaaaccaggagatccacctatcgcccatcacattacagccagcactgtccgaggcaaagacagtccacagcatggtccaacctgagcaggccccaaaggtactgaatgttgtcgtggaccctcaaggccgaggtgctcctgagatcaaagctaccaccgctacctctgtttgcccttctcctttcaaaatgaagcccataggacttcaagagaggaaataccaatgaactttgtggatcccaaagaaattgatattccgcgtcatggaactaaaaatcgctataagaccattttaccaaatcccctcagcagagtgtgtttaagaccaaaaaatgtaaccgattcattgagcacctacattaatgctaattatattaggggctacagtggcaaggagaaagccttcattgccacgcagggccccatgatcaacaccgtggatgatttctggcagatggtttggcaggaagacagccctgtgattgttatgatcacaaaactcaaagaaaaaaatgagaagaggaggcttacagggctggcacctgcccacacctggcattcgacatttccctgggctaagctgagtgggagcagatgcccccatcctatgaccagggcctgtgcaggagccatcacaccaccttgctgatgatgacacctagttcttcaatttcacactggacttcatctcccttcttgagaaagacagaaggtttcctgaatacaccaacacctggggaggtcccagtcaggatgacatcccctgggtaaaagaaatgtgtgctatactggccggaaaagagagggatatatggaaaagttgaggttctggttatcagtgtaaatgaatgtgataactacaccattcgaaaccttgtcttaaagcaaggaagccacacccaacatgtgaagcattactggtacacctcatggcctgatcacaagactccagacagtgcccagcccctcctacagctcatgctggatgtagaagaagacagacttgcttcccagggccgagggcctgtggttgtccactgcagtgcaggaataggtagaacagggtgttttattgctacatccattggctgtcaacagctgaaagaagaaggagttgtggatgcactaagcattgtctgccagcttcgtatggatagaggaagaaactaaagtgcaaggggtttcgaggaatttgtccaagatgcatacagctaagaattggcagaggagggatttgaactcaccttggctgatgccaaatccaagtacttgatcattaggctgtaccacctccccagtaatgttacacagaggtggaatggtgcaaaccagtgagcagtatgaatttgtgcaccatgctctgtgcctgtatgagagcagactttcagcagagactgtccagtgagtcattgaagacttgtcagaccatcaatctcttggggtgattaatcaaattacccacccaaggcttctagaaggagcttcctgcaatggaaggaaggagaagctctgaagcccatgtatggcatggattgtggaagactgggcaacatatttaagatttccagctccttgtgtatatgaatgcatttgtaagcatcccccaaattattctgaaggttttttgatgatggaggtatgataggtttatcacacagcctaaggcagattttgttttgtctgtactgactctatctgccacacagaatgtatgtatgtaatattcagtaataaatgtcatcaggtgatgactggatgagctgctgaagacattcgtattatgtgttagatgctttaatgtttgcaaaatctgtcttgtgaatggactgtcagctgttaaactgttcctgttttgaagtgctattacctttctcagttaccagaatcttgctgctaaagttgcaagtgattgataatggatttttaacagagaagtctttgtttttgaaaaacaaaaatcaaaaacagtaactattttatatggaaatgtgtcttgataatattacctattaaatgtgtatttatagtccctcctatcaaacaattacagagcacaatgattgtcattgggtatatatgtatttactctctattattgggcataaaggtggcttctgctccagaactctatccactgtatttccacatcgtgagtcattttactttaaaagggaaaaacaaatttgtagcaactctgaagtatcaagagttttaactacttgtctctcttttgctaagaagggatttttgaatatgctatctacctggaatctctctctcaacaaaaggtatatgccttcaggaatgatataatctgtcccattttcgaggctccttataaggacatttccatgtatgtccttacatttctgaaagctttcaatcttcaagagacaaaaaaaattaaaataactaccctcagcaaacactagctgttctgctcatatatgaatttttaatgcagcaatgttgactttgtttcatactgccaataaactcttaatactaaa

SEQ ID NO: 17026 - DNA, 1729 bp, Homo sapiens
  ENST00000547752
gaaataattgatgcttcattgaaagaaaccaggcaaattgaaatgtgtgctatactggccggaaaagagagggatatatggaaaagttgaggttctggttatcagtgtaaatgaatgtgataactacaccattcgaaaccttgtcttaaagaaataaattgccagcaagatgggggtgataaaaggcattcagtattgtggtttggatgacttttagttctacaagtgaatgaggcatttggtggctgttgctattttcagcaaggaagccacacccaacatgtgaagcattactggtacacctcatggcctgatcacaagactccagacagtgcccagcccctcctacagctcatgctggatgtagaagaagacagacttgcttcccagggccgagggcctgtggttgtccactgcagtgcaggaataggtagaacagggtgttttattgctacatccattggctgtcaacagctgaaagaagaaggagttgtggatgcactaagcattgtctgccagcttcgtatggatagaggtggaatggtgcaaaccagtgagcagtatgaatttgtgcaccatgctctgtgcctgtatgagagcagactttcagcagagactgtccagtgagtcattgaagacttgtcagaccatcaatctcttggggtgattaatcaaattacccacccaaggcttctagaaggagcttcctgcaatggaaggaaggagaagctctgaagcccatgtatggcatggattgtggaagactgggcaacatatttaagatttccagctccttgtgtatatgaatgcatttgtaagcatcccccaaattattctgaaggttttttgatgatggaggtatgataggtttatcacacagcctaaggcagattttgttttgtctgtactgactctatctgccacacagaatgtatgtatgtaatattcagtaataaatgtcatcaggtgatgactggatgagctgctgaagacattcgtattatgtgttagatgctttaatgtttgcaaaatctgtcttgtgaatggactgtcagctgttaaactgttcctgttttgaagtgctattacctttctcagttaccagaatcttgctgctaaagttgcaagtgattgataatggatttttaacagagaagtctttgtttttgaaaaacaaaaatcaaaaacagtaactattttatatggaaatgtgtcttgataatattacctattaaatgtgtatttatagtccctcctatcaaacaattacagagcacaatgattgtcattgggtatatatgtatttactctctattattgggcataaaggtggcttctgctccagaactctatccactgtatttccacatcgtgagtcattttactttaaaagggaaaaacaaatttgtagcaactctgaagtatcaagagttttaactacttgtctctcttttgctaagaagggatttttgaatatgctatctacctggaatctctctctcaacaaaaggtatatgccttcaggaatgatataatctgtcccattttcgaggctccttataaggacatttccatgtatgtccttacatttctgaaagctttcaatcttcaagagacaaaaaaaattaaaataactaccctcagcaaacactagctgttctgctcatatatgaatttttaatgcagcaatgttgactttgtttcatactgccaataaactcttaatact

SEQ ID NO: 17027 - DNA, 3529 bp, Homo sapiens
  ENST00000283228
accaccccagcgatggagcctactctgctccaagccgccgctaagacccggagaagcggaatttcactttgaaattcccttgcctcgtgagggccggcgctgggcatgctcagtagccgcggcgctgctgctgggctgctgggctggcgcggagtccaccctgccgtctccgccttggcttctgggcgtccagaaggccaggcatttgccgcctctgagcgcttctgttccccttacccgcaacctcctactgctcttcctctctccctctcttagggaggttgaagctggtgctggtttctgtcggcgccacagactgactgctctgcaaaccccagccgaggacctgaatcccggagactagaagacccttggcggtggctctttctaatagcactttacctgaagtggggtcgtggtggagtttctcctccacctctcaatgcaaacactatgcggagagcagtctgcttccctgcgctgtgcctgctccttaatcttcacgctgcagggtgcttttcaggaaacaatgatcattttttggcaattaatcagaagaagagtgggaagccggtattcatttataagcattcacaagacattgagaagagcctggatatagccccacaaaaaatctacagacatagctaccattcctcttccgaagctcaagtaagcaaacgccaccagattgtcaattcagcatttcctagacccgcatatgacccgtctctcaatctgctggccatggatggtcaagatcttgaagtggaaaatctcccaatcccagcagcaaatgtaattgtggtgacactgcaaatggatgtaaacaagctgaacataaccttgcttcggatcttccgccaaggagtggctgcagctttaggactcttaccccagcaagtgcacatcaatcgcctcattggaaagaagaacagtattgaactgtttgtgtctcccataaaccgaaaaacaggaatttctgatgctctgccctctgaggaagttcttcgttcacttaatatcaatgttttgcatcaaagtttatcccagtttggaattacagaagtctctcctgagaaaaatgttttacaagggcagcatgaagcggacaaaatctggagcaaagaaggattttatgctgttgtcatttttctcagcatctttgttattatagtaacgtgtttgatgattctttacagattaaaagaaagatttcagctttccttaagacaagacaaagagaaaaaccaggagatccacctatcgcccatcacattacagccagcactgtccgaggcaaagacagtccacagcatggtccaacctgagcaggccccaaaggtactgaatgttgtcgtggaccctcaaggccgaggtgctcctgagatcaaagctaccaccgctacctctgtttgcccttctcctttcaaaatgaagcccataggacttcaagagagaagagggtccaacgtatctcttacattggacatgagtagcttggggaacattgaaccctttgtgtctataccaacaccacgggagaaggtagcaatggagtatctgcagtcagccagccgaattctcacaaggtctcagctgagggacgtcgtggcaagttcacatttactccaaagtgaattcatggaaataccaatgaactttgtggatcccaaagaaattgatattccgcgtcatggaactaaaaatcgctataagaccattttaccaaatcccctcagcagagtgtgtttaagaccaaaaaatgtaaccgattcattgagcacctacattaatgctaattatattaggggctacagtggcaaggagaaagccttcattgccacgcagggccccatgatcaacaccgtggatgatttctggcagatggtttggcaggaagacagccctgtgattgttatgatcacaaaactcaaagaaaaaaatgagaaatgtgtgctatactggccggaaaagagagggatatatggaaaagttgaggttctggttatcagtgtaaatgaatgtgataactacaccattcgaaaccttgtcttaaagcaaggaagccacacccaacatgtgaagcattactggtacacctcatggcctgatcacaagactccagacagtgcccagcccctcctacagctcatgctggatgtagaagaagacagacttgcttcccagggccgagggcctgtggttgtccactgcagtgcaggaataggtagaacagggtgttttattgctacatccattggctgtcaacagctgaaagaagaaggagttgtggatgcactaagcattgtctgccagcttcgtatggatagaggtggaatggtgcaaaccagtgagcagtatgaatttgtgcaccatgctctgtgcctgtatgagagcagactttcagcagagactgtccagtgagtcattgaagacttgtcagaccatcaatctcttggggtgattaatcaaattacccacccaaggcttctagaaggagcttcctgcaatggaaggaaggagaagctctgaagcccatgtatggcatggattgtggaagactgggcaacatatttaagatttccagctccttgtgtatatgaatgcatttgtaagcatcccccaaattattctgaaggttttttgatgatggaggtatgataggtttatcacacagcctaaggcagattttgttttgtctgtactgactctatctgccacacagaatgtatgtatgtaatattcagtaataaatgtcatcaggtgatgactggatgagctgctgaagacattcgtattatgtgttagatgctttaatgtttgcaaaatctgtcttgtgaatggactgtcagctgttaaactgttcctgttttgaagtgctattacctttctcagttaccagaatcttgctgctaaagttgcaagtgattgataatggatttttaacagagaagtctttgtttttgaaaaacaaaaatcaaaaacagtaactattttatatggaaatgtgtcttgataatattacctattaaatgtgtatttatagtccctcctatcaaacaattacagagcacaatgattgtcattgggtatatatgtatttactctctattattgggcataaaggtggcttctgctccagaactctatccactgtatttccacatcgtgagtcattttactttaaaagggaaaaacaaatttgtagcaactctgaagtatcaagagttttaactacttgtctctcttttgctaagaagggatttttgaatatgctatctacctggaatctctctctcaacaaaaggtatatgccttcaggaatgatataatctgtcccattttcgaggctccttataaggacatttccatgtatgtccttacatttctgaaagctttcaatcttcaagagacaaaaaaaattaaaataactaccctcagcaaacactagctgttctgctcatatatgaatttttaatgcagcaatgttgactttgtttcatactgccaataaactcttaatact

SEQ ID NO: 17028 - DNA, 2037 bp, Homo sapiens
  ENST00000342084
aaacagtaccaggcggttacctccaggtgactaaatgaggcttcatctcagcacacaagcttagaaagctttacgattagtcctgcttgctatggtaaggaaataacacaaagaagagtgcaaatggaagtcgacttcatcacaacatgcagtcaatttccaaacagacactgcaaatggatgtaaacaagctgaacataaccttgcttcggatcttccgccaaggagtggctgcagctttaggactcttaccccagcaagtgcacatcaatcgcctcattggaaagaagaacagtattgaactgtttgtgtctcccataaaccgaaaaacaggaatttctgatgctctgccctctgaggaagttcttcgttcacttaatatcaatgttttgcatcaaagtttatcccagtttggaattacagaagtctctcctgagaaaaatgttttacaagggcagcatgaagcggacaaaatctggagcaaagaaggattttatgctgttgtcatttttctcagcatctttgttattatagtaacgtgtttgatgattctttacagattaaaagaaagatttcagctttccttaagacaagacaaagagaaaaaccaggagatccacctatcgcccatcacattacagccagcactgtccgaggcaaagacagtccacagcatggtccaacctgagcaggccccaaaggtactgaatgttgtcgtggaccctcaaggccgaggtgctcctgagatcaaagctaccaccgctacctctgtttgcccttctcctttcaaaatgaagcccataggacttcaagagagaagagggtccaacgtatctcttacattggacatgagtagcttggggaacattgaaccctttgtgtctataccaacaccacgggagaaggtagcaatggagtatctgcagtcagccagccgaattctcacaaggtctcagctgagggacgtcgtggcaagttcacatttactccaaagtgaattcatggaaataccaatgaactttgtggatcccaaagaaattgatattccgcgtcatggaactaaaaatcgctataagaccattttaccaaatcccctcagcagagtgtgtttaagaccaaaaaatgtaaccgattcattgagcacctacattaatgctaattatattaggggctacagtggcaaggagaaagccttcattgccacgcagggccccatgatcaacaccgtggatgatttctggcagatggtttggcaggaagacagccctgtgattgttatgatcacaaaactcaaagaaaaaaatgagaaatgtgtgctatactggccggaaaagagagggatatatggaaaagttgaggttctggttatcagtgtaaatgaatgtgataactacaccattcgaaaccttgtcttaaagcaaggaagccacacccaacatgtgaagcattactggtacacctcatggcctgatcacaagactccagacagtgcccagcccctcctacagctcatgctggatgtagaagaagacagacttgcttcccagggccgagggcctgtggttgtccactgcagtgcaggaataggtagaacagggtgttttattgctacatccattggctgtcaacagctgaaagaagaaggagttgtggatgcactaagcattgtctgccagcttcgtatggatagaggtggaatggtgcaaaccagtgagcagtatgaatttgtgcaccatgctctgtgcctgtatgagagcagactttcagcagagactgtccagtgagtcattgaagacttgtcagaccatcaatctcttggggtgattaatcaaattacccacccaaggcttctagaaggagcttcctgcaatggaaggaaggagaagctctgaagcccatgtatggcatggattgtggaagactgggcaacatatttaagatttccagctccttgtgtatatgaatgcatttgtaagcatcccccaaattattctgaaggttttttgatgatggaggtatgataggtttatcacacag

SEQ ID NO: 17029 - DNA, 1603 bp, Homo sapiens
  ENST00000549308
aaaagtaaagaggtagtacagcacgtaatccagggtgctgatgttgtgggaggggacttaaaacagagtaaggaaatcagaaacaatttcctccacacagaaaagaacagaactctcttacctatgaaccagaaaaatgttttacaagggcagcatgaagcggacaaaatctggagcaaagaaggattttatgctgttgtcatttttctcagcatctttgttattatagtaacgtgtttgatgattctttacagattaaaagaaagatttcagctttccttaagacaagacaaagagaaaaaccaggagatccacctatcgcccatcacattacagccagcactgtccgaggcaaagacagtccacagcatggtccaacctgagcaggccccaaaggtactgaatgttgtcgtggaccctcaaggccgaggtgctcctgagatcaaagctaccaccgctacctctgtttgcccttctcctttcaaaatgaagcccataggacttcaagagagaagagggtccaacgtatctcttacattggacatgagtagcttggggaacattgaaccctttgtgtctataccaacaccacgggagaaggtagcaatggagtatctgcagtcagccagccgaattctcacaaggtctcagctgagggacgtcgtggcaagttcacatttactccaaagtgaattcatggaaataccaatgaactttgtggatcccaaagaaattgatattccgcgtcatggaactaaaaatcgctataagaccattttaccaaatcccctcagcagagtgtgtttaagaccaaaaaatgtaaccgattcattgagcacctacattaatgctaattatattaggggctacagtggcaaggagaaagccttcattgccacgcagggccccatgatcaacaccgtggatgatttctggcagatggtttggcaggaagacagccctgtgattgttatgatcacaaaactcaaagaaaaaaatgagaaatgtgtgctatactggccggaaaagagagggatatatggaaaagttgaggttctggttatcagtgtaaatgaatgtgataactacaccattcgaaaccttgtcttaaagcaaggaagccacacccaacatgtgaagcattactggtacacctcatggcctgatcacaagactccagacagtgcccagcccctcctacagctcatgctggatgtagaagaagacagacttgcttcccagggccgagggcctgtggttgtccactgcagtgcaggaataggtagaacagggtgttttattgctacatccattggctgtcaacagctgaaagaagaaggagttgtggatgcactaagcattgtctgccagcttcgtatggatagaggtggaatggtgcaaaccagtgagcagtatgaatttgtgcaccatgctctgtgcctgtatgagagcagactttcagcagagactgtccagtgagtcattgaagacttgtcagaccatcaatctcttggggtgattaatcaaattacccacccaaggcttctagaaggagcttcctgcaatggaaggaaggagaagctctgaagcccatgtatggcat

SEQ ID NO: 17030 - DNA, 862 bp, Homo sapiens
  ENST00000549107
atgcaccagataatcaatacataacaggtttctacttactggttattggcattctaaggaactttaaaaagggtaaatctgtttaatatattcttttttgttttcttcattagatcccctcagcagagtgtgtttaagaccaaaaaatgtaaccgattcattgagcacctacattaatgctaattatattaggggctacagtggcaaggagaaagccttcattgccacgcagggccccatgatcaacaccgtggatgatttctggcagatggtttggcaggaagacagccctgtgattgttatgatcacaaaactcaaagaaaaaaatgagaaatgtgtgctatactggccggaaaagagagggatatatggaaaagttgaggttctggttatcagtgtaaatgaatgtgataactacaccattcgaaaccttgtcttaaagcaaggaagccacacccaacatgtgaagcattactggtacacctcatggcctgatcacaagactccagacagtgcccagcccctcctacagctcatgctggatgtagaagaagacagacttgcttcccagggccgagggcctgtggttgtccactgcagtgcaggaataggtagaacagggtgttttattgctacatccattggctgtcaacagctgaaagaagaaggagttgtggatgcactaagcattgtctgccagcttcgtatggatagaggtggaatggtgcaaaccagtgagcagtatgaatttgtgcaccatgctctgtgcctgtatgagagcagactttcagcagagactgtccagtgagtcattgaagacttgtcagaccatcaatctcttggggtgattaatcaaattacc

SEQ ID NO: 17031 - DNA, 1374 bp, Homo sapiens
  ENST00000548220
aatgcaccacaagcttttgtttgcacttgtttcacttttgtttaaaagtaaagaggtagtacagcacgtaatccagggtgctgatgttgtgggaggggacttaaaacagagtaaggaaatcagaaacaatttcctccacacagaaaagaacagaactctcttacctatgaaccagaaaaatgttttacaagggcagcatgaagcggacaaaatctggagcaaagaaggattttatgctgttgtcatttttctcagcatctttgttattatagtaacgtgtttgatgattctttacagattaaaagaaagatttcagctttccttaagacaagacaaagagaaaaaccaggagatccacctatcgcccatcacattacagccagcactgtccgaggcaaagacagtccacagcatggtccaacctgagcaggccccaaaggtactgaatgttgtcgtggaccctcaaggccgaggtgctcctgagatcaaagctaccaccgctacctctgtttgcccttctcctttcaaaatgaagcccataggacttcaagagagaagagggtccaacgtatctcttacattggacatgagtagcttggggaacattgaaccctttgtgtctataccaacaccacgggagaaggtagcaatggagtatctgcagtcagccagccgaattctcacaaggtctcagctgagggacgtcgtggcaagttcacatttactccaaagtgaattcatggaaataccaatgaactttgtggatcccaaagaaattgatattccgcgtcatggaactaaaaatcgctataagaccattttaccaaatcccctcagcagagtgtgtttaagaccaaaaaatgtaaccgattcattgagcacctacattaatgctaattatattaggggctacagtggcaaggagaaagccttcattgccacgcagggccccatgatcaacaccgtggatgatttctggcagatggtttggcaggaagacagccctgtgattgttatgatcacaaaactcaaagaaaaaaatgagaaatgtgtgctatactggccggaaaagagagggatatatggaaaagttgaggttctggttatcagtgtaaatgaatgtgataactacaccattcgaaaccttgtcttaaagaaataaattgccagcaagatgggggtgataaaaggcattcagtattgtggtttggatgacttttagttctacaagtgaatgaggcatttggtggctgttgctattttcagcaaggaagccacacccaacatgtgaagcattactggtacacctcatggcctgatcacaagactccagacagtgcccagcccctcctacagctcatgctggatgtagaa

SEQ ID NO: 17032 - DNA, 1024 bp, Homo sapiens
  ENST00000550661
acttgtttcacttttgtttaaaagtaaagaggtagtacagcacgtaatccagggtgctgatgttgtgggaggggacttaaaacagagtaaggaaatcagaaacaatttcctccacacagaaaagaacagaactctcttacctatgaaccaggtagtttccaagagagacgctgagggatgtttagaaagcctgggacctgcagatgccatgtcaggcacgcttgctcctgcataggagactaaataatctcgatatataaggatggcagtctgttgtcttagatcagtttgagaagcagctctggcagcggggggtgtagaaaaatgttttacaagggcagcatgaagcggacaaaatctggagcaaagaaggattttatgctgttgtcatttttctcagcatctttgttattatagtaacgtgtttgatgattctttacagattaaaagaaagatttcagctttccttaagacaagacaaagagaaaaaccaggagatccacctatcgcccatcacattacagccagcactgtccgaggcaaagacagtccacagcatggtccaacctgagcaggccccaaaggtactgaatgttgtcgtggaccctcaaggccgaggtgctcctgagatcaaagctaccaccgctacctctgtttgcccttctcctttcaaaatgaagcccataggacttcaagagagaagagggtccaacgtatctcttacattggacatgagtagcttggggaacattgaaccctttgtgtctataccaacaccacgggagaaggtagcaatggagtatctgcagtcagccagccgaattctcacaaggtctcagctgagggacgtcgtggcaagttcacatttactccaaagtgaattcatggaaataccaatgaactttgtggatcccaaagaaattgatattccgcgtcatggaactaaaaatcgctataagaccattttaccaaatcccctcagcagagtgtgtttaagaccaaaaaatgtaaccgattcattgag

SEQ ID NO: 17033 - DNA, 2632 bp, Homo sapiens
  ENST00000378778
aatgcaccacaagcttttgtttgcacttgtttcacttttgtttaaaagtaaagaggtagtacagcacgtaatccagggtgctgatgttgtgggaggggacttaaaacagagtaaggaaatcagaaacaatttcctccacacagaaaagaacagaactctcttacctatgaaccagaaaaatgttttacaagggcagcatgaagcggacaaaatctggagcaaagaaggattttatgctgttgtcatttttctcagcatctttgttattatagtaacgtgtttgatgattctttacagattaaaagaaagatttcagctttccttaagacaagacaaagagaaaaaccaggagatccacctatcgcccatcacattacagccagcactgtccgaggcaaagacagtccacagcatggtccaacctgagcaggccccaaaggtactgaatgttgtcgtggaccctcaaggccgaggtgctcctgagatcaaagctaccaccgctacctctgtttgcccttctcctttcaaaatgaagcccataggacttcaagagagaagagggtccaacgtatctcttacattggacatgagtagcttggggaacattgaaccctttgtgtctataccaacaccacgggagaaggtagcaatggagtatctgcagtcagccagccgaattctcacaaggtctcagctgagggacgtcgtggcaagttcacatttactccaaagtgaattcatggaaataccaatgaactttgtggatcccaaagaaattgatattccgcgtcatggaactaaaaatcgctataagaccattttaccaaatcccctcagcagagtgtgtttaagaccaaaaaatgtaaccgattcattgagcacctacattaatgctaattatattaggggctacagtggcaaggagaaagccttcattgccacgcagggccccatgatcaacaccgtggatgatttctggcagatggtttggcaggaagacagccctgtgattgttatgatcacaaaactcaaagaaaaaaatgagaaatgtgtgctatactggccggaaaagagagggatatatggaaaagttgaggttctggttatcagtgtaaatgaatgtgataactacaccattcgaaaccttgtcttaaagcaaggaagccacacccaacatgtgaagcattactggtacacctcatggcctgatcacaagactccagacagtgcccagcccctcctacagctcatgctggatgtagaagaagacagacttgcttcccagggccgagggcctgtggttgtccactgcagtgcaggaataggtagaacagggtgttttattgctacatccattggctgtcaacagctgaaagaagaaggagttgtggatgcactaagcattgtctgccagcttcgtatggatagaggtggaatggtgcaaaccagtgagcagtatgaatttgtgcaccatgctctgtgcctgtatgagagcagactttcagcagagactgtccagtgagtcattgaagacttgtcagaccatcaatctcttggggtgattaatcaaattacccacccaaggcttctagaaggagcttcctgcaatggaaggaaggagaagctctgaagcccatgtatggcatggattgtggaagactgggcaacatatttaagatttccagctccttgtgtatatgaatgcatttgtaagcatcccccaaattattctgaaggttttttgatgatggaggtatgataggtttatcacacagcctaaggcagattttgttttgtctgtactgactctatctgccacacagaatgtatgtatgtaatattcagtaataaatgtcatcaggtgatgactggatgagctgctgaagacattcgtattatgtgttagatgctttaatgtttgcaaaatctgtcttgtgaatggactgtcagctgttaaactgttcctgttttgaagtgctattacctttctcagttaccagaatcttgctgctaaagttgcaagtgattgataatggatttttaacagagaagtctttgtttttgaaaaacaaaaatcaaaaacagtaactattttatatggaaatgtgtcttgataatattacctattaaatgtgtatttatagtccctcctatcaaacaattacagagcacaatgattgtcattgggtatatatgtatttactctctattattgggcataaaggtggcttctgctccagaactctatccactgtatttccacatcgtgagtcattttactttaaaagggaaaaacaaatttgtagcaactctgaagtatcaagagttttaactacttgtctctcttttgctaagaagggatttttgaatatgctatctacctggaatctctctctcaacaaaaggtatatgccttcaggaatgatataatctgtcccattttcgaggctccttataaggacatttccatgtatgtccttacatttctgaaagctttcaatcttcaagagacaaaaaaaattaaaataactaccctcagcaaacactagctgttctgctcatatatgaatttttaatgcagcaatgttgactttgtttcatactgccaataaactcttaatactaaatactg

SEQ ID NO: 17034 - DNA, 12453 bp, Homo sapiens
  ENST00000373187
atggcgagcctcgccgcgctcgccctcagcctgctcctgaggctgcagctgccgccactgcccggcgcccgggctcagagcgccgcaggtggctgttcctttgatgagcactacagcaactgtggttatagtgtggctctagggaccaatgggttcacctgggagcagattaacacatgggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccagggcctcccctcaccaccaggaccaagtgtgcagatccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgttccaggagctgttcctctagaatccatccaaggggggccctttgaggagaagatctacatccagtggaaacctcccaatgagaccaatggggtcatcacgctctacgagatcaactacaaggctgtcggctcgctggacccaagtgctgacctctcgagccagagggggaaagtgttcaagctccggaatgaaacccaccacctctttgtgggtctgtacccagggaccacctattccttcaccatcaaggccagcacagcaaagggctttgggccccctgtcaccactcggattgccaccaaaatttcagctccatccatgcctgagtacgacacagacaccccattgaatgagacagacacgaccatcacagtgatgctgaaacccgctcagtcccggggagctcctgtcagtgtttatcagctggttgtcaaggaggagcgacttcagaagtcacggagggcagctgacattattgagtgcttttcggtgcccgtgagctatcggaatgcctccagcctcgattctctacactactttgctgctgagttgaagcctgccaacctgcctgtcacccagccatttacagtgggtgacaataagacatacaatggctactggaaccctcctctctctcccctgaaaagctacagcatctacttccaggcactcagcaaagccaatggagagaccaaaatcaactgtgttcgtctggctacaaaaggtgcctccacccagaattctaacactgtggagccagagaagcaggtggacaacaccgtgaagatggctggcgtgatcgctggcctcctcatgttcatcatcattctcctgggcgtgatgctcaccatcaaaaggagaagaaatgcttattcctactcctattacttgaagctggccaagaagcagaaggagacccagagtggagcccagagggagatggggcctgtggcctctgccgacaaacccaccaccaagctcagcgccagccgcaatgatgaaggcttctcttctagttctcaggacgtcaacggattcacagatggcagccgcggggagctttcccagcccaccctcacgatccagactcatccctaccgcacctgtgaccctgtggagatgagctacccccgggaccagttccaacccgccatccgggtggctgacttgctgcagcacatcacgcagatgaagagaggccagggctacgggttcaaggaggaatacgaggccttaccagaggggcagacagcttcgtgggacacagccaaggaggatgaaaaccgcaataagaatcgatatgggaacatcatatcctacgaccattcccgggtgaggctgctggtgctggatggagacccgcactctgactacatcaatgccaactacattgacggataccatcgacctcggcactacattgcgactcaaggtccgatgcaggagactgtaaaggacttttggagaatgatctggcaggagaactccgccagcatcgtcatggtcacaaacctggtggaagtgggcagggtgaaatgtgtgcgatactggccagatgacacggaggtctacggagacattaaagtcaccctgattgaaacagagcccctggcagaatacgtcatacgcaccttcacagtccagaagaaaggctaccatgagatccgggagctccgcctcttccacttcaccagctggcctgaccacggcgttccctgctatgccactggccttctgggcttcgtccgccaggtcaagttcctcaaccccccggaagctgggcccatagtggtccactgcagtgctggggctgggcggactggctgcttcattgccattgacaccatgcttgacatggccgagaatgaaggggtggtggacatcttcaactgcgtgcgtgagctccgggcccaaagggtcaacctggtacagacagaggagcaatatgtgtttgtgcacgatgccatcctggaagcgtgcctctgtggcaacactgccatccctgtgtgtgagttccgttctctctactacaatatcagcaggctggacccccagacaaactccagccaaatcaaagatgaatttcagaccctcaacattgtgacaccccgtgtgcggcccgaggactgcagcattgggctcctgccccggaaccatgataagaatcgaagtatggacgtgctgcctctggaccgctgcctgcccttccttatctcagtggacggagaatccagcaattacatcaacgcagcactgatggatagccacaagcagcctgccgccttcgtggtcacccagcaccctctacccaacaccgtggcagacttctggaggctggtgttcgattacaactgctcctctgtggtgatgctgaatgagatggacactgcccagttctgtatgcagtactggcctgagaagacctccgggtgctatgggcccatccaggtggagttcgtctccgcagacatcgacgaggacatcatccacagaatattccgcatctgtaacatggcccggccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggaacagtataaatttgtatacgaggtggcactggaatatttaagctccttttagctcaatgggatggggaacctgccggagtccagaggctgctgtgaccaagcccccttttgtgtgaatggcagtaactgggctcaggagctctgaggtggcaccctgcctgactccaaggagaagactggtggccctgtgttccacggggggctctgcaccttctgaggggtctcctgttgccgtgggagatgctgctccaaaaggcccaggcttccttttcaacctaaccagccacagccaagggcccaagcagaagtacacccacaagcaaggccttggatttctggctcccagaccacctgcttttgttctgagtttgtggatctcttggcaagccaactgtgcaggtgctggggagtgggaggctcccctgccctccttctccttaggagtggaggagatgtgtgttctgctcctctacgtcatggaaaagattgaggctcttgggggtcactgctctgctgccccctgcaacctccttcaggggcctctggcaccagacatttgcagtctggaccagtgtgaccttacgatgttccctaggccacaagagaggccccccatcctcacacctaacctgcatggggcttcgcccacaaccattctgtaccccttccccagcctgggccttgaccgtccagcattcactggccggccagctgtgtccacagcagtttttgataaaggtgttctttgcttttttgtgtggtcagtgggagggggtggaactgcagggaacttctctgctcctccttgtctttgtaaaaagggaccacctccctggggcagggcttgggctgacctgtaggatgtaacccctgtgtttctttggtggtagctttctttggaagagacaaacaagataagatttgattattttccaaagtgtatgtgaaaagaaactttcttttggagggtgtaaaatcttagtctcttatgtcaaaaagaagggggcgggggagtttgagtatgtacctctaagacaaatctctcgggccttttattttttcctggcaatgtccttaaaagctcccaccctgggacagcatgccactgagcaaggagagatgggtgagcctgaagatggtccctttggtttctggggcaaatagagcaccagctttgtgcataatttggatgtccaaatttgaactccttcctaaagaaacccagcagccaccttgaaaaaggccattgtggagcccattatactttgatttaaaataggccaagagaatcaggcctggagatctagggtcttgtccaaagtgtgagtgagtcaatgagagggaaccaacatttgctaagtctctactgtatgccagggatcatgcttggcactttccataggacatttcacacagtccttagaacccccaggagagagctactgacttgttatcatctccatttgatcatctcctccaatgaggaaacccacgcaccttccttagtaatgaaatcctgggttccaaaggggcaggtaatggcaatgagacttctccgtgctgttttcttcatcttctctaagccaagcaattattttatggagggaaaataaggccagaaacttctgagcagataactccacaaatggaaatttagtactttcttcctgatgccagttcttctgggaagcgcagaatttcagatatattttagtaacacattcccagctccccaggaaagccagtctcatctaatttcttagtcagtaaaaacaattccctgttccttcaggctatgaatggaccagccagggaaactctcgaccttgatctctagccagtgcttaggcccaatatctgacagcctcaggtgggctgggacctaggaagctccatcttgaaggctggtctagccccagacagggcatgaggggcagagaattcaagaaggtacagctttggccctcaagagcccactgtatgctggggaaatggaaccatggtgcagtagtgtggagtggatgagtgttccatgagcctaggagcaagaaagtctcttcggcctcgggcttcctggagaaggggacgtccattcctgctgggtcttaacaagcataaaaaggaaaaaaaggaaactcaggcaaagggatccatatgtgcaatggcaaagaaatgtgaaaaggcattgggagaagcagtctgggggaggccagcccagtgcgggcacagcacaacacggggagcagcaagagatgagccagggtccaggagacagatgcccatcgcgagtacagactttgtcctattggcaacaaggagtccatggagctttagagagatgcactcagcttcgtgttggccaagactccttctgggccaatggggctgcctcttttcctttcatcagacactgtgaaaacattcccttaagcgtgcactttttaatatcacatctatttgtctgtctgctcattgttttgttgctggaactaaatatgcaatggatcatgagactcagattctatgagaaacccagggtctctgctttaccacggagcagggtcaccaacccagatctccaggcccatgaggatggaacatgaaaggagccgacaaaagttgcttccattggcatgggctctggagctgtccagaagtccagggacaccagacttgatcaaggaagggctgtcactttagaggttcaaaaggaagtgcctcaaagcaaaggcaagcaaaggaaccccacgatgaacttgctcttttcctttgatgagcctctccccaggtgtatttcagcagaccccggggacccacccccactgggcctgctggcctccctcggctccagcccaatgccccagctggccttccccagcctgcaaggagcctgtagcatggcaaatctgcctgctgtatgctattttcttagatcttggtacatccagacaggatgagggtggagggagagctatttaacacaaatcctaagatttttttctgctcaggaaggggtgaaatagctggcagatacaaaagacagtggcttttatcattttaaatggtaggaatttaaggtgtgacttcagggagaaacaaacttgcaaaaaaaaaaaatctcaggccatgttggggtaacccagcaagggccagtgatgatttcccccagctcatccccttattttcccacaacccaaccattctctaaagcaggacagtgaataggtcttaggccagtgcacacaggaagaaattgaggcttatggatggggatgacttccctaagatcccatgggacaaggatgtggcaaggcttggatgagatggggcaccagtgcccaggaatttgaacattttcctttacccaggaaatctccggagccaacaccaccacccccagggggtctccccaccccaccccatttacagggtgagctcagcctgtcatgagcagaggaaaatattattaatgctctctgagtctttacaacaggagctcttacctcatagatgtgggctctgtttggggaagatgcaaggaagtaatgagaagcccaggaaatttctccacctgtgtttatggcctaaatagcttcaggatgtatcttagctgcactccaacattgcatcctttctggggtgaagaatctgggccaaccaggggtccttgggcctctagaaggccacagtaggcctctctttgtgggaatggaaggggacagtttgcttttagtgctggccctctctgtgggtgtggcctgcaaaggaaccaacagaccctatgctggggactctaacatgtgagctcattaaattcttccagcattctaaaggagggtttgtgattgtcaccatttactgatgaggaaactaaggctcctaggggagaaatcacttgcccacagttccacagctagtgagtgaatgaaccaggatttaaaccggttttttctcactacagagacaatatttttccaccattgtatctcacatttttcccaggaggttacccataacagaagagactagagtggaacagatacgtcagtggataaagctcaaagcaaacaacagtaagcttaaaattccttcatagtctcatgttttacgttcacaattcatgcaaaatttgcattccactttctgatttagccttgttggttttaatatgactctatgaatatttcaaaaaaaaatgtgctctgttcctcatgttgttctgttctgttcaccccgctatgacggaccctaggtcagctggtcttcagcttgaccctagaattgactctaggagcagtgaccctgctgcctcccagagccagttataggctcaagatcaagaccaactgaccttctcctaggcagctcctttggtgtgtgggtgctctgacctcactgttcatgaggggacctcaactaaggcatcttccagttgggtgctggaaggaacccattaactcacactagaatgatgaggatttgctcatctggcgtggagaaggatgagcccacaaaaccctaaagggaaaagagaagctggacacagctgtactcagcagattcctgaatgctaggctggaaagtggtgcctgttgtccaagtggagtcacatggttgctaatgtgggcaagtctgaggacacacttcatgagcagctggggtctggaaggctcctcactttaccctagccacacataattactgggtgcctacagcacctagcaccttggagggggcactattaggaaatcgagattactatggcacaattaattcctgggtaaggcatggggttgtggtggacagagctcagtctttagtttgaacgaaaacatacatacatgaaaaacatacatgaaaaaaggaccctcatcaacattagaaggggtagatttggagcactttaggcaggaaaacaggaacgcaaggccaggaaactggaacccagtgaatactcagaaccgaggatgcagatgacttatttagcaaaatggtcacttctgtgacatagctggagaaaggatgggtaacagcttgccagagccacttggaacaagggcaaatctcagtgtctggggcaaaagatgatgcatttccctctgacccatcatgtttattcatcctccactccccattgccacactagctcttgctgtaagtcctcaccaggatctacatttcctcgtcgctggtgggaaccccttagagtacatagaggtatcagtccagtaagactgctctacacaacagaagtgaggcccagggagtagcagccaggcccttatcctgttacctctgcaggagtgactgcccaacccagatccagagacattgaaggaaatgataattccttggtacctcactgccttgggacaaaatgaagaaagccacccttccttaggctgcagcttgccactcctgggctgggtaaacaggtcatcagcaccaagctcaaccaggagtaacactctggaagacatgggtgagcccaagaggaagcatgaacaggacgctgttcctaagtcatgtcaacaggttgtgctgggccaggatccccagggaaaaaaatggtcaacccaactggagggtaggttagaagaaaaaaaacataaacgtggatagtcatgtcatctcaaatccctgacttggcttccccattacttaacagtctgagctccttcttagcctgtgaccagcttcaaatcacagccaagtaaaacaaggaaataggaaaagtaaatccaactagaagagacaagctgagattcagatttgtttactcctcccatgcaaagtttccctgttggaggttttccatgtatacatgtctagaagtgatagaatgcaaggccttggctttgtcttgcagggatctgcctttgaggtcatagactgaacagcagggagagaggttagtggtggagtgtggggggagctgttctagctccagtttcttctgacacatttttcaggatcatggatctgatcctccgaagcacagcagagatatctaagccatatttgtgcacatgagcagactcttctagttttttagtaaccagggatgggcttttgcatggcactgactatagagatgtcttgtagagatcaagccagtcttttgcatcccacctgcccacctccagaagagatgggaaaaggtcatcaaagggcattcaccaactgaaatccactcatgaatgttaggtctctaaaaggaggcatcaacactcacaatggtagcctccaaacctagcatcccacctatctaagagctcaggggtggtccactggggcagatacaagggaagtgcaagggctcaggatgaaagaaaatctattgggaagagttttaggggcttgatcattatggggcttccttctatatctgagaactgctctgggtggtgagatgtggactctgatccttaattggaatgttcggagaatgagtgtctggtggccttgaagtgttggacagaaaagtatcagtataaaagcctggagctcagggtaattaatgtagttcatggttccttagtgagcaggactcttggatgtggaggagaaagggtcataggaagtaaaccaccaaaattacaaaattgagtctctgtacaattacttcagtgcctttgggcttatgaatacaaatcagtgggccttctctatgatggtccaacaaactctcagtgtccaccctgtccctgtatctcccatggaagatgaataatgtcaggtgttctttgggtcaaaggccccagggcagtctggaggcttagagggcagagtggtgtcattccatgtaaagttaggcttctgaggggtcaggcagaatatggtgtccatatcttccatagctctgcagattcttggatgaagtcaagcacagtttgctagacccaggtcactcctctgagtataactaggacccatgagtgaaacttaatagctgtaaggaagaacctgctgtctgccagagaggataagctgcccatctcagcagctgtctaaaagaaggcaggtgtctctttaaagggaagagaagcattggtgaaatggatttcaggtcacttccattccagatgggtgagatcttgtggagctgggatcatgtttgaactcattcatacctgtagagcacgaatccaagtagattgtgtttggtctgtacaggctgaagccccctgctctcccacccaagtgcccccactgagcaggccaacatgctgttgtggccacatatactgggctgatccaggctggttatcaccaaacagcaaaccatagggaacagctgctttgccatagacccaatacccatgtagatctctcatgagagcagccataactcagacccactgaccaacagggccatgagtgacagccagaaccagtgaaggtccaagtaggacacagagcagggcttttcttaccatacacattatctccagaggttatttctaccccactccctattcaaggcctgttggagcacactgcaaaagcaaaagcacagtaactcaatttacacatgattataatcatttccagtgcacacatttcatcaccaggtggatcctgagctagcccatgtaaatccgggttaacccatattggtaatcatactcaaaagcacttttcaccctacattctactagccaatcaaagacaaagagttgtggcctctaccattgccttggcttctggacaccctcacaagctatcccaaggttcccgctcaactccagggaggctgacatcttcacatccactgggcatataatattgcatgagaccaaagtctccacactctttgcagcctcctccatgaatcccaatggcctgcacttgtacagtttgggtgtttgatagataaagcacgtatgagaagagaaaacaaaataaatcaactttttaaaaaagccagcactgtgctgtcaatgttttttttttcttttcaattctagctcagaaaagcagaaggtaaataatgtcaggtcaatgaatatcagatatattttttgactgtacattacagtgaagtgtaatctttttacacctgcaagtccatcttatttattcttgtaaatgttccctgacaatgtttgtaacatggctgtgttaaaaaatctatacaataaagctgtgaccctgagattcatgttttcctaagata

SEQ ID NO: 17035 - DNA, 12480 bp, Homo sapiens
  ENST00000356100
atggcgagcctcgccgcgctcgccctcagcctgctcctgaggctgcagctgccgccactgcccggcgcccgggctcagagcgccgcaggtggctgttcctttgatgagcactacagcaactgtggttatagtgtggctctagggaccaatgggttcacctgggagcagattaacacatgggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccagggcctcccctcaccaccaggaccaagtgtgcagatccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgttccaggagctgttcctctagaatccatccaaggggggccctttgaggagaagatctacatccagtggaaacctcccaatgagaccaatggggtcatcacgctctacgagatcaactacaaggctgtcggctcgctggacccaagtgctgacctctcgagccagagggggaaagtgttcaagctccggaatgaaacccaccacctctttgtgggtctgtacccagggaccacctattccttcaccatcaaggccagcacagcaaagggctttgggccccctgtcaccactcggattgccaccaaaatttcagctccatccatgcctgagtacgacacagacaccccattgaatgagacagacacgaccatcacagtgatgctgaaacccgctcagtcccggggagctcctgtcagtgtttatcagctggttgtcaaggaggagcgacttcagaagtcacggagggcagctgacattattgagtgcttttcggtgcccgtgagctatcggaatgcctccagcctcgattctctacactactttgctgctgagttgaagcctgccaacctgcctgtcacccagccatttacagtgggtgacaataagacatacaatggctactggaaccctcctctctctcccctgaaaagctacagcatctacttccaggcactcagcaaagccaatggagagaccaaaatcaactgtgttcgtctggctacaaaagcaccaatgggcagcgcccaggtgaccccggggactccactctgcctcctcaccacaggtgcctccacccagaattctaacactgtggagccagagaagcaggtggacaacaccgtgaagatggctggcgtgatcgctggcctcctcatgttcatcatcattctcctgggcgtgatgctcaccatcaaaaggaggaagctggccaagaagcagaaggagacccagagtggagcccagagggagatggggcctgtggcctctgccgacaaacccaccaccaagctcagcgccagccgcaatgatgaaggcttctcttctagttctcaggacgtcaacggattcacagatggcagccgcggggagctttcccagcccaccctcacgatccagactcatccctaccgcacctgtgaccctgtggagatgagctacccccgggaccagttccaacccgccatccgggtggctgacttgctgcagcacatcacgcagatgaagagaggccagggctacgggttcaaggaggaatacgaggccttaccagaggggcagacagcttcgtgggacacagccaaggaggatgaaaaccgcaataagaatcgatatgggaacatcatatcctacgaccattcccgggtgaggctgctggtgctggatggagacccgcactctgactacatcaatgccaactacattgacggataccatcgacctcggcactacattgcgactcaaggtccgatgcaggagactgtaaaggacttttggagaatgatctggcaggagaactccgccagcatcgtcatggtcacaaacctggtggaagtgggcagggtgaaatgtgtgcgatactggccagatgacacggaggtctacggagacattaaagtcaccctgattgaaacagagcccctggcagaatacgtcatacgcaccttcacagtccagaagaaaggctaccatgagatccgggagctccgcctcttccacttcaccagctggcctgaccacggcgttccctgctatgccactggccttctgggcttcgtccgccaggtcaagttcctcaaccccccggaagctgggcccatagtggtccactgcagtgctggggctgggcggactggctgcttcattgccattgacaccatgcttgacatggccgagaatgaaggggtggtggacatcttcaactgcgtgcgtgagctccgggcccaaagggtcaacctggtacagacagaggagcaatatgtgtttgtgcacgatgccatcctggaagcgtgcctctgtggcaacactgccatccctgtgtgtgagttccgttctctctactacaatatcagcaggctggacccccagacaaactccagccaaatcaaagatgaatttcagaccctcaacattgtgacaccccgtgtgcggcccgaggactgcagcattgggctcctgccccggaaccatgataagaatcgaagtatggacgtgctgcctctggaccgctgcctgcccttccttatctcagtggacggagaatccagcaattacatcaacgcagcactgatggatagccacaagcagcctgccgccttcgtggtcacccagcaccctctacccaacaccgtggcagacttctggaggctggtgttcgattacaactgctcctctgtggtgatgctgaatgagatggacactgcccagttctgtatgcagtactggcctgagaagacctccgggtgctatgggcccatccaggtggagttcgtctccgcagacatcgacgaggacatcatccacagaatattccgcatctgtaacatggcccggccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggaacagtataaatttgtatacgaggtggcactggaatatttaagctccttttagctcaatgggatggggaacctgccggagtccagaggctgctgtgaccaagcccccttttgtgtgaatggcagtaactgggctcaggagctctgaggtggcaccctgcctgactccaaggagaagactggtggccctgtgttccacggggggctctgcaccttctgaggggtctcctgttgccgtgggagatgctgctccaaaaggcccaggcttccttttcaacctaaccagccacagccaagggcccaagcagaagtacacccacaagcaaggccttggatttctggctcccagaccacctgcttttgttctgagtttgtggatctcttggcaagccaactgtgcaggtgctggggagtgggaggctcccctgccctccttctccttaggagtggaggagatgtgtgttctgctcctctacgtcatggaaaagattgaggctcttgggggtcactgctctgctgccccctgcaacctccttcaggggcctctggcaccagacatttgcagtctggaccagtgtgaccttacgatgttccctaggccacaagagaggccccccatcctcacacctaacctgcatggggcttcgcccacaaccattctgtaccccttccccagcctgggccttgaccgtccagcattcactggccggccagctgtgtccacagcagtttttgataaaggtgttctttgcttttttgtgtggtcagtgggagggggtggaactgcagggaacttctctgctcctccttgtctttgtaaaaagggaccacctccctggggcagggcttgggctgacctgtaggatgtaacccctgtgtttctttggtggtagctttctttggaagagacaaacaagataagatttgattattttccaaagtgtatgtgaaaagaaactttcttttggagggtgtaaaatcttagtctcttatgtcaaaaagaagggggcgggggagtttgagtatgtacctctaagacaaatctctcgggccttttattttttcctggcaatgtccttaaaagctcccaccctgggacagcatgccactgagcaaggagagatgggtgagcctgaagatggtccctttggtttctggggcaaatagagcaccagctttgtgcataatttggatgtccaaatttgaactccttcctaaagaaacccagcagccaccttgaaaaaggccattgtggagcccattatactttgatttaaaataggccaagagaatcaggcctggagatctagggtcttgtccaaagtgtgagtgagtcaatgagagggaaccaacatttgctaagtctctactgtatgccagggatcatgcttggcactttccataggacatttcacacagtccttagaacccccaggagagagctactgacttgttatcatctccatttgatcatctcctccaatgaggaaacccacgcaccttccttagtaatgaaatcctgggttccaaaggggcaggtaatggcaatgagacttctccgtgctgttttcttcatcttctctaagccaagcaattattttatggagggaaaataaggccagaaacttctgagcagataactccacaaatggaaatttagtactttcttcctgatgccagttcttctgggaagcgcagaatttcagatatattttagtaacacattcccagctccccaggaaagccagtctcatctaatttcttagtcagtaaaaacaattccctgttccttcaggctatgaatggaccagccagggaaactctcgaccttgatctctagccagtgcttaggcccaatatctgacagcctcaggtgggctgggacctaggaagctccatcttgaaggctggtctagccccagacagggcatgaggggcagagaattcaagaaggtacagctttggccctcaagagcccactgtatgctggggaaatggaaccatggtgcagtagtgtggagtggatgagtgttccatgagcctaggagcaagaaagtctcttcggcctcgggcttcctggagaaggggacgtccattcctgctgggtcttaacaagcataaaaaggaaaaaaaggaaactcaggcaaagggatccatatgtgcaatggcaaagaaatgtgaaaaggcattgggagaagcagtctgggggaggccagcccagtgcgggcacagcacaacacggggagcagcaagagatgagccagggtccaggagacagatgcccatcgcgagtacagactttgtcctattggcaacaaggagtccatggagctttagagagatgcactcagcttcgtgttggccaagactccttctgggccaatggggctgcctcttttcctttcatcagacactgtgaaaacattcccttaagcgtgcactttttaatatcacatctatttgtctgtctgctcattgttttgttgctggaactaaatatgcaatggatcatgagactcagattctatgagaaacccagggtctctgctttaccacggagcagggtcaccaacccagatctccaggcccatgaggatggaacatgaaaggagccgacaaaagttgcttccattggcatgggctctggagctgtccagaagtccagggacaccagacttgatcaaggaagggctgtcactttagaggttcaaaaggaagtgcctcaaagcaaaggcaagcaaaggaaccccacgatgaacttgctcttttcctttgatgagcctctccccaggtgtatttcagcagaccccggggacccacccccactgggcctgctggcctccctcggctccagcccaatgccccagctggccttccccagcctgcaaggagcctgtagcatggcaaatctgcctgctgtatgctattttcttagatcttggtacatccagacaggatgagggtggagggagagctatttaacacaaatcctaagatttttttctgctcaggaaggggtgaaatagctggcagatacaaaagacagtggcttttatcattttaaatggtaggaatttaaggtgtgacttcagggagaaacaaacttgcaaaaaaaaaaaatctcaggccatgttggggtaacccagcaagggccagtgatgatttcccccagctcatccccttattttcccacaacccaaccattctctaaagcaggacagtgaataggtcttaggccagtgcacacaggaagaaattgaggcttatggatggggatgacttccctaagatcccatgggacaaggatgtggcaaggcttggatgagatggggcaccagtgcccaggaatttgaacattttcctttacccaggaaatctccggagccaacaccaccacccccagggggtctccccaccccaccccatttacagggtgagctcagcctgtcatgagcagaggaaaatattattaatgctctctgagtctttacaacaggagctcttacctcatagatgtgggctctgtttggggaagatgcaaggaagtaatgagaagcccaggaaatttctccacctgtgtttatggcctaaatagcttcaggatgtatcttagctgcactccaacattgcatcctttctggggtgaagaatctgggccaaccaggggtccttgggcctctagaaggccacagtaggcctctctttgtgggaatggaaggggacagtttgcttttagtgctggccctctctgtgggtgtggcctgcaaaggaaccaacagaccctatgctggggactctaacatgtgagctcattaaattcttccagcattctaaaggagggtttgtgattgtcaccatttactgatgaggaaactaaggctcctaggggagaaatcacttgcccacagttccacagctagtgagtgaatgaaccaggatttaaaccggttttttctcactacagagacaatatttttccaccattgtatctcacatttttcccaggaggttacccataacagaagagactagagtggaacagatacgtcagtggataaagctcaaagcaaacaacagtaagcttaaaattccttcatagtctcatgttttacgttcacaattcatgcaaaatttgcattccactttctgatttagccttgttggttttaatatgactctatgaatatttcaaaaaaaaatgtgctctgttcctcatgttgttctgttctgttcaccccgctatgacggaccctaggtcagctggtcttcagcttgaccctagaattgactctaggagcagtgaccctgctgcctcccagagccagttataggctcaagatcaagaccaactgaccttctcctaggcagctcctttggtgtgtgggtgctctgacctcactgttcatgaggggacctcaactaaggcatcttccagttgggtgctggaaggaacccattaactcacactagaatgatgaggatttgctcatctggcgtggagaaggatgagcccacaaaaccctaaagggaaaagagaagctggacacagctgtactcagcagattcctgaatgctaggctggaaagtggtgcctgttgtccaagtggagtcacatggttgctaatgtgggcaagtctgaggacacacttcatgagcagctggggtctggaaggctcctcactttaccctagccacacataattactgggtgcctacagcacctagcaccttggagggggcactattaggaaatcgagattactatggcacaattaattcctgggtaaggcatggggttgtggtggacagagctcagtctttagtttgaacgaaaacatacatacatgaaaaacatacatgaaaaaaggaccctcatcaacattagaaggggtagatttggagcactttaggcaggaaaacaggaacgcaaggccaggaaactggaacccagtgaatactcagaaccgaggatgcagatgacttatttagcaaaatggtcacttctgtgacatagctggagaaaggatgggtaacagcttgccagagccacttggaacaagggcaaatctcagtgtctggggcaaaagatgatgcatttccctctgacccatcatgtttattcatcctccactccccattgccacactagctcttgctgtaagtcctcaccaggatctacatttcctcgtcgctggtgggaaccccttagagtacatagaggtatcagtccagtaagactgctctacacaacagaagtgaggcccagggagtagcagccaggcccttatcctgttacctctgcaggagtgactgcccaacccagatccagagacattgaaggaaatgataattccttggtacctcactgccttgggacaaaatgaagaaagccacccttccttaggctgcagcttgccactcctgggctgggtaaacaggtcatcagcaccaagctcaaccaggagtaacactctggaagacatgggtgagcccaagaggaagcatgaacaggacgctgttcctaagtcatgtcaacaggttgtgctgggccaggatccccagggaaaaaaatggtcaacccaactggagggtaggttagaagaaaaaaaacataaacgtggatagtcatgtcatctcaaatccctgacttggcttccccattacttaacagtctgagctccttcttagcctgtgaccagcttcaaatcacagccaagtaaaacaaggaaataggaaaagtaaatccaactagaagagacaagctgagattcagatttgtttactcctcccatgcaaagtttccctgttggaggttttccatgtatacatgtctagaagtgatagaatgcaaggccttggctttgtcttgcagggatctgcctttgaggtcatagactgaacagcagggagagaggttagtggtggagtgtggggggagctgttctagctccagtttcttctgacacatttttcaggatcatggatctgatcctccgaagcacagcagagatatctaagccatatttgtgcacatgagcagactcttctagttttttagtaaccagggatgggcttttgcatggcactgactatagagatgtcttgtagagatcaagccagtcttttgcatcccacctgcccacctccagaagagatgggaaaaggtcatcaaagggcattcaccaactgaaatccactcatgaatgttaggtctctaaaaggaggcatcaacactcacaatggtagcctccaaacctagcatcccacctatctaagagctcaggggtggtccactggggcagatacaagggaagtgcaagggctcaggatgaaagaaaatctattgggaagagttttaggggcttgatcattatggggcttccttctatatctgagaactgctctgggtggtgagatgtggactctgatccttaattggaatgttcggagaatgagtgtctggtggccttgaagtgttggacagaaaagtatcagtataaaagcctggagctcagggtaattaatgtagttcatggttccttagtgagcaggactcttggatgtggaggagaaagggtcataggaagtaaaccaccaaaattacaaaattgagtctctgtacaattacttcagtgcctttgggcttatgaatacaaatcagtgggccttctctatgatggtccaacaaactctcagtgtccaccctgtccctgtatctcccatggaagatgaataatgtcaggtgttctttgggtcaaaggccccagggcagtctggaggcttagagggcagagtggtgtcattccatgtaaagttaggcttctgaggggtcaggcagaatatggtgtccatatcttccatagctctgcagattcttggatgaagtcaagcacagtttgctagacccaggtcactcctctgagtataactaggacccatgagtgaaacttaatagctgtaaggaagaacctgctgtctgccagagaggataagctgcccatctcagcagctgtctaaaagaaggcaggtgtctctttaaagggaagagaagcattggtgaaatggatttcaggtcacttccattccagatgggtgagatcttgtggagctgggatcatgtttgaactcattcatacctgtagagcacgaatccaagtagattgtgtttggtctgtacaggctgaagccccctgctctcccacccaagtgcccccactgagcaggccaacatgctgttgtggccacatatactgggctgatccaggctggttatcaccaaacagcaaaccatagggaacagctgctttgccatagacccaatacccatgtagatctctcatgagagcagccataactcagacccactgaccaacagggccatgagtgacagccagaaccagtgaaggtccaagtaggacacagagcagggcttttcttaccatacacattatctccagaggttatttctaccccactccctattcaaggcctgttggagcacactgcaaaagcaaaagcacagtaactcaatttacacatgattataatcatttccagtgcacacatttcatcaccaggtggatcctgagctagcccatgtaaatccgggttaacccatattggtaatcatactcaaaagcacttttcaccctacattctactagccaatcaaagacaaagagttgtggcctctaccattgccttggcttctggacaccctcacaagctatcccaaggttcccgctcaactccagggaggctgacatcttcacatccactgggcatataatattgcatgagaccaaagtctccacactctttgcagcctcctccatgaatcccaatggcctgcacttgtacagtttgggtgtttgatagataaagcacgtatgagaagagaaaacaaaataaatcaactttttaaaaaagccagcactgtgctgtcaatgttttttttttcttttcaattctagctcagaaaagcagaaggtaaataatgtcaggtcaatgaatatcagatatattttttgactgtacattacagtgaagtgtaatctttttacacctgcaagtccatcttatttattcttgtaaatgttccctgacaatgtttgtaacatggctgtgttaaaaaatctatacaataaagctgtgaccctgagattcatgttttcctaagata

SEQ ID NO: 17036 - DNA, 12483 bp, Homo sapiens
  ENST00000373184
atggcgagcctcgccgcgctcgccctcagcctgctcctgaggctgcagctgccgccactgcccggcgcccgggctcagagcgccgcaggtggctgttcctttgatgagcactacagcaactgtggttatagtgtggctctagggaccaatgggttcacctgggagcagattaacacatgggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccagggcctcccctcaccaccaggaccaagtgtgcagatccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgttccaggagctgttcctctagaatccatccaaggggggccctttgaggagaagatctacatccagtggaaacctcccaatgagaccaatggggtcatcacgctctacgagatcaactacaaggctgtcggctcgctggacccaagtgctgacctctcgagccagagggggaaagtgttcaagctccggaatgaaacccaccacctctttgtgggtctgtacccagggaccacctattccttcaccatcaaggccagcacagcaaagggctttgggccccctgtcaccactcggattgccaccaaaatttcagctccatccatgcctgagtacgacacagacaccccattgaatgagacagacacgaccatcacagtgatgctgaaacccgctcagtcccggggagctcctgtcagtgtttatcagctggttgtcaaggaggagcgacttcagaagtcacggagggcagctgacattattgagtgcttttcggtgcccgtgagctatcggaatgcctccagcctcgattctctacactactttgctgctgagttgaagcctgccaacctgcctgtcacccagccatttacagtgggtgacaataagacatacaatggctactggaaccctcctctctctcccctgaaaagctacagcatctacttccaggcactcagcaaagccaatggagagaccaaaatcaactgtgttcgtctggctacaaaaggtgcctccacccagaattctaacactgtggagccagagaagcaggtggacaacaccgtgaagatggctggcgtgatcgctggcctcctcatgttcatcatcattctcctgggcgtgatgctcaccatcaaaaggaggaagctggccaagaagcagaaggagacccagagtggagcccagagggagatggggcctgtggcctctgccgacaaacccaccaccaagctcagcgccagccgcaatgatgaaggcttctcttctagttctcaggacgtcaacggattcacagatggcagccgcggggagctttcccagcccaccctcacgatccagactcatccctaccgcacctgtgaccctgtggagatgagctacccccgggaccagttccaacccgccatccgggtggctgacttgctgcagcacatcacgcagatgaagagaggccagggctacgggttcaaggaggaatacgaggccttaccagaggggcagacagcttcgtgggacacagccaaggaggatgaaaaccgcaataagaatcgatatgggaacatcatatcctacgaccattcccgggtgaggctgctggtgctggatggagacccgcactctgactacatcaatgccaactacattgacggataccatcgacctcggcactacattgcgactcaaggtccgatgcaggagactgtaaaggacttttggagaatgatctggcaggagaactccgccagcatcgtcatggtcacaaacctggtggaagtgggcaggcacccagcggaacacactgtgggaaatgccactctaggccgtgcggcgtcccccggaatggtgaaatgtgtgcgatactggccagatgacacggaggtctacggagacattaaagtcaccctgattgaaacagagcccctggcagaatacgtcatacgcaccttcacagtccagaagaaaggctaccatgagatccgggagctccgcctcttccacttcaccagctggcctgaccacggcgttccctgctatgccactggccttctgggcttcgtccgccaggtcaagttcctcaaccccccggaagctgggcccatagtggtccactgcagtgctggggctgggcggactggctgcttcattgccattgacaccatgcttgacatggccgagaatgaaggggtggtggacatcttcaactgcgtgcgtgagctccgggcccaaagggtcaacctggtacagacagaggagcaatatgtgtttgtgcacgatgccatcctggaagcgtgcctctgtggcaacactgccatccctgtgtgtgagttccgttctctctactacaatatcagcaggctggacccccagacaaactccagccaaatcaaagatgaatttcagaccctcaacattgtgacaccccgtgtgcggcccgaggactgcagcattgggctcctgccccggaaccatgataagaatcgaagtatggacgtgctgcctctggaccgctgcctgcccttccttatctcagtggacggagaatccagcaattacatcaacgcagcactgatggatagccacaagcagcctgccgccttcgtggtcacccagcaccctctacccaacaccgtggcagacttctggaggctggtgttcgattacaactgctcctctgtggtgatgctgaatgagatggacactgcccagttctgtatgcagtactggcctgagaagacctccgggtgctatgggcccatccaggtggagttcgtctccgcagacatcgacgaggacatcatccacagaatattccgcatctgtaacatggcccggccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggaacagtataaatttgtatacgaggtggcactggaatatttaagctccttttagctcaatgggatggggaacctgccggagtccagaggctgctgtgaccaagcccccttttgtgtgaatggcagtaactgggctcaggagctctgaggtggcaccctgcctgactccaaggagaagactggtggccctgtgttccacggggggctctgcaccttctgaggggtctcctgttgccgtgggagatgctgctccaaaaggcccaggcttccttttcaacctaaccagccacagccaagggcccaagcagaagtacacccacaagcaaggccttggatttctggctcccagaccacctgcttttgttctgagtttgtggatctcttggcaagccaactgtgcaggtgctggggagtgggaggctcccctgccctccttctccttaggagtggaggagatgtgtgttctgctcctctacgtcatggaaaagattgaggctcttgggggtcactgctctgctgccccctgcaacctccttcaggggcctctggcaccagacatttgcagtctggaccagtgtgaccttacgatgttccctaggccacaagagaggccccccatcctcacacctaacctgcatggggcttcgcccacaaccattctgtaccccttccccagcctgggccttgaccgtccagcattcactggccggccagctgtgtccacagcagtttttgataaaggtgttctttgcttttttgtgtggtcagtgggagggggtggaactgcagggaacttctctgctcctccttgtctttgtaaaaagggaccacctccctggggcagggcttgggctgacctgtaggatgtaacccctgtgtttctttggtggtagctttctttggaagagacaaacaagataagatttgattattttccaaagtgtatgtgaaaagaaactttcttttggagggtgtaaaatcttagtctcttatgtcaaaaagaagggggcgggggagtttgagtatgtacctctaagacaaatctctcgggccttttattttttcctggcaatgtccttaaaagctcccaccctgggacagcatgccactgagcaaggagagatgggtgagcctgaagatggtccctttggtttctggggcaaatagagcaccagctttgtgcataatttggatgtccaaatttgaactccttcctaaagaaacccagcagccaccttgaaaaaggccattgtggagcccattatactttgatttaaaataggccaagagaatcaggcctggagatctagggtcttgtccaaagtgtgagtgagtcaatgagagggaaccaacatttgctaagtctctactgtatgccagggatcatgcttggcactttccataggacatttcacacagtccttagaacccccaggagagagctactgacttgttatcatctccatttgatcatctcctccaatgaggaaacccacgcaccttccttagtaatgaaatcctgggttccaaaggggcaggtaatggcaatgagacttctccgtgctgttttcttcatcttctctaagccaagcaattattttatggagggaaaataaggccagaaacttctgagcagataactccacaaatggaaatttagtactttcttcctgatgccagttcttctgggaagcgcagaatttcagatatattttagtaacacattcccagctccccaggaaagccagtctcatctaatttcttagtcagtaaaaacaattccctgttccttcaggctatgaatggaccagccagggaaactctcgaccttgatctctagccagtgcttaggcccaatatctgacagcctcaggtgggctgggacctaggaagctccatcttgaaggctggtctagccccagacagggcatgaggggcagagaattcaagaaggtacagctttggccctcaagagcccactgtatgctggggaaatggaaccatggtgcagtagtgtggagtggatgagtgttccatgagcctaggagcaagaaagtctcttcggcctcgggcttcctggagaaggggacgtccattcctgctgggtcttaacaagcataaaaaggaaaaaaaggaaactcaggcaaagggatccatatgtgcaatggcaaagaaatgtgaaaaggcattgggagaagcagtctgggggaggccagcccagtgcgggcacagcacaacacggggagcagcaagagatgagccagggtccaggagacagatgcccatcgcgagtacagactttgtcctattggcaacaaggagtccatggagctttagagagatgcactcagcttcgtgttggccaagactccttctgggccaatggggctgcctcttttcctttcatcagacactgtgaaaacattcccttaagcgtgcactttttaatatcacatctatttgtctgtctgctcattgttttgttgctggaactaaatatgcaatggatcatgagactcagattctatgagaaacccagggtctctgctttaccacggagcagggtcaccaacccagatctccaggcccatgaggatggaacatgaaaggagccgacaaaagttgcttccattggcatgggctctggagctgtccagaagtccagggacaccagacttgatcaaggaagggctgtcactttagaggttcaaaaggaagtgcctcaaagcaaaggcaagcaaaggaaccccacgatgaacttgctcttttcctttgatgagcctctccccaggtgtatttcagcagaccccggggacccacccccactgggcctgctggcctccctcggctccagcccaatgccccagctggccttccccagcctgcaaggagcctgtagcatggcaaatctgcctgctgtatgctattttcttagatcttggtacatccagacaggatgagggtggagggagagctatttaacacaaatcctaagatttttttctgctcaggaaggggtgaaatagctggcagatacaaaagacagtggcttttatcattttaaatggtaggaatttaaggtgtgacttcagggagaaacaaacttgcaaaaaaaaaaaatctcaggccatgttggggtaacccagcaagggccagtgatgatttcccccagctcatccccttattttcccacaacccaaccattctctaaagcaggacagtgaataggtcttaggccagtgcacacaggaagaaattgaggcttatggatggggatgacttccctaagatcccatgggacaaggatgtggcaaggcttggatgagatggggcaccagtgcccaggaatttgaacattttcctttacccaggaaatctccggagccaacaccaccacccccagggggtctccccaccccaccccatttacagggtgagctcagcctgtcatgagcagaggaaaatattattaatgctctctgagtctttacaacaggagctcttacctcatagatgtgggctctgtttggggaagatgcaaggaagtaatgagaagcccaggaaatttctccacctgtgtttatggcctaaatagcttcaggatgtatcttagctgcactccaacattgcatcctttctggggtgaagaatctgggccaaccaggggtccttgggcctctagaaggccacagtaggcctctctttgtgggaatggaaggggacagtttgcttttagtgctggccctctctgtgggtgtggcctgcaaaggaaccaacagaccctatgctggggactctaacatgtgagctcattaaattcttccagcattctaaaggagggtttgtgattgtcaccatttactgatgaggaaactaaggctcctaggggagaaatcacttgcccacagttccacagctagtgagtgaatgaaccaggatttaaaccggttttttctcactacagagacaatatttttccaccattgtatctcacatttttcccaggaggttacccataacagaagagactagagtggaacagatacgtcagtggataaagctcaaagcaaacaacagtaagcttaaaattccttcatagtctcatgttttacgttcacaattcatgcaaaatttgcattccactttctgatttagccttgttggttttaatatgactctatgaatatttcaaaaaaaaatgtgctctgttcctcatgttgttctgttctgttcaccccgctatgacggaccctaggtcagctggtcttcagcttgaccctagaattgactctaggagcagtgaccctgctgcctcccagagccagttataggctcaagatcaagaccaactgaccttctcctaggcagctcctttggtgtgtgggtgctctgacctcactgttcatgaggggacctcaactaaggcatcttccagttgggtgctggaaggaacccattaactcacactagaatgatgaggatttgctcatctggcgtggagaaggatgagcccacaaaaccctaaagggaaaagagaagctggacacagctgtactcagcagattcctgaatgctaggctggaaagtggtgcctgttgtccaagtggagtcacatggttgctaatgtgggcaagtctgaggacacacttcatgagcagctggggtctggaaggctcctcactttaccctagccacacataattactgggtgcctacagcacctagcaccttggagggggcactattaggaaatcgagattactatggcacaattaattcctgggtaaggcatggggttgtggtggacagagctcagtctttagtttgaacgaaaacatacatacatgaaaaacatacatgaaaaaaggaccctcatcaacattagaaggggtagatttggagcactttaggcaggaaaacaggaacgcaaggccaggaaactggaacccagtgaatactcagaaccgaggatgcagatgacttatttagcaaaatggtcacttctgtgacatagctggagaaaggatgggtaacagcttgccagagccacttggaacaagggcaaatctcagtgtctggggcaaaagatgatgcatttccctctgacccatcatgtttattcatcctccactccccattgccacactagctcttgctgtaagtcctcaccaggatctacatttcctcgtcgctggtgggaaccccttagagtacatagaggtatcagtccagtaagactgctctacacaacagaagtgaggcccagggagtagcagccaggcccttatcctgttacctctgcaggagtgactgcccaacccagatccagagacattgaaggaaatgataattccttggtacctcactgccttgggacaaaatgaagaaagccacccttccttaggctgcagcttgccactcctgggctgggtaaacaggtcatcagcaccaagctcaaccaggagtaacactctggaagacatgggtgagcccaagaggaagcatgaacaggacgctgttcctaagtcatgtcaacaggttgtgctgggccaggatccccagggaaaaaaatggtcaacccaactggagggtaggttagaagaaaaaaaacataaacgtggatagtcatgtcatctcaaatccctgacttggcttccccattacttaacagtctgagctccttcttagcctgtgaccagcttcaaatcacagccaagtaaaacaaggaaataggaaaagtaaatccaactagaagagacaagctgagattcagatttgtttactcctcccatgcaaagtttccctgttggaggttttccatgtatacatgtctagaagtgatagaatgcaaggccttggctttgtcttgcagggatctgcctttgaggtcatagactgaacagcagggagagaggttagtggtggagtgtggggggagctgttctagctccagtttcttctgacacatttttcaggatcatggatctgatcctccgaagcacagcagagatatctaagccatatttgtgcacatgagcagactcttctagttttttagtaaccagggatgggcttttgcatggcactgactatagagatgtcttgtagagatcaagccagtcttttgcatcccacctgcccacctccagaagagatgggaaaaggtcatcaaagggcattcaccaactgaaatccactcatgaatgttaggtctctaaaaggaggcatcaacactcacaatggtagcctccaaacctagcatcccacctatctaagagctcaggggtggtccactggggcagatacaagggaagtgcaagggctcaggatgaaagaaaatctattgggaagagttttaggggcttgatcattatggggcttccttctatatctgagaactgctctgggtggtgagatgtggactctgatccttaattggaatgttcggagaatgagtgtctggtggccttgaagtgttggacagaaaagtatcagtataaaagcctggagctcagggtaattaatgtagttcatggttccttagtgagcaggactcttggatgtggaggagaaagggtcataggaagtaaaccaccaaaattacaaaattgagtctctgtacaattacttcagtgcctttgggcttatgaatacaaatcagtgggccttctctatgatggtccaacaaactctcagtgtccaccctgtccctgtatctcccatggaagatgaataatgtcaggtgttctttgggtcaaaggccccagggcagtctggaggcttagagggcagagtggtgtcattccatgtaaagttaggcttctgaggggtcaggcagaatatggtgtccatatcttccatagctctgcagattcttggatgaagtcaagcacagtttgctagacccaggtcactcctctgagtataactaggacccatgagtgaaacttaatagctgtaaggaagaacctgctgtctgccagagaggataagctgcccatctcagcagctgtctaaaagaaggcaggtgtctctttaaagggaagagaagcattggtgaaatggatttcaggtcacttccattccagatgggtgagatcttgtggagctgggatcatgtttgaactcattcatacctgtagagcacgaatccaagtagattgtgtttggtctgtacaggctgaagccccctgctctcccacccaagtgcccccactgagcaggccaacatgctgttgtggccacatatactgggctgatccaggctggttatcaccaaacagcaaaccatagggaacagctgctttgccatagacccaatacccatgtagatctctcatgagagcagccataactcagacccactgaccaacagggccatgagtgacagccagaaccagtgaaggtccaagtaggacacagagcagggcttttcttaccatacacattatctccagaggttatttctaccccactccctattcaaggcctgttggagcacactgcaaaagcaaaagcacagtaactcaatttacacatgattataatcatttccagtgcacacatttcatcaccaggtggatcctgagctagcccatgtaaatccgggttaacccatattggtaatcatactcaaaagcacttttcaccctacattctactagccaatcaaagacaaagagttgtggcctctaccattgccttggcttctggacaccctcacaagctatcccaaggttcccgctcaactccagggaggctgacatcttcacatccactgggcatataatattgcatgagaccaaagtctccacactctttgcagcctcctccatgaatcccaatggcctgcacttgtacagtttgggtgtttgatagataaagcacgtatgagaagagaaaacaaaataaatcaactttttaaaaaagccagcactgtgctgtcaatgttttttttttcttttcaattctagctcagaaaagcagaaggtaaataatgtcaggtcaatgaatatcagatatattttttgactgtacattacagtgaagtgtaatctttttacacctgcaagtccatcttatttattcttgtaaatgttccctgacaatgtttgtaacatggctgtgttaaaaaatctatacaataaagctgtgaccctgagattcatgttttcctaagata

SEQ ID NO: 17037 - DNA, 12559 bp, Homo sapiens
  ENST00000373190
ccgcgcgcacagccagcggccgcgccggcgatgcggggccaccccgcgcccgccccagtcccggccccggcccccgcgggaaggggctgagctgcccgccgccgcccggatggcgagcctcgccgcgctcgccctcagcctgctcctgaggctgcagctgccgccactgcccggcgcccgggctcagagcgccgcaggtggctgttcctttgatgagcactacagcaactgtggttatagtgtggctctagggaccaatgggttcacctgggagcagattaacacatgggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccagggcctcccctcaccaccaggaccaagtgtgcagatccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgttccaggagctgttcctctagaatccatccaaggggggccctttgaggagaagatctacatccagtggaaacctcccaatgagaccaatggggtcatcacgctctacgagatcaactacaaggctgtcggctcgctggacccaagtgctgacctctcgagccagagggggaaagtgttcaagctccggaatgaaacccaccacctctttgtgggtctgtacccagggaccacctattccttcaccatcaaggccagcacagcaaagggctttgggccccctgtcaccactcggattgccaccaaaatttcagctccatccatgcctgagtacgacacagacaccccattgaatgagacagacacgaccatcacagtgatgctgaaacccgctcagtcccggggagctcctgtcagtgtttatcagctggttgtcaaggaggagcgacttcagaagtcacggagggcagctgacattattgagtgcttttcggtgcccgtgagctatcggaatgcctccagcctcgattctctacactactttgctgctgagttgaagcctgccaacctgcctgtcacccagccatttacagtgggtgacaataagacatacaatggctactggaaccctcctctctctcccctgaaaagctacagcatctacttccaggcactcagcaaagccaatggagagaccaaaatcaactgtgttcgtctggctacaaaaggtgcctccacccagaattctaacactgtggagccagagaagcaggtggacaacaccgtgaagatggctggcgtgatcgctggcctcctcatgttcatcatcattctcctgggcgtgatgctcaccatcaaaaggagaagaaatgcttattcctactcctattacttgaagctggccaagaagcagaaggagacccagagtggagcccagagggagatggggcctgtggcctctgccgacaaacccaccaccaagctcagcgccagccgcaatgatgaaggcttctcttctagttctcaggacgtcaacggattcaatggcagccgcggggagctttcccagcccaccctcacgatccagactcatccctaccgcacctgtgaccctgtggagatgagctacccccgggaccagttccaacccgccatccgggtggctgacttgctgcagcacatcacgcagatgaagagaggccagggctacgggttcaaggaggaatacgaggccttaccagaggggcagacagcttcgtgggacacagccaaggaggatgaaaaccgcaataagaatcgatatgggaacatcatatcctacgaccattcccgggtgaggctgctggtgctggatggagacccgcactctgactacatcaatgccaactacattgacggataccatcgacctcggcactacattgcgactcaaggtccgatgcaggagactgtaaaggacttttggagaatgatctggcaggagaactccgccagcatcgtcatggtcacaaacctggtggaagtgggcagggtgaaatgtgtgcgatactggccagatgacacggaggtctacggagacattaaagtcaccctgattgaaacagagcccctggcagaatacgtcatacgcaccttcacagtccagaagaaaggctaccatgagatccgggagctccgcctcttccacttcaccagctggcctgaccacggcgttccctgctatgccactggccttctgggcttcgtccgccaggtcaagttcctcaaccccccggaagctgggcccatagtggtccactgcagtgctggggctgggcggactggctgcttcattgccattgacaccatgcttgacatggccgagaatgaaggggtggtggacatcttcaactgcgtgcgtgagctccgggcccaaagggtcaacctggtacagacagaggagcaatatgtgtttgtgcacgatgccatcctggaagcgtgcctctgtggcaacactgccatccctgtgtgtgagttccgttctctctactacaatatcagcaggctggacccccagacaaactccagccaaatcaaagatgaatttcagaccctcaacattgtgacaccccgtgtgcggcccgaggactgcagcattgggctcctgccccggaaccatgataagaatcgaagtatggacgtgctgcctctggaccgctgcctgcccttccttatctcagtggacggagaatccagcaattacatcaacgcagcactgatggatagccacaagcagcctgccgccttcgtggtcacccagcaccctctacccaacaccgtggcagacttctggaggctggtgttcgattacaactgctcctctgtggtgatgctgaatgagatggacactgcccagttctgtatgcagtactggcctgagaagacctccgggtgctatgggcccatccaggtggagttcgtctccgcagacatcgacgaggacatcatccacagaatattccgcatctgtaacatggcccggccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggaacagtataaatttgtatacgaggtggcactggaatatttaagctccttttagctcaatgggatggggaacctgccggagtccagaggctgctgtgaccaagcccccttttgtgtgaatggcagtaactgggctcaggagctctgaggtggcaccctgcctgactccaaggagaagactggtggccctgtgttccacggggggctctgcaccttctgaggggtctcctgttgccgtgggagatgctgctccaaaaggcccaggcttccttttcaacctaaccagccacagccaagggcccaagcagaagtacacccacaagcaaggccttggatttctggctcccagaccacctgcttttgttctgagtttgtggatctcttggcaagccaactgtgcaggtgctggggagtgggaggctcccctgccctccttctccttaggagtggaggagatgtgtgttctgctcctctacgtcatggaaaagattgaggctcttgggggtcactgctctgctgccccctgcaacctccttcaggggcctctggcaccagacatttgcagtctggaccagtgtgaccttacgatgttccctaggccacaagagaggccccccatcctcacacctaacctgcatggggcttcgcccacaaccattctgtaccccttccccagcctgggccttgaccgtccagcattcactggccggccagctgtgtccacagcagtttttgataaaggtgttctttgcttttttgtgtggtcagtgggagggggtggaactgcagggaacttctctgctcctccttgtctttgtaaaaagggaccacctccctggggcagggcttgggctgacctgtaggatgtaacccctgtgtttctttggtggtagctttctttggaagagacaaacaagataagatttgattattttccaaagtgtatgtgaaaagaaactttcttttggagggtgtaaaatcttagtctcttatgtcaaaaagaagggggcgggggagtttgagtatgtacctctaagacaaatctctcgggccttttattttttcctggcaatgtccttaaaagctcccaccctgggacagcatgccactgagcaaggagagatgggtgagcctgaagatggtccctttggtttctggggcaaatagagcaccagctttgtgcataatttggatgtccaaatttgaactccttcctaaagaaacccagcagccaccttgaaaaaggccattgtggagcccattatactttgatttaaaataggccaagagaatcaggcctggagatctagggtcttgtccaaagtgtgagtgagtcaatgagagggaaccaacatttgctaagtctctactgtatgccagggatcatgcttggcactttccataggacatttcacacagtccttagaacccccaggagagagctactgacttgttatcatctccatttgatcatctcctccaatgaggaaacccacgcaccttccttagtaatgaaatcctgggttccaaaggggcaggtaatggcaatgagacttctccgtgctgttttcttcatcttctctaagccaagcaattattttatggagggaaaataaggccagaaacttctgagcagataactccacaaatggaaatttagtactttcttcctgatgccagttcttctgggaagcgcagaatttcagatatattttagtaacacattcccagctccccaggaaagccagtctcatctaatttcttagtcagtaaaaacaattccctgttccttcaggctatgaatggaccagccagggaaactctcgaccttgatctctagccagtgcttaggcccaatatctgacagcctcaggtgggctgggacctaggaagctccatcttgaaggctggtctagccccagacagggcatgaggggcagagaattcaagaaggtacagctttggccctcaagagcccactgtatgctggggaaatggaaccatggtgcagtagtgtggagtggatgagtgttccatgagcctaggagcaagaaagtctcttcggcctcgggcttcctggagaaggggacgtccattcctgctgggtcttaacaagcataaaaaggaaaaaaaggaaactcaggcaaagggatccatatgtgcaatggcaaagaaatgtgaaaaggcattgggagaagcagtctgggggaggccagcccagtgcgggcacagcacaacacggggagcagcaagagatgagccagggtccaggagacagatgcccatcgcgagtacagactttgtcctattggcaacaaggagtccatggagctttagagagatgcactcagcttcgtgttggccaagactccttctgggccaatggggctgcctcttttcctttcatcagacactgtgaaaacattcccttaagcgtgcactttttaatatcacatctatttgtctgtctgctcattgttttgttgctggaactaaatatgcaatggatcatgagactcagattctatgagaaacccagggtctctgctttaccacggagcagggtcaccaacccagatctccaggcccatgaggatggaacatgaaaggagccgacaaaagttgcttccattggcatgggctctggagctgtccagaagtccagggacaccagacttgatcaaggaagggctgtcactttagaggttcaaaaggaagtgcctcaaagcaaaggcaagcaaaggaaccccacgatgaacttgctcttttcctttgatgagcctctccccaggtgtatttcagcagaccccggggacccacccccactgggcctgctggcctccctcggctccagcccaatgccccagctggccttccccagcctgcaaggagcctgtagcatggcaaatctgcctgctgtatgctattttcttagatcttggtacatccagacaggatgagggtggagggagagctatttaacacaaatcctaagatttttttctgctcaggaaggggtgaaatagctggcagatacaaaagacagtggcttttatcattttaaatggtaggaatttaaggtgtgacttcagggagaaacaaacttgcaaaaaaaaaaaatctcaggccatgttggggtaacccagcaagggccagtgatgatttcccccagctcatccccttattttcccacaacccaaccattctctaaagcaggacagtgaataggtcttaggccagtgcacacaggaagaaattgaggcttatggatggggatgacttccctaagatcccatgggacaaggatgtggcaaggcttggatgagatggggcaccagtgcccaggaatttgaacattttcctttacccaggaaatctccggagccaacaccaccacccccagggggtctccccaccccaccccatttacagggtgagctcagcctgtcatgagcagaggaaaatattattaatgctctctgagtctttacaacaggagctcttacctcatagatgtgggctctgtttggggaagatgcaaggaagtaatgagaagcccaggaaatttctccacctgtgtttatggcctaaatagcttcaggatgtatcttagctgcactccaacattgcatcctttctggggtgaagaatctgggccaaccaggggtccttgggcctctagaaggccacagtaggcctctctttgtgggaatggaaggggacagtttgcttttagtgctggccctctctgtgggtgtggcctgcaaaggaaccaacagaccctatgctggggactctaacatgtgagctcattaaattcttccagcattctaaaggagggtttgtgattgtcaccatttactgatgaggaaactaaggctcctaggggagaaatcacttgcccacagttccacagctagtgagtgaatgaaccaggatttaaaccggttttttctcactacagagacaatatttttccaccattgtatctcacatttttcccaggaggttacccataacagaagagactagagtggaacagatacgtcagtggataaagctcaaagcaaacaacagtaagcttaaaattccttcatagtctcatgttttacgttcacaattcatgcaaaatttgcattccactttctgatttagccttgttggttttaatatgactctatgaatatttcaaaaaaaaatgtgctctgttcctcatgttgttctgttctgttcaccccgctatgacggaccctaggtcagctggtcttcagcttgaccctagaattgactctaggagcagtgaccctgctgcctcccagagccagttataggctcaagatcaagaccaactgaccttctcctaggcagctcctttggtgtgtgggtgctctgacctcactgttcatgaggggacctcaactaaggcatcttccagttgggtgctggaaggaacccattaactcacactagaatgatgaggatttgctcatctggcgtggagaaggatgagcccacaaaaccctaaagggaaaagagaagctggacacagctgtactcagcagattcctgaatgctaggctggaaagtggtgcctgttgtccaagtggagtcacatggttgctaatgtgggcaagtctgaggacacacttcatgagcagctggggtctggaaggctcctcactttaccctagccacacataattactgggtgcctacagcacctagcaccttggagggggcactattaggaaatcgagattactatggcacaattaattcctgggtaaggcatggggttgtggtggacagagctcagtctttagtttgaacgaaaacatacatacatgaaaaacatacatgaaaaaaggaccctcatcaacattagaaggggtagatttggagcactttaggcaggaaaacaggaacgcaaggccaggaaactggaacccagtgaatactcagaaccgaggatgcagatgacttatttagcaaaatggtcacttctgtgacatagctggagaaaggatgggtaacagcttgccagagccacttggaacaagggcaaatctcagtgtctggggcaaaagatgatgcatttccctctgacccatcatgtttattcatcctccactccccattgccacactagctcttgctgtaagtcctcaccaggatctacatttcctcgtcgctggtgggaaccccttagagtacatagaggtatcagtccagtaagactgctctacacaacagaagtgaggcccagggagtagcagccaggcccttatcctgttacctctgcaggagtgactgcccaacccagatccagagacattgaaggaaatgataattccttggtacctcactgccttgggacaaaatgaagaaagccacccttccttaggctgcagcttgccactcctgggctgggtaaacaggtcatcagcaccaagctcaaccaggagtaacactctggaagacatgggtgagcccaagaggaagcatgaacaggacgctgttcctaagtcatgtcaacaggttgtgctgggccaggatccccagggaaaaaaatggtcaacccaactggagggtaggttagaagaaaaaaaacataaacgtggatagtcatgtcatctcaaatccctgacttggcttccccattacttaacagtctgagctccttcttagcctgtgaccagcttcaaatcacagccaagtaaaacaaggaaataggaaaagtaaatccaactagaagagacaagctgagattcagatttgtttactcctcccatgcaaagtttccctgttggaggttttccatgtatacatgtctagaagtgatagaatgcaaggccttggctttgtcttgcagggatctgcctttgaggtcatagactgaacagcagggagagaggttagtggtggagtgtggggggagctgttctagctccagtttcttctgacacatttttcaggatcatggatctgatcctccgaagcacagcagagatatctaagccatatttgtgcacatgagcagactcttctagttttttagtaaccagggatgggcttttgcatggcactgactatagagatgtcttgtagagatcaagccagtcttttgcatcccacctgcccacctccagaagagatgggaaaaggtcatcaaagggcattcaccaactgaaatccactcatgaatgttaggtctctaaaaggaggcatcaacactcacaatggtagcctccaaacctagcatcccacctatctaagagctcaggggtggtccactggggcagatacaagggaagtgcaagggctcaggatgaaagaaaatctattgggaagagttttaggggcttgatcattatggggcttccttctatatctgagaactgctctgggtggtgagatgtggactctgatccttaattggaatgttcggagaatgagtgtctggtggccttgaagtgttggacagaaaagtatcagtataaaagcctggagctcagggtaattaatgtagttcatggttccttagtgagcaggactcttggatgtggaggagaaagggtcataggaagtaaaccaccaaaattacaaaattgagtctctgtacaattacttcagtgcctttgggcttatgaatacaaatcagtgggccttctctatgatggtccaacaaactctcagtgtccaccctgtccctgtatctcccatggaagatgaataatgtcaggtgttctttgggtcaaaggccccagggcagtctggaggcttagagggcagagtggtgtcattccatgtaaagttaggcttctgaggggtcaggcagaatatggtgtccatatcttccatagctctgcagattcttggatgaagtcaagcacagtttgctagacccaggtcactcctctgagtataactaggacccatgagtgaaacttaatagctgtaaggaagaacctgctgtctgccagagaggataagctgcccatctcagcagctgtctaaaagaaggcaggtgtctctttaaagggaagagaagcattggtgaaatggatttcaggtcacttccattccagatgggtgagatcttgtggagctgggatcatgtttgaactcattcatacctgtagagcacgaatccaagtagattgtgtttggtctgtacaggctgaagccccctgctctcccacccaagtgcccccactgagcaggccaacatgctgttgtggccacatatactgggctgatccaggctggttatcaccaaacagcaaaccatagggaacagctgctttgccatagacccaatacccatgtagatctctcatgagagcagccataactcagacccactgaccaacagggccatgagtgacagccagaaccagtgaaggtccaagtaggacacagagcagggcttttcttaccatacacattatctccagaggttatttctaccccactccctattcaaggcctgttggagcacactgcaaaagcaaaagcacagtaactcaatttacacatgattataatcatttccagtgcacacatttcatcaccaggtggatcctgagctagcccatgtaaatccgggttaacccatattggtaatcatactcaaaagcacttttcaccctacattctactagccaatcaaagacaaagagttgtggcctctaccattgccttggcttctggacaccctcacaagctatcccaaggttcccgctcaactccagggaggctgacatcttcacatccactgggcatataatattgcatgagaccaaagtctccacactctttgcagcctcctccatgaatcccaatggcctgcacttgtacagtttgggtgtttgatagataaagcacgtatgagaagagaaaacaaaataaatcaactttttaaaaaagccagcactgtgctgtcaatgttttttttttcttttcaattctagctcagaaaagcagaaggtaaataatgtcaggtcaatgaatatcagatatattttttgactgtacattacagtgaagtgtaatctttttacacctgcaagtccatcttatttattcttgtaaatgttccctgacaatgtttgtaacatggctgtgttaaaaaatctatacaataaagctgtgaccctgagattcatgttttcctaagata

SEQ ID NO: 17038 - DNA, 12746 bp, Homo sapiens
  ENST00000373198
ttaggactcgggggacaccgccccccgccccccgcgtcccgcccccgcccagcctcccgcctcagttcgcgccgcgcctcggcttggaacgcaggagcgccggctccgggagcccgagcggagccagccgcgcgcacagccagcggccgcgccggcgatgcggggccaccccgcgcccgccccagtcccggccccggcccccgcgggaaggggctgagctgcccgccgccgcccggatggcgagcctcgccgcgctcgccctcagcctgctcctgaggctgcagctgccgccactgcccggcgcccgggctcagagcgccgcaggtggctgttcctttgatgagcactacagcaactgtggttatagtgtggctctagggaccaatgggttcacctgggagcagattaacacatgggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccagggcctcccctcaccaccaggaccaagtgtgcagatccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgttccaggagctgttcctctagaatccatccaaggggggccctttgaggagaagatctacatccagtggaaacctcccaatgagaccaatggggtcatcacgctctacgagatcaactacaaggctgtcggctcgctggacccaagtgctgacctctcgagccagagggggaaagtgttcaagctccggaatgaaacccaccacctctttgtgggtctgtacccagggaccacctattccttcaccatcaaggccagcacagcaaagggctttgggccccctgtcaccactcggattgccaccaaaatttcagctccatccatgcctgagtacgacacagacaccccattgaatgagacagacacgaccatcacagtgatgctgaaacccgctcagtcccggggagctcctgtcagtgtttatcagctggttgtcaaggaggagcgacttcagaagtcacggagggcagctgacattattgagtgcttttcggtgcccgtgagctatcggaatgcctccagcctcgattctctacactactttgctgctgagttgaagcctgccaacctgcctgtcacccagccatttacagtgggtgacaataagacatacaatggctactggaaccctcctctctctcccctgaaaagctacagcatctacttccaggcactcagcaaagccaatggagagaccaaaatcaactgtgttcgtctggctacaaaagcaccaatgggcagcgcccaggtgaccccggggactccactctgcctcctcaccacaggtgcctccacccagaattctaacactgtggagccagagaagcaggtggacaacaccgtgaagatggctggcgtgatcgctggcctcctcatgttcatcatcattctcctgggcgtgatgctcaccatcaaaaggagaagaaatgcttattcctactcctattacttgaagctggccaagaagcagaaggagacccagagtggagcccagagggagatggggcctgtggcctctgccgacaaacccaccaccaagctcagcgccagccgcaatgatgaaggcttctcttctagttctcaggacgtcaacggattcacagatggcagccgcggggagctttcccagcccaccctcacgatccagactcatccctaccgcacctgtgaccctgtggagatgagctacccccgggaccagttccaacccgccatccgggtggctgacttgctgcagcacatcacgcagatgaagagaggccagggctacgggttcaaggaggaatacgaggccttaccagaggggcagacagcttcgtgggacacagccaaggaggatgaaaaccgcaataagaatcgatatgggaacatcatatcctacgaccattcccgggtgaggctgctggtgctggatggagacccgcactctgactacatcaatgccaactacattgacggataccatcgacctcggcactacattgcgactcaaggtccgatgcaggagactgtaaaggacttttggagaatgatctggcaggagaactccgccagcatcgtcatggtcacaaacctggtggaagtgggcagggtgaaatgtgtgcgatactggccagatgacacggaggtctacggagacattaaagtcaccctgattgaaacagagcccctggcagaatacgtcatacgcaccttcacagtccagaagaaaggctaccatgagatccgggagctccgcctcttccacttcaccagctggcctgaccacggcgttccctgctatgccactggccttctgggcttcgtccgccaggtcaagttcctcaaccccccggaagctgggcccatagtggtccactgcagtgctggggctgggcggactggctgcttcattgccattgacaccatgcttgacatggccgagaatgaaggggtggtggacatcttcaactgcgtgcgtgagctccgggcccaaagggtcaacctggtacagacagaggagcaatatgtgtttgtgcacgatgccatcctggaagcgtgcctctgtggcaacactgccatccctgtgtgtgagttccgttctctctactacaatatcagcaggctggacccccagacaaactccagccaaatcaaagatgaatttcagaccctcaacattgtgacaccccgtgtgcggcccgaggactgcagcattgggctcctgccccggaaccatgataagaatcgaagtatggacgtgctgcctctggaccgctgcctgcccttccttatctcagtggacggagaatccagcaattacatcaacgcagcactgatggatagccacaagcagcctgccgccttcgtggtcacccagcaccctctacccaacaccgtggcagacttctggaggctggtgttcgattacaactgctcctctgtggtgatgctgaatgagatggacactgcccagttctgtatgcagtactggcctgagaagacctccgggtgctatgggcccatccaggtggagttcgtctccgcagacatcgacgaggacatcatccacagaatattccgcatctgtaacatggcccggccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggaacagtataaatttgtatacgaggtggcactggaatatttaagctccttttagctcaatgggatggggaacctgccggagtccagaggctgctgtgaccaagcccccttttgtgtgaatggcagtaactgggctcaggagctctgaggtggcaccctgcctgactccaaggagaagactggtggccctgtgttccacggggggctctgcaccttctgaggggtctcctgttgccgtgggagatgctgctccaaaaggcccaggcttccttttcaacctaaccagccacagccaagggcccaagcagaagtacacccacaagcaaggccttggatttctggctcccagaccacctgcttttgttctgagtttgtggatctcttggcaagccaactgtgcaggtgctggggagtgggaggctcccctgccctccttctccttaggagtggaggagatgtgtgttctgctcctctacgtcatggaaaagattgaggctcttgggggtcactgctctgctgccccctgcaacctccttcaggggcctctggcaccagacatttgcagtctggaccagtgtgaccttacgatgttccctaggccacaagagaggccccccatcctcacacctaacctgcatggggcttcgcccacaaccattctgtaccccttccccagcctgggccttgaccgtccagcattcactggccggccagctgtgtccacagcagtttttgataaaggtgttctttgcttttttgtgtggtcagtgggagggggtggaactgcagggaacttctctgctcctccttgtctttgtaaaaagggaccacctccctggggcagggcttgggctgacctgtaggatgtaacccctgtgtttctttggtggtagctttctttggaagagacaaacaagataagatttgattattttccaaagtgtatgtgaaaagaaactttcttttggagggtgtaaaatcttagtctcttatgtcaaaaagaagggggcgggggagtttgagtatgtacctctaagacaaatctctcgggccttttattttttcctggcaatgtccttaaaagctcccaccctgggacagcatgccactgagcaaggagagatgggtgagcctgaagatggtccctttggtttctggggcaaatagagcaccagctttgtgcataatttggatgtccaaatttgaactccttcctaaagaaacccagcagccaccttgaaaaaggccattgtggagcccattatactttgatttaaaataggccaagagaatcaggcctggagatctagggtcttgtccaaagtgtgagtgagtcaatgagagggaaccaacatttgctaagtctctactgtatgccagggatcatgcttggcactttccataggacatttcacacagtccttagaacccccaggagagagctactgacttgttatcatctccatttgatcatctcctccaatgaggaaacccacgcaccttccttagtaatgaaatcctgggttccaaaggggcaggtaatggcaatgagacttctccgtgctgttttcttcatcttctctaagccaagcaattattttatggagggaaaataaggccagaaacttctgagcagataactccacaaatggaaatttagtactttcttcctgatgccagttcttctgggaagcgcagaatttcagatatattttagtaacacattcccagctccccaggaaagccagtctcatctaatttcttagtcagtaaaaacaattccctgttccttcaggctatgaatggaccagccagggaaactctcgaccttgatctctagccagtgcttaggcccaatatctgacagcctcaggtgggctgggacctaggaagctccatcttgaaggctggtctagccccagacagggcatgaggggcagagaattcaagaaggtacagctttggccctcaagagcccactgtatgctggggaaatggaaccatggtgcagtagtgtggagtggatgagtgttccatgagcctaggagcaagaaagtctcttcggcctcgggcttcctggagaaggggacgtccattcctgctgggtcttaacaagcataaaaaggaaaaaaaggaaactcaggcaaagggatccatatgtgcaatggcaaagaaatgtgaaaaggcattgggagaagcagtctgggggaggccagcccagtgcgggcacagcacaacacggggagcagcaagagatgagccagggtccaggagacagatgcccatcgcgagtacagactttgtcctattggcaacaaggagtccatggagctttagagagatgcactcagcttcgtgttggccaagactccttctgggccaatggggctgcctcttttcctttcatcagacactgtgaaaacattcccttaagcgtgcactttttaatatcacatctatttgtctgtctgctcattgttttgttgctggaactaaatatgcaatggatcatgagactcagattctatgagaaacccagggtctctgctttaccacggagcagggtcaccaacccagatctccaggcccatgaggatggaacatgaaaggagccgacaaaagttgcttccattggcatgggctctggagctgtccagaagtccagggacaccagacttgatcaaggaagggctgtcactttagaggttcaaaaggaagtgcctcaaagcaaaggcaagcaaaggaaccccacgatgaacttgctcttttcctttgatgagcctctccccaggtgtatttcagcagaccccggggacccacccccactgggcctgctggcctccctcggctccagcccaatgccccagctggccttccccagcctgcaaggagcctgtagcatggcaaatctgcctgctgtatgctattttcttagatcttggtacatccagacaggatgagggtggagggagagctatttaacacaaatcctaagatttttttctgctcaggaaggggtgaaatagctggcagatacaaaagacagtggcttttatcattttaaatggtaggaatttaaggtgtgacttcagggagaaacaaacttgcaaaaaaaaaaaatctcaggccatgttggggtaacccagcaagggccagtgatgatttcccccagctcatccccttattttcccacaacccaaccattctctaaagcaggacagtgaataggtcttaggccagtgcacacaggaagaaattgaggcttatggatggggatgacttccctaagatcccatgggacaaggatgtggcaaggcttggatgagatggggcaccagtgcccaggaatttgaacattttcctttacccaggaaatctccggagccaacaccaccacccccagggggtctccccaccccaccccatttacagggtgagctcagcctgtcatgagcagaggaaaatattattaatgctctctgagtctttacaacaggagctcttacctcatagatgtgggctctgtttggggaagatgcaaggaagtaatgagaagcccaggaaatttctccacctgtgtttatggcctaaatagcttcaggatgtatcttagctgcactccaacattgcatcctttctggggtgaagaatctgggccaaccaggggtccttgggcctctagaaggccacagtaggcctctctttgtgggaatggaaggggacagtttgcttttagtgctggccctctctgtgggtgtggcctgcaaaggaaccaacagaccctatgctggggactctaacatgtgagctcattaaattcttccagcattctaaaggagggtttgtgattgtcaccatttactgatgaggaaactaaggctcctaggggagaaatcacttgcccacagttccacagctagtgagtgaatgaaccaggatttaaaccggttttttctcactacagagacaatatttttccaccattgtatctcacatttttcccaggaggttacccataacagaagagactagagtggaacagatacgtcagtggataaagctcaaagcaaacaacagtaagcttaaaattccttcatagtctcatgttttacgttcacaattcatgcaaaatttgcattccactttctgatttagccttgttggttttaatatgactctatgaatatttcaaaaaaaaatgtgctctgttcctcatgttgttctgttctgttcaccccgctatgacggaccctaggtcagctggtcttcagcttgaccctagaattgactctaggagcagtgaccctgctgcctcccagagccagttataggctcaagatcaagaccaactgaccttctcctaggcagctcctttggtgtgtgggtgctctgacctcactgttcatgaggggacctcaactaaggcatcttccagttgggtgctggaaggaacccattaactcacactagaatgatgaggatttgctcatctggcgtggagaaggatgagcccacaaaaccctaaagggaaaagagaagctggacacagctgtactcagcagattcctgaatgctaggctggaaagtggtgcctgttgtccaagtggagtcacatggttgctaatgtgggcaagtctgaggacacacttcatgagcagctggggtctggaaggctcctcactttaccctagccacacataattactgggtgcctacagcacctagcaccttggagggggcactattaggaaatcgagattactatggcacaattaattcctgggtaaggcatggggttgtggtggacagagctcagtctttagtttgaacgaaaacatacatacatgaaaaacatacatgaaaaaaggaccctcatcaacattagaaggggtagatttggagcactttaggcaggaaaacaggaacgcaaggccaggaaactggaacccagtgaatactcagaaccgaggatgcagatgacttatttagcaaaatggtcacttctgtgacatagctggagaaaggatgggtaacagcttgccagagccacttggaacaagggcaaatctcagtgtctggggcaaaagatgatgcatttccctctgacccatcatgtttattcatcctccactccccattgccacactagctcttgctgtaagtcctcaccaggatctacatttcctcgtcgctggtgggaaccccttagagtacatagaggtatcagtccagtaagactgctctacacaacagaagtgaggcccagggagtagcagccaggcccttatcctgttacctctgcaggagtgactgcccaacccagatccagagacattgaaggaaatgataattccttggtacctcactgccttgggacaaaatgaagaaagccacccttccttaggctgcagcttgccactcctgggctgggtaaacaggtcatcagcaccaagctcaaccaggagtaacactctggaagacatgggtgagcccaagaggaagcatgaacaggacgctgttcctaagtcatgtcaacaggttgtgctgggccaggatccccagggaaaaaaatggtcaacccaactggagggtaggttagaagaaaaaaaacataaacgtggatagtcatgtcatctcaaatccctgacttggcttccccattacttaacagtctgagctccttcttagcctgtgaccagcttcaaatcacagccaagtaaaacaaggaaataggaaaagtaaatccaactagaagagacaagctgagattcagatttgtttactcctcccatgcaaagtttccctgttggaggttttccatgtatacatgtctagaagtgatagaatgcaaggccttggctttgtcttgcagggatctgcctttgaggtcatagactgaacagcagggagagaggttagtggtggagtgtggggggagctgttctagctccagtttcttctgacacatttttcaggatcatggatctgatcctccgaagcacagcagagatatctaagccatatttgtgcacatgagcagactcttctagttttttagtaaccagggatgggcttttgcatggcactgactatagagatgtcttgtagagatcaagccagtcttttgcatcccacctgcccacctccagaagagatgggaaaaggtcatcaaagggcattcaccaactgaaatccactcatgaatgttaggtctctaaaaggaggcatcaacactcacaatggtagcctccaaacctagcatcccacctatctaagagctcaggggtggtccactggggcagatacaagggaagtgcaagggctcaggatgaaagaaaatctattgggaagagttttaggggcttgatcattatggggcttccttctatatctgagaactgctctgggtggtgagatgtggactctgatccttaattggaatgttcggagaatgagtgtctggtggccttgaagtgttggacagaaaagtatcagtataaaagcctggagctcagggtaattaatgtagttcatggttccttagtgagcaggactcttggatgtggaggagaaagggtcataggaagtaaaccaccaaaattacaaaattgagtctctgtacaattacttcagtgcctttgggcttatgaatacaaatcagtgggccttctctatgatggtccaacaaactctcagtgtccaccctgtccctgtatctcccatggaagatgaataatgtcaggtgttctttgggtcaaaggccccagggcagtctggaggcttagagggcagagtggtgtcattccatgtaaagttaggcttctgaggggtcaggcagaatatggtgtccatatcttccatagctctgcagattcttggatgaagtcaagcacagtttgctagacccaggtcactcctctgagtataactaggacccatgagtgaaacttaatagctgtaaggaagaacctgctgtctgccagagaggataagctgcccatctcagcagctgtctaaaagaaggcaggtgtctctttaaagggaagagaagcattggtgaaatggatttcaggtcacttccattccagatgggtgagatcttgtggagctgggatcatgtttgaactcattcatacctgtagagcacgaatccaagtagattgtgtttggtctgtacaggctgaagccccctgctctcccacccaagtgcccccactgagcaggccaacatgctgttgtggccacatatactgggctgatccaggctggttatcaccaaacagcaaaccatagggaacagctgctttgccatagacccaatacccatgtagatctctcatgagagcagccataactcagacccactgaccaacagggccatgagtgacagccagaaccagtgaaggtccaagtaggacacagagcagggcttttcttaccatacacattatctccagaggttatttctaccccactccctattcaaggcctgttggagcacactgcaaaagcaaaagcacagtaactcaatttacacatgattataatcatttccagtgcacacatttcatcaccaggtggatcctgagctagcccatgtaaatccgggttaacccatattggtaatcatactcaaaagcacttttcaccctacattctactagccaatcaaagacaaagagttgtggcctctaccattgccttggcttctggacaccctcacaagctatcccaaggttcccgctcaactccagggaggctgacatcttcacatccactgggcatataatattgcatgagaccaaagtctccacactctttgcagcctcctccatgaatcccaatggcctgcacttgtacagtttgggtgtttgatagataaagcacgtatgagaagagaaaacaaaataaatcaactttttaaaaaagccagcactgtgctgtcaatgttttttttttcttttcaattctagctcagaaaagcagaaggtaaataatgtcaggtcaatgaatatcagatatattttttgactgtacattacagtgaagtgtaatctttttacacctgcaagtccatcttatttattcttgtaaatgttccctgacaatgtttgtaacatggctgtgttaaaaaatctatacaataaagctgtgaccctgagattcatgttttcctaagata

SEQ ID NO: 17039 - DNA, 12660 bp, Homo sapiens
  ENST00000373201
gttaggactcgggggacaccgccccccgccccccgcgtcccgcccccgcccagcctcccgcctcagttcgcgccgcgcctcggcttggaacgcaggagcgccggctccgggagcccgagcggagccagccgcgcgcacagccagcggccgcgccggcgatgcggggccaccccgcgcccgccccagtcccggccccggcccccgcgggaaggggctgagctgcccgccgccgcccggatggcgagcctcgccgcgctcgccctcagcctgctcctgaggctgcagctgccgccactgcccggcgcccgggctcagagcgccgcaggtggctgttcctttgatgagcactacagcaactgtggttatagtgtggctctagggaccaatgggttcacctgggagcagattaacacatgggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccagggcctcccctcaccaccaggaccaagtgtgcagatccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgttccaggagctgttcctctagaatccatccaaggggggccctttgaggagaagatctacatccagtggaaacctcccaatgagaccaatggggtcatcacgctctacgagatcaactacaaggctgtcggctcgctggacccaagtgctgacctctcgagccagagggggaaagtgttcaagctccggaatgaaacccaccacctctttgtgggtctgtacccagggaccacctattccttcaccatcaaggccagcacagcaaagggctttgggccccctgtcaccactcggattgccaccaaaatttcagctccatccatgcctgagtacgacacagacaccccattgaatgagacagacacgaccatcacagtgatgctgaaacccgctcagtcccggggagctcctgtcagtgtttatcagctggttgtcaaggaggagcgacttcagaagtcacggagggcagctgacattattgagtgcttttcggtgcccgtgagctatcggaatgcctccagcctcgattctctacactactttgctgctgagttgaagcctgccaacctgcctgtcacccagccatttacagtgggtgacaataagacatacaatggctactggaaccctcctctctctcccctgaaaagctacagcatctacttccaggcactcagcaaagccaatggagagaccaaaatcaactgtgttcgtctggctacaaaaggtgcctccacccagaattctaacactgtggagccagagaagcaggtggacaacaccgtgaagatggctggcgtgatcgctggcctcctcatgttcatcatcattctcctgggcgtgatgctcaccatcaaaaggaggaagctggccaagaagcagaaggagacccagagtggagcccagagggagatggggcctgtggcctctgccgacaaacccaccaccaagctcagcgccagccgcaatgatgaaggcttctcttctagttctcaggacgtcaacggattcacagatggcagccgcggggagctttcccagcccaccctcacgatccagactcatccctaccgcacctgtgaccctgtggagatgagctacccccgggaccagttccaacccgccatccgggtggctgacttgctgcagcacatcacgcagatgaagagaggccagggctacgggttcaaggaggaatacgaggccttaccagaggggcagacagcttcgtgggacacagccaaggaggatgaaaaccgcaataagaatcgatatgggaacatcatatcctacgaccattcccgggtgaggctgctggtgctggatggagacccgcactctgactacatcaatgccaactacattgacggataccatcgacctcggcactacattgcgactcaaggtccgatgcaggagactgtaaaggacttttggagaatgatctggcaggagaactccgccagcatcgtcatggtcacaaacctggtggaagtgggcagggtgaaatgtgtgcgatactggccagatgacacggaggtctacggagacattaaagtcaccctgattgaaacagagcccctggcagaatacgtcatacgcaccttcacagtccagaagaaaggctaccatgagatccgggagctccgcctcttccacttcaccagctggcctgaccacggcgttccctgctatgccactggccttctgggcttcgtccgccaggtcaagttcctcaaccccccggaagctgggcccatagtggtccactgcagtgctggggctgggcggactggctgcttcattgccattgacaccatgcttgacatggccgagaatgaaggggtggtggacatcttcaactgcgtgcgtgagctccgggcccaaagggtcaacctggtacagacagaggagcaatatgtgtttgtgcacgatgccatcctggaagcgtgcctctgtggcaacactgccatccctgtgtgtgagttccgttctctctactacaatatcagcaggctggacccccagacaaactccagccaaatcaaagatgaatttcagaccctcaacattgtgacaccccgtgtgcggcccgaggactgcagcattgggctcctgccccggaaccatgataagaatcgaagtatggacgtgctgcctctggaccgctgcctgcccttccttatctcagtggacggagaatccagcaattacatcaacgcagcactgatggatagccacaagcagcctgccgccttcgtggtcacccagcaccctctacccaacaccgtggcagacttctggaggctggtgttcgattacaactgctcctctgtggtgatgctgaatgagatggacactgcccagttctgtatgcagtactggcctgagaagacctccgggtgctatgggcccatccaggtggagttcgtctccgcagacatcgacgaggacatcatccacagaatattccgcatctgtaacatggcccggccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggaacagtataaatttgtatacgaggtggcactggaatatttaagctccttttagctcaatgggatggggaacctgccggagtccagaggctgctgtgaccaagcccccttttgtgtgaatggcagtaactgggctcaggagctctgaggtggcaccctgcctgactccaaggagaagactggtggccctgtgttccacggggggctctgcaccttctgaggggtctcctgttgccgtgggagatgctgctccaaaaggcccaggcttccttttcaacctaaccagccacagccaagggcccaagcagaagtacacccacaagcaaggccttggatttctggctcccagaccacctgcttttgttctgagtttgtggatctcttggcaagccaactgtgcaggtgctggggagtgggaggctcccctgccctccttctccttaggagtggaggagatgtgtgttctgctcctctacgtcatggaaaagattgaggctcttgggggtcactgctctgctgccccctgcaacctccttcaggggcctctggcaccagacatttgcagtctggaccagtgtgaccttacgatgttccctaggccacaagagaggccccccatcctcacacctaacctgcatggggcttcgcccacaaccattctgtaccccttccccagcctgggccttgaccgtccagcattcactggccggccagctgtgtccacagcagtttttgataaaggtgttctttgcttttttgtgtggtcagtgggagggggtggaactgcagggaacttctctgctcctccttgtctttgtaaaaagggaccacctccctggggcagggcttgggctgacctgtaggatgtaacccctgtgtttctttggtggtagctttctttggaagagacaaacaagataagatttgattattttccaaagtgtatgtgaaaagaaactttcttttggagggtgtaaaatcttagtctcttatgtcaaaaagaagggggcgggggagtttgagtatgtacctctaagacaaatctctcgggccttttattttttcctggcaatgtccttaaaagctcccaccctgggacagcatgccactgagcaaggagagatgggtgagcctgaagatggtccctttggtttctggggcaaatagagcaccagctttgtgcataatttggatgtccaaatttgaactccttcctaaagaaacccagcagccaccttgaaaaaggccattgtggagcccattatactttgatttaaaataggccaagagaatcaggcctggagatctagggtcttgtccaaagtgtgagtgagtcaatgagagggaaccaacatttgctaagtctctactgtatgccagggatcatgcttggcactttccataggacatttcacacagtccttagaacccccaggagagagctactgacttgttatcatctccatttgatcatctcctccaatgaggaaacccacgcaccttccttagtaatgaaatcctgggttccaaaggggcaggtaatggcaatgagacttctccgtgctgttttcttcatcttctctaagccaagcaattattttatggagggaaaataaggccagaaacttctgagcagataactccacaaatggaaatttagtactttcttcctgatgccagttcttctgggaagcgcagaatttcagatatattttagtaacacattcccagctccccaggaaagccagtctcatctaatttcttagtcagtaaaaacaattccctgttccttcaggctatgaatggaccagccagggaaactctcgaccttgatctctagccagtgcttaggcccaatatctgacagcctcaggtgggctgggacctaggaagctccatcttgaaggctggtctagccccagacagggcatgaggggcagagaattcaagaaggtacagctttggccctcaagagcccactgtatgctggggaaatggaaccatggtgcagtagtgtggagtggatgagtgttccatgagcctaggagcaagaaagtctcttcggcctcgggcttcctggagaaggggacgtccattcctgctgggtcttaacaagcataaaaaggaaaaaaaggaaactcaggcaaagggatccatatgtgcaatggcaaagaaatgtgaaaaggcattgggagaagcagtctgggggaggccagcccagtgcgggcacagcacaacacggggagcagcaagagatgagccagggtccaggagacagatgcccatcgcgagtacagactttgtcctattggcaacaaggagtccatggagctttagagagatgcactcagcttcgtgttggccaagactccttctgggccaatggggctgcctcttttcctttcatcagacactgtgaaaacattcccttaagcgtgcactttttaatatcacatctatttgtctgtctgctcattgttttgttgctggaactaaatatgcaatggatcatgagactcagattctatgagaaacccagggtctctgctttaccacggagcagggtcaccaacccagatctccaggcccatgaggatggaacatgaaaggagccgacaaaagttgcttccattggcatgggctctggagctgtccagaagtccagggacaccagacttgatcaaggaagggctgtcactttagaggttcaaaaggaagtgcctcaaagcaaaggcaagcaaaggaaccccacgatgaacttgctcttttcctttgatgagcctctccccaggtgtatttcagcagaccccggggacccacccccactgggcctgctggcctccctcggctccagcccaatgccccagctggccttccccagcctgcaaggagcctgtagcatggcaaatctgcctgctgtatgctattttcttagatcttggtacatccagacaggatgagggtggagggagagctatttaacacaaatcctaagatttttttctgctcaggaaggggtgaaatagctggcagatacaaaagacagtggcttttatcattttaaatggtaggaatttaaggtgtgacttcagggagaaacaaacttgcaaaaaaaaaaaatctcaggccatgttggggtaacccagcaagggccagtgatgatttcccccagctcatccccttattttcccacaacccaaccattctctaaagcaggacagtgaataggtcttaggccagtgcacacaggaagaaattgaggcttatggatggggatgacttccctaagatcccatgggacaaggatgtggcaaggcttggatgagatggggcaccagtgcccaggaatttgaacattttcctttacccaggaaatctccggagccaacaccaccacccccagggggtctccccaccccaccccatttacagggtgagctcagcctgtcatgagcagaggaaaatattattaatgctctctgagtctttacaacaggagctcttacctcatagatgtgggctctgtttggggaagatgcaaggaagtaatgagaagcccaggaaatttctccacctgtgtttatggcctaaatagcttcaggatgtatcttagctgcactccaacattgcatcctttctggggtgaagaatctgggccaaccaggggtccttgggcctctagaaggccacagtaggcctctctttgtgggaatggaaggggacagtttgcttttagtgctggccctctctgtgggtgtggcctgcaaaggaaccaacagaccctatgctggggactctaacatgtgagctcattaaattcttccagcattctaaaggagggtttgtgattgtcaccatttactgatgaggaaactaaggctcctaggggagaaatcacttgcccacagttccacagctagtgagtgaatgaaccaggatttaaaccggttttttctcactacagagacaatatttttccaccattgtatctcacatttttcccaggaggttacccataacagaagagactagagtggaacagatacgtcagtggataaagctcaaagcaaacaacagtaagcttaaaattccttcatagtctcatgttttacgttcacaattcatgcaaaatttgcattccactttctgatttagccttgttggttttaatatgactctatgaatatttcaaaaaaaaatgtgctctgttcctcatgttgttctgttctgttcaccccgctatgacggaccctaggtcagctggtcttcagcttgaccctagaattgactctaggagcagtgaccctgctgcctcccagagccagttataggctcaagatcaagaccaactgaccttctcctaggcagctcctttggtgtgtgggtgctctgacctcactgttcatgaggggacctcaactaaggcatcttccagttgggtgctggaaggaacccattaactcacactagaatgatgaggatttgctcatctggcgtggagaaggatgagcccacaaaaccctaaagggaaaagagaagctggacacagctgtactcagcagattcctgaatgctaggctggaaagtggtgcctgttgtccaagtggagtcacatggttgctaatgtgggcaagtctgaggacacacttcatgagcagctggggtctggaaggctcctcactttaccctagccacacataattactgggtgcctacagcacctagcaccttggagggggcactattaggaaatcgagattactatggcacaattaattcctgggtaaggcatggggttgtggtggacagagctcagtctttagtttgaacgaaaacatacatacatgaaaaacatacatgaaaaaaggaccctcatcaacattagaaggggtagatttggagcactttaggcaggaaaacaggaacgcaaggccaggaaactggaacccagtgaatactcagaaccgaggatgcagatgacttatttagcaaaatggtcacttctgtgacatagctggagaaaggatgggtaacagcttgccagagccacttggaacaagggcaaatctcagtgtctggggcaaaagatgatgcatttccctctgacccatcatgtttattcatcctccactccccattgccacactagctcttgctgtaagtcctcaccaggatctacatttcctcgtcgctggtgggaaccccttagagtacatagaggtatcagtccagtaagactgctctacacaacagaagtgaggcccagggagtagcagccaggcccttatcctgttacctctgcaggagtgactgcccaacccagatccagagacattgaaggaaatgataattccttggtacctcactgccttgggacaaaatgaagaaagccacccttccttaggctgcagcttgccactcctgggctgggtaaacaggtcatcagcaccaagctcaaccaggagtaacactctggaagacatgggtgagcccaagaggaagcatgaacaggacgctgttcctaagtcatgtcaacaggttgtgctgggccaggatccccagggaaaaaaatggtcaacccaactggagggtaggttagaagaaaaaaaacataaacgtggatagtcatgtcatctcaaatccctgacttggcttccccattacttaacagtctgagctccttcttagcctgtgaccagcttcaaatcacagccaagtaaaacaaggaaataggaaaagtaaatccaactagaagagacaagctgagattcagatttgtttactcctcccatgcaaagtttccctgttggaggttttccatgtatacatgtctagaagtgatagaatgcaaggccttggctttgtcttgcagggatctgcctttgaggtcatagactgaacagcagggagagaggttagtggtggagtgtggggggagctgttctagctccagtttcttctgacacatttttcaggatcatggatctgatcctccgaagcacagcagagatatctaagccatatttgtgcacatgagcagactcttctagttttttagtaaccagggatgggcttttgcatggcactgactatagagatgtcttgtagagatcaagccagtcttttgcatcccacctgcccacctccagaagagatgggaaaaggtcatcaaagggcattcaccaactgaaatccactcatgaatgttaggtctctaaaaggaggcatcaacactcacaatggtagcctccaaacctagcatcccacctatctaagagctcaggggtggtccactggggcagatacaagggaagtgcaagggctcaggatgaaagaaaatctattgggaagagttttaggggcttgatcattatggggcttccttctatatctgagaactgctctgggtggtgagatgtggactctgatccttaattggaatgttcggagaatgagtgtctggtggccttgaagtgttggacagaaaagtatcagtataaaagcctggagctcagggtaattaatgtagttcatggttccttagtgagcaggactcttggatgtggaggagaaagggtcataggaagtaaaccaccaaaattacaaaattgagtctctgtacaattacttcagtgcctttgggcttatgaatacaaatcagtgggccttctctatgatggtccaacaaactctcagtgtccaccctgtccctgtatctcccatggaagatgaataatgtcaggtgttctttgggtcaaaggccccagggcagtctggaggcttagagggcagagtggtgtcattccatgtaaagttaggcttctgaggggtcaggcagaatatggtgtccatatcttccatagctctgcagattcttggatgaagtcaagcacagtttgctagacccaggtcactcctctgagtataactaggacccatgagtgaaacttaatagctgtaaggaagaacctgctgtctgccagagaggataagctgcccatctcagcagctgtctaaaagaaggcaggtgtctctttaaagggaagagaagcattggtgaaatggatttcaggtcacttccattccagatgggtgagatcttgtggagctgggatcatgtttgaactcattcatacctgtagagcacgaatccaagtagattgtgtttggtctgtacaggctgaagccccctgctctcccacccaagtgcccccactgagcaggccaacatgctgttgtggccacatatactgggctgatccaggctggttatcaccaaacagcaaaccatagggaacagctgctttgccatagacccaatacccatgtagatctctcatgagagcagccataactcagacccactgaccaacagggccatgagtgacagccagaaccagtgaaggtccaagtaggacacagagcagggcttttcttaccatacacattatctccagaggttatttctaccccactccctattcaaggcctgttggagcacactgcaaaagcaaaagcacagtaactcaatttacacatgattataatcatttccagtgcacacatttcatcaccaggtggatcctgagctagcccatgtaaatccgggttaacccatattggtaatcatactcaaaagcacttttcaccctacattctactagccaatcaaagacaaagagttgtggcctctaccattgccttggcttctggacaccctcacaagctatcccaaggttcccgctcaactccagggaggctgacatcttcacatccactgggcatataatattgcatgagaccaaagtctccacactctttgcagcctcctccatgaatcccaatggcctgcacttgtacagtttgggtgtttgatagataaagcacgtatgagaagagaaaacaaaataaatcaactttttaaaaaagccagcactgtgctgtcaatgttttttttttcttttcaattctagctcagaaaagcagaaggtaaataatgtcaggtcaatgaatatcagatatattttttgactgtacattacagtgaagtgtaatctttttacacctgcaagtccatcttatttattcttgtaaatgttccctgacaatgtttgtaacatggctgtgttaaaaaatctatacaataaagctgtgaccctgagattcatgttttcctaagata

SEQ ID NO: 17040 - DNA, 12681 bp, Homo sapiens
  ENST00000373193
cctcccgcctcagttcgcgccgcgcctcggcttggaacgcaggagcgccggctccgggagcccgagcggagccagccgcgcgcacagccagcggccgcgccggcgatgcggggccaccccgcgcccgccccagtcccggccccggcccccgcgggaaggggctgagctgcccgccgccgcccggatggcgagcctcgccgcgctcgccctcagcctgctcctgaggctgcagctgccgccactgcccggcgcccgggctcagagcgccgcaggtggctgttcctttgatgagcactacagcaactgtggttatagtgtggctctagggaccaatgggttcacctgggagcagattaacacatgggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccagggcctcccctcaccaccaggaccaagtgtgcagatccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgttccaggagctgttcctctagaatccatccaaggggggccctttgaggagaagatctacatccagtggaaacctcccaatgagaccaatggggtcatcacgctctacgagatcaactacaaggctgtcggctcgctggacccaagtgctgacctctcgagccagagggggaaagtgttcaagctccggaatgaaacccaccacctctttgtgggtctgtacccagggaccacctattccttcaccatcaaggccagcacagcaaagggctttgggccccctgtcaccactcggattgccaccaaaatttcagctccatccatgcctgagtacgacacagacaccccattgaatgagacagacacgaccatcacagtgatgctgaaacccgctcagtcccggggagctcctgtcagtgtttatcagctggttgtcaaggaggagcgacttcagaagtcacggagggcagctgacattattgagtgcttttcggtgcccgtgagctatcggaatgcctccagcctcgattctctacactactttgctgctgagttgaagcctgccaacctgcctgtcacccagccatttacagtgggtgacaataagacatacaatggctactggaaccctcctctctctcccctgaaaagctacagcatctacttccaggcactcagcaaagccaatggagagaccaaaatcaactgtgttcgtctggctacaaaagcaccaatgggcagcgcccaggtgaccccggggactccactctgcctcctcaccacaggtgcctccacccagaattctaacactgtggagccagagaagcaggtggacaacaccgtgaagatggctggcgtgatcgctggcctcctcatgttcatcatcattctcctgggcgtgatgctcaccatcaaaaggagaagaaatgcttattcctactcctattacttgtcccaaaggaagctggccaagaagcagaaggagacccagagtggagcccagagggagatggggcctgtggcctctgccgacaaacccaccaccaagctcagcgccagccgcaatgatgaaggcttctcttctagttctcaggacgtcaacggattcacagatggcagccgcggggagctttcccagcccaccctcacgatccagactcatccctaccgcacctgtgaccctgtggagatgagctacccccgggaccagttccaacccgccatccgggtggctgacttgctgcagcacatcacgcagatgaagagaggccagggctacgggttcaaggaggaatacgaggccttaccagaggggcagacagcttcgtgggacacagccaaggaggatgaaaaccgcaataagaatcgatatgggaacatcatatcctacgaccattcccgggtgaggctgctggtgctggatggagacccgcactctgactacatcaatgccaactacattgacggataccatcgacctcggcactacattgcgactcaaggtccgatgcaggagactgtaaaggacttttggagaatgatctggcaggagaactccgccagcatcgtcatggtcacaaacctggtggaagtgggcagggtgaaatgtgtgcgatactggccagatgacacggaggtctacggagacattaaagtcaccctgattgaaacagagcccctggcagaatacgtcatacgcaccttcacagtccagaagaaaggctaccatgagatccgggagctccgcctcttccacttcaccagctggcctgaccacggcgttccctgctatgccactggccttctgggcttcgtccgccaggtcaagttcctcaaccccccggaagctgggcccatagtggtccactgcagtgctggggctgggcggactggctgcttcattgccattgacaccatgcttgacatggccgagaatgaaggggtggtggacatcttcaactgcgtgcgtgagctccgggcccaaagggtcaacctggtacagacagaggagcaatatgtgtttgtgcacgatgccatcctggaagcgtgcctctgtggcaacactgccatccctgtgtgtgagttccgttctctctactacaatatcagcaggctggacccccagacaaactccagccaaatcaaagatgaatttcagaccctcaacattgtgacaccccgtgtgcggcccgaggactgcagcattgggctcctgccccggaaccatgataagaatcgaagtatggacgtgctgcctctggaccgctgcctgcccttccttatctcagtggacggagaatccagcaattacatcaacgcagcactgatggatagccacaagcagcctgccgccttcgtggtcacccagcaccctctacccaacaccgtggcagacttctggaggctggtgttcgattacaactgctcctctgtggtgatgctgaatgagatggacactgcccagttctgtatgcagtactggcctgagaagacctccgggtgctatgggcccatccaggtggagttcgtctccgcagacatcgacgaggacatcatccacagaatattccgcatctgtaacatggcccggccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggaacagtataaatttgtatacgaggtggcactggaatatttaagctccttttagctcaatgggatggggaacctgccggagtccagaggctgctgtgaccaagcccccttttgtgtgaatggcagtaactgggctcaggagctctgaggtggcaccctgcctgactccaaggagaagactggtggccctgtgttccacggggggctctgcaccttctgaggggtctcctgttgccgtgggagatgctgctccaaaaggcccaggcttccttttcaacctaaccagccacagccaagggcccaagcagaagtacacccacaagcaaggccttggatttctggctcccagaccacctgcttttgttctgagtttgtggatctcttggcaagccaactgtgcaggtgctggggagtgggaggctcccctgccctccttctccttaggagtggaggagatgtgtgttctgctcctctacgtcatggaaaagattgaggctcttgggggtcactgctctgctgccccctgcaacctccttcaggggcctctggcaccagacatttgcagtctggaccagtgtgaccttacgatgttccctaggccacaagagaggccccccatcctcacacctaacctgcatggggcttcgcccacaaccattctgtaccccttccccagcctgggccttgaccgtccagcattcactggccggccagctgtgtccacagcagtttttgataaaggtgttctttgcttttttgtgtggtcagtgggagggggtggaactgcagggaacttctctgctcctccttgtctttgtaaaaagggaccacctccctggggcagggcttgggctgacctgtaggatgtaacccctgtgtttctttggtggtagctttctttggaagagacaaacaagataagatttgattattttccaaagtgtatgtgaaaagaaactttcttttggagggtgtaaaatcttagtctcttatgtcaaaaagaagggggcgggggagtttgagtatgtacctctaagacaaatctctcgggccttttattttttcctggcaatgtccttaaaagctcccaccctgggacagcatgccactgagcaaggagagatgggtgagcctgaagatggtccctttggtttctggggcaaatagagcaccagctttgtgcataatttggatgtccaaatttgaactccttcctaaagaaacccagcagccaccttgaaaaaggccattgtggagcccattatactttgatttaaaataggccaagagaatcaggcctggagatctagggtcttgtccaaagtgtgagtgagtcaatgagagggaaccaacatttgctaagtctctactgtatgccagggatcatgcttggcactttccataggacatttcacacagtccttagaacccccaggagagagctactgacttgttatcatctccatttgatcatctcctccaatgaggaaacccacgcaccttccttagtaatgaaatcctgggttccaaaggggcaggtaatggcaatgagacttctccgtgctgttttcttcatcttctctaagccaagcaattattttatggagggaaaataaggccagaaacttctgagcagataactccacaaatggaaatttagtactttcttcctgatgccagttcttctgggaagcgcagaatttcagatatattttagtaacacattcccagctccccaggaaagccagtctcatctaatttcttagtcagtaaaaacaattccctgttccttcaggctatgaatggaccagccagggaaactctcgaccttgatctctagccagtgcttaggcccaatatctgacagcctcaggtgggctgggacctaggaagctccatcttgaaggctggtctagccccagacagggcatgaggggcagagaattcaagaaggtacagctttggccctcaagagcccactgtatgctggggaaatggaaccatggtgcagtagtgtggagtggatgagtgttccatgagcctaggagcaagaaagtctcttcggcctcgggcttcctggagaaggggacgtccattcctgctgggtcttaacaagcataaaaaggaaaaaaaggaaactcaggcaaagggatccatatgtgcaatggcaaagaaatgtgaaaaggcattgggagaagcagtctgggggaggccagcccagtgcgggcacagcacaacacggggagcagcaagagatgagccagggtccaggagacagatgcccatcgcgagtacagactttgtcctattggcaacaaggagtccatggagctttagagagatgcactcagcttcgtgttggccaagactccttctgggccaatggggctgcctcttttcctttcatcagacactgtgaaaacattcccttaagcgtgcactttttaatatcacatctatttgtctgtctgctcattgttttgttgctggaactaaatatgcaatggatcatgagactcagattctatgagaaacccagggtctctgctttaccacggagcagggtcaccaacccagatctccaggcccatgaggatggaacatgaaaggagccgacaaaagttgcttccattggcatgggctctggagctgtccagaagtccagggacaccagacttgatcaaggaagggctgtcactttagaggttcaaaaggaagtgcctcaaagcaaaggcaagcaaaggaaccccacgatgaacttgctcttttcctttgatgagcctctccccaggtgtatttcagcagaccccggggacccacccccactgggcctgctggcctccctcggctccagcccaatgccccagctggccttccccagcctgcaaggagcctgtagcatggcaaatctgcctgctgtatgctattttcttagatcttggtacatccagacaggatgagggtggagggagagctatttaacacaaatcctaagatttttttctgctcaggaaggggtgaaatagctggcagatacaaaagacagtggcttttatcattttaaatggtaggaatttaaggtgtgacttcagggagaaacaaacttgcaaaaaaaaaaaatctcaggccatgttggggtaacccagcaagggccagtgatgatttcccccagctcatccccttattttcccacaacccaaccattctctaaagcaggacagtgaataggtcttaggccagtgcacacaggaagaaattgaggcttatggatggggatgacttccctaagatcccatgggacaaggatgtggcaaggcttggatgagatggggcaccagtgcccaggaatttgaacattttcctttacccaggaaatctccggagccaacaccaccacccccagggggtctccccaccccaccccatttacagggtgagctcagcctgtcatgagcagaggaaaatattattaatgctctctgagtctttacaacaggagctcttacctcatagatgtgggctctgtttggggaagatgcaaggaagtaatgagaagcccaggaaatttctccacctgtgtttatggcctaaatagcttcaggatgtatcttagctgcactccaacattgcatcctttctggggtgaagaatctgggccaaccaggggtccttgggcctctagaaggccacagtaggcctctctttgtgggaatggaaggggacagtttgcttttagtgctggccctctctgtgggtgtggcctgcaaaggaaccaacagaccctatgctggggactctaacatgtgagctcattaaattcttccagcattctaaaggagggtttgtgattgtcaccatttactgatgaggaaactaaggctcctaggggagaaatcacttgcccacagttccacagctagtgagtgaatgaaccaggatttaaaccggttttttctcactacagagacaatatttttccaccattgtatctcacatttttcccaggaggttacccataacagaagagactagagtggaacagatacgtcagtggataaagctcaaagcaaacaacagtaagcttaaaattccttcatagtctcatgttttacgttcacaattcatgcaaaatttgcattccactttctgatttagccttgttggttttaatatgactctatgaatatttcaaaaaaaaatgtgctctgttcctcatgttgttctgttctgttcaccccgctatgacggaccctaggtcagctggtcttcagcttgaccctagaattgactctaggagcagtgaccctgctgcctcccagagccagttataggctcaagatcaagaccaactgaccttctcctaggcagctcctttggtgtgtgggtgctctgacctcactgttcatgaggggacctcaactaaggcatcttccagttgggtgctggaaggaacccattaactcacactagaatgatgaggatttgctcatctggcgtggagaaggatgagcccacaaaaccctaaagggaaaagagaagctggacacagctgtactcagcagattcctgaatgctaggctggaaagtggtgcctgttgtccaagtggagtcacatggttgctaatgtgggcaagtctgaggacacacttcatgagcagctggggtctggaaggctcctcactttaccctagccacacataattactgggtgcctacagcacctagcaccttggagggggcactattaggaaatcgagattactatggcacaattaattcctgggtaaggcatggggttgtggtggacagagctcagtctttagtttgaacgaaaacatacatacatgaaaaacatacatgaaaaaaggaccctcatcaacattagaaggggtagatttggagcactttaggcaggaaaacaggaacgcaaggccaggaaactggaacccagtgaatactcagaaccgaggatgcagatgacttatttagcaaaatggtcacttctgtgacatagctggagaaaggatgggtaacagcttgccagagccacttggaacaagggcaaatctcagtgtctggggcaaaagatgatgcatttccctctgacccatcatgtttattcatcctccactccccattgccacactagctcttgctgtaagtcctcaccaggatctacatttcctcgtcgctggtgggaaccccttagagtacatagaggtatcagtccagtaagactgctctacacaacagaagtgaggcccagggagtagcagccaggcccttatcctgttacctctgcaggagtgactgcccaacccagatccagagacattgaaggaaatgataattccttggtacctcactgccttgggacaaaatgaagaaagccacccttccttaggctgcagcttgccactcctgggctgggtaaacaggtcatcagcaccaagctcaaccaggagtaacactctggaagacatgggtgagcccaagaggaagcatgaacaggacgctgttcctaagtcatgtcaacaggttgtgctgggccaggatccccagggaaaaaaatggtcaacccaactggagggtaggttagaagaaaaaaaacataaacgtggatagtcatgtcatctcaaatccctgacttggcttccccattacttaacagtctgagctccttcttagcctgtgaccagcttcaaatcacagccaagtaaaacaaggaaataggaaaagtaaatccaactagaagagacaagctgagattcagatttgtttactcctcccatgcaaagtttccctgttggaggttttccatgtatacatgtctagaagtgatagaatgcaaggccttggctttgtcttgcagggatctgcctttgaggtcatagactgaacagcagggagagaggttagtggtggagtgtggggggagctgttctagctccagtttcttctgacacatttttcaggatcatggatctgatcctccgaagcacagcagagatatctaagccatatttgtgcacatgagcagactcttctagttttttagtaaccagggatgggcttttgcatggcactgactatagagatgtcttgtagagatcaagccagtcttttgcatcccacctgcccacctccagaagagatgggaaaaggtcatcaaagggcattcaccaactgaaatccactcatgaatgttaggtctctaaaaggaggcatcaacactcacaatggtagcctccaaacctagcatcccacctatctaagagctcaggggtggtccactggggcagatacaagggaagtgcaagggctcaggatgaaagaaaatctattgggaagagttttaggggcttgatcattatggggcttccttctatatctgagaactgctctgggtggtgagatgtggactctgatccttaattggaatgttcggagaatgagtgtctggtggccttgaagtgttggacagaaaagtatcagtataaaagcctggagctcagggtaattaatgtagttcatggttccttagtgagcaggactcttggatgtggaggagaaagggtcataggaagtaaaccaccaaaattacaaaattgagtctctgtacaattacttcagtgcctttgggcttatgaatacaaatcagtgggccttctctatgatggtccaacaaactctcagtgtccaccctgtccctgtatctcccatggaagatgaataatgtcaggtgttctttgggtcaaaggccccagggcagtctggaggcttagagggcagagtggtgtcattccatgtaaagttaggcttctgaggggtcaggcagaatatggtgtccatatcttccatagctctgcagattcttggatgaagtcaagcacagtttgctagacccaggtcactcctctgagtataactaggacccatgagtgaaacttaatagctgtaaggaagaacctgctgtctgccagagaggataagctgcccatctcagcagctgtctaaaagaaggcaggtgtctctttaaagggaagagaagcattggtgaaatggatttcaggtcacttccattccagatgggtgagatcttgtggagctgggatcatgtttgaactcattcatacctgtagagcacgaatccaagtagattgtgtttggtctgtacaggctgaagccccctgctctcccacccaagtgcccccactgagcaggccaacatgctgttgtggccacatatactgggctgatccaggctggttatcaccaaacagcaaaccatagggaacagctgctttgccatagacccaatacccatgtagatctctcatgagagcagccataactcagacccactgaccaacagggccatgagtgacagccagaaccagtgaaggtccaagtaggacacagagcagggcttttcttaccatacacattatctccagaggttatttctaccccactccctattcaaggcctgttggagcacactgcaaaagcaaaagcacagtaactcaatttacacatgattataatcatttccagtgcacacatttcatcaccaggtggatcctgagctagcccatgtaaatccgggttaacccatattggtaatcatactcaaaagcacttttcaccctacattctactagccaatcaaagacaaagagttgtggcctctaccattgccttggcttctggacaccctcacaagctatcccaaggttcccgctcaactccagggaggctgacatcttcacatccactgggcatataatattgcatgagaccaaagtctccacactctttgcagcctcctccatgaatcccaatggcctgcacttgtacagtttgggtgtttgatagataaagcacgtatgagaagagaaaacaaaataaatcaactttttaaaaaagccagcactgtgctgtcaatgttttttttttcttttcaattctagctcagaaaagcagaaggtaaataatgtcaggtcaatgaatatcagatatattttttgactgtacattacagtgaagtgtaatctttttacacctgcaagtccatcttatttattcttgtaaatgttccctgacaatgtttgtaacatggctgtgttaaaaaatctatacaataaagctgtgaccctg

SEQ ID NO: 17041 - DNA, 4521 bp, Homo sapiens
  ENST00000617474
cctcccgcctcagttcgcgccgcgcctcggcttggaacgcaggagcgccggctccgggagcccgagcggagccagccgcgcgcacagccagcggccgcgccggcgatgcggggccaccccgcgcccgccccagtcccggccccggcccccgcgggaaggggctgagctgcccgccgccgcccggatggcgagcctcgccgcgctcgccctcagcctgctcctgaggctgcagctgccgccactgcccggcgcccgggctcagagcgccgcaggtgtggctgttcctttgatgagcactacagcaactgtggttatagtgtggctctagggaccaatgggttcacctgggagcagattaacacatgggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccagggcctcccctcaccaccaggaccaagtgtgcagatccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgttccaggagctgttcctctagaatccatccaaggggggccctttgaggagaagatctacatccagtggaaacctcccaatgagaccaatggggtcatcacgctctacgagatcaactacaaggctgtcggctcgctggacccaagtgctgacctctcgagccagagggggaaagtgttcaagctccggaatgaaacccaccacctctttgtgggtctgtacccagggaccacctattccttcaccatcaaggccagcacagcaaagggctttgggccccctgtcaccactcggattgccaccaaaatttcagctccatccatgcctgagtacgacacagacaccccattgaatgagacagacacgaccatcacagtgatgctgaaacccgctcagtcccggggagctcctgtcagtgtttatcagctggttgtcaaggaggagcgacttcagaagtcacggagggcagctgacattattgagtgcttttcggtgcccgtgagctatcggaatgcctccagcctcgattctctacactactttgctgctgagttgaagcctgccaacctgcctgtcacccagccatttacagtgggtgacaataagacatacaatggctactggaaccctcctctctctcccctgaaaagctacagcatctacttccaggcactcagcaaagccaatggagagaccaaaatcaactgtgttcgtctggctacaaaaggtgcctccacccagaattctaacactgtggagccagagaagcaggtggacaacaccgtgaagatggctggcgtgatcgctggcctcctcatgttcatcatcattctcctgggcgtgatgctcaccatcaaaaggagaagaaatgcttattcctactcctattacttgtcccaaaggaagctggccaagaagcagaaggagacccagagtggagcccagagggagatggggcctgtggcctctgccgacaaacccaccaccaagctcagcgccagccgcaatgatgaaggcttctcttctagttctcaggacgtcaacggattcacagatggcagccgcggggagctttcccagcccaccctcacgatccagactcatccctaccgcacctgtgaccctgtggagatgagctacccccgggaccagttccaacccgccatccgggtggctgacttgctgcagcacatcacgcagatgaagagaggccagggctacgggttcaaggaggaatacgaggccttaccagaggggcagacagcttcgtgggacacagccaaggaggatgaaaaccgcaataagaatcgatatgggaacatcatatcctacgaccattcccgggtgaggctgctggtgctggatggagacccgcactctgactacatcaatgccaactacattgacggataccatcgacctcggcactacattgcgactcaaggtccgatgcaggagactgtaaaggacttttggagaatgatctggcaggagaactccgccagcatcgtcatggtcacaaacctggtggaagtgggcagggtgaaatgtgtgcgatactggccagatgacacggaggtctacggagacattaaagtcaccctgattgaaacagagcccctggcagaatacgtcatacgcaccttcacagtccagaagaaaggctaccatgagatccgggagctccgcctcttccacttcaccagctggcctgaccacggcgttccctgctatgccactggccttctgggcttcgtccgccaggtcaagttcctcaaccccccggaagctgggcccatagtggtccactgcagtgctggggctgggcggactggctgcttcattgccattgacaccatgcttgacatggccgagaatgaaggggtggtggacatcttcaactgcgtgcgtgagctccgggcccaaagggtcaacctggtacagacagaggagcaatatgtgtttgtgcacgatgccatcctggaagcgtgcctctgtggcaacactgccatccctgtgtgtgagttccgttctctctactacaatatcagcaggctggacccccagacaaactccagccaaatcaaagatgaatttcagaccctcaacattgtgacaccccgtgtgcggcccgaggactgcagcattgggctcctgccccggaaccatgataagaatcgaagtatggacgtgctgcctctggaccgctgcctgcccttccttatctcagtggacggagaatccagcaattacatcaacgcagcactgatggatagccacaagcagcctgccgccttcgtggtcacccagcaccctctacccaacaccgtggcagacttctggaggctggtgttcgattacaactgctcctctgtggtgatgctgaatgagatggacactgcccagttctgtatgcagtactggcctgagaagacctccgggtgctatgggcccatccaggtggagttcgtctccgcagacatcgacgaggacatcatccacagaatattccgcatctgtaacatggcccggccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggaacagtataaatttgtatacgaggtggcactggaatatttaagctccttttag

SEQ ID NO: 17042 - DNA, 208 bp, Homo sapiens
  ENST00000485499
aggagggactgagggaacacagaggaaagagggatttctacaaaaatagacatagaaataaccgataagtttatgaaatattaccagcctcgttaaacatcaggcatgctaattaaggtggctgttcctttgatgagcactacagcaactgtggttatagtgtggctctagggaccaatgggttcacctgggagcagattaacacatg

SEQ ID NO: 17043 - DNA, 940 bp, Homo sapiens
  ENST00000620410
ggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccagggcctcccctcaccaccaggaccaagtgtgcag

SEQ ID NO: 17044 - DNA, 3230 bp, Homo sapiens
  ENST00000618610
atccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgttccaggagctgttcctctagaatccatccaaggggggccctttgaggagaagatctacatccagtggaaacctcccaatgagaccaatggggtcatcacgctctacgagatcaactacaaggctgtcggctcgctggacccaagtgctgacctctcgagccagagggggaaagtgttcaagctccggaatgaaacccaccacctctttgtgggtctgtacccagggaccacctattccttcaccatcaaggccagcacagcaaagggctttgggccccctgtcaccactcggattgccaccaaaatttcagctccatccatgcctgagtacgacacagacaccccattgaatgagacagacacgaccatcacagtgatgctgaaacccgctcagtcccggggagctcctgtcagtgtttatcagctggttgtcaaggaggagcgacttcagaagtcacggagggcagctgacattattgagtgcttttcggtgcccgtgagctatcggaatgcctccagcctcgattctctacactactttgctgctgagttgaagcctgccaacctgcctgtcacccagccatttacagtgggtgacaataagacatacaatggctactggaaccctcctctctctcccctgaaaagctacagcatctacttccaggcactcagcaaagccaatggagagaccaaaatcaactgtgttcgtctggctacaaaagcaccaatgggcagcgcccaggtgaccccggggactccactctgcctcctcaccacaggtgcctccacccagaattctaacactgtggagccagagaagcaggtggacaacaccgtgaagatggctggcgtgatcgctggcctcctcatgttcatcatcattctcctgggcgtgatgctcaccatcaaaaggagaagaaatgcttattcctactcctattacttgaagctggccaagaagcagaaggagacccagagtggagcccagagggagatggggcctgtggcctctgccgacaaacccaccaccaagctcagcgccagccgcaatgatgaaggcttctcttctagttctcaggacgtcaacggattcacagatggcagccgcggggagctttcccagcccaccctcacgatccagactcatccctaccgcacctgtgaccctgtggagatgagctacccccgggaccagttccaacccgccatccgggtggctgacttgctgcagcacatcacgcagatgaagagaggccagggctacgggttcaaggaggaatacgaggccttaccagaggggcagacagcttcgtgggacacagccaaggaggatgaaaaccgcaataagaatcgatatgggaacatcatatcctacgaccattcccgggtgaggctgctggtgctggatggagacccgcactctgactacatcaatgccaactacattgacggataccatcgacctcggcactacattgcgactcaaggtccgatgcaggagactgtaaaggacttttggagaatgatctggcaggagaactccgccagcatcgtcatggtcacaaacctggtggaagtgggcagggtgaaatgtgtgcgatactggccagatgacacggaggtctacggagacattaaagtcaccctgattgaaacagagcccctggcagaatacgtcatacgcaccttcacagtccagaagaaaggctaccatgagatccgggagctccgcctcttccacttcaccagctggcctgaccacggcgttccctgctatgccactggccttctgggcttcgtccgccaggtcaagttcctcaaccccccggaagctgggcccatagtggtccactgcagtgctggggctgggcggactggctgcttcattgccattgacaccatgcttgacatggccgagaatgaaggggtggtggacatcttcaactgcgtgcgtgagctccgggcccaaagggtcaacctggtacagacagaggagcaatatgtgtttgtgcacgatgccatcctggaagcgtgcctctgtggcaacactgccatccctgtgtgtgagttccgttctctctactacaatatcagcaggctggacccccagacaaactccagccaaatcaaagatgaatttcagaccctcaacattgtgacaccccgtgtgcggcccgaggactgcagcattgggctcctgccccggaaccatgataagaatcgaagtatggacgtgctgcctctggaccgctgcctgcccttccttatctcagtggacggagaatccagcaattacatcaacgcagcactgatggatagccacaagcagcctgccgccttcgtggtcacccagcaccctctacccaacaccgtggcagacttctggaggctggtgttcgattacaactgctcctctgtggtgatgctgaatgagatggacactgcccagttctgtatgcagtactggcctgagaagacctccgggtgctatgggcccatccaggtggagttcgtctccgcagacatcgacgaggacatcatccacagaatattccgcatctgtaacatggcccggccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggaacagtataaatttgtatacgaggtggcactggaatatttaagctccttttag

SEQ ID NO: 17045 - DNA, 11285 bp, Homo sapiens
  ENST00000612229
tttgcagatccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgttccaggagctgttcctctagaatccatccaaggggggccctttgaggagaagatctacatccagtggaaacctcccaatgagaccaatggggtcatcacgctctacgagatcaactacaaggctgtcggctcgctggacccaagtgctgacctctcgagccagagggggaaagtgttcaagctccggaatgaaacccaccacctctttgtgggtctgtacccagggaccacctattccttcaccatcaaggccagcacagcaaagggctttgggccccctgtcaccactcggattgccaccaaaatttcagctccatccatgcctgagtacgacacagacaccccattgaatgagacagacacgaccatcacagtgatgctgaaacccgctcagtcccggggagctcctgtcagtgtttatcagctggttgtcaaggaggagcgacttcagaagtcacggagggcagctgacattattgagtgcttttcggtgcccgtgagctatcggaatgcctccagcctcgattctctacactactttgctgctgagttgaagcctgccaacctgcctgtcacccagccatttacagtgggtgacaataagacatacaatggctactggaaccctcctctctctcccctgaaaagctacagcatctacttccaggcactcagcaaagccaatggagagaccaaaatcaactgtgttcgtctggctacaaaaggtgcctccacccagaattctaacactgtggagccagagaagcaggtggacaacaccgtgaagatggctggcgtgatcgctggcctcctcatgttcatcatcattctcctgggcgtgatgctcaccatcaaaaggagaagaaatgcttattcctactcctattacttgaagctggccaagaagcagaaggagacccagagtggagcccagagggagatggggcctgtggcctctgccgacaaacccaccaccaagctcagcgccagccgcaatgatgaaggcttctcttctagttctcaggacgtcaacggattcacagatggcagccgcggggagctttcccagcccaccctcacgatccagactcatccctaccgcacctgtgaccctgtggagatgagctacccccgggaccagttccaacccgccatccgggtggctgacttgctgcagcacatcacgcagatgaagagaggccagggctacgggttcaaggaggaatacgaggccttaccagaggggcagacagcttcgtgggacacagccaaggaggatgaaaaccgcaataagaatcgatatgggaacatcatatcctacgaccattcccgggtgaggctgctggtgctggatggagacccgcactctgactacatcaatgccaactacattgacggataccatcgacctcggcactacattgcgactcaaggtccgatgcaggagactgtaaaggacttttggagaatgatctggcaggagaactccgccagcatcgtcatggtcacaaacctggtggaagtgggcagggtgaaatgtgtgcgatactggccagatgacacggaggtctacggagacattaaagtcaccctgattgaaacagagcccctggcagaatacgtcatacgcaccttcacagtccagaagaaaggctaccatgagatccgggagctccgcctcttccacttcaccagctggcctgaccacggcgttccctgctatgccactggccttctgggcttcgtccgccaggtcaagttcctcaaccccccggaagctgggcccatagtggtccactgcagtgctggggctgggcggactggctgcttcattgccattgacaccatgcttgacatggccgagaatgaaggggtggtggacatcttcaactgcgtgcgtgagctccgggcccaaagggtcaacctggtacagacagaggagcaatatgtgtttgtgcacgatgccatcctggaagcgtgcctctgtggcaacactgccatccctgtgtgtgagttccgttctctctactacaatatcagcaggctggacccccagacaaactccagccaaatcaaagatgaatttcagaccctcaacattgtgacaccccgtgtgcggcccgaggactgcagcattgggctcctgccccggaaccatgataagaatcgaagtatggacgtgctgcctctggaccgctgcctgcccttccttatctcagtggacggagaatccagcaattacatcaacgcagcactgatggatagccacaagcagcctgccgccttcgtggtcacccagcaccctctacccaacaccgtggcagacttctggaggctggtgttcgattacaactgctcctctgtggtgatgctgaatgagatggacactgcccagttctgtatgcagtactggcctgagaagacctccgggtgctatgggcccatccaggtggagttcgtctccgcagacatcgacgaggacatcatccacagaatattccgcatctgtaacatggcccggccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggaacagtataaatttgtatacgaggtggcactggaatatttaagctccttttagctcaatgggatggggaacctgccggagtccagaggctgctgtgaccaagcccccttttgtgtgaatggcagtaactgggctcaggagctctgaggtggcaccctgcctgactccaaggagaagactggtggccctgtgttccacggggggctctgcaccttctgaggggtctcctgttgccgtgggagatgctgctccaaaaggcccaggcttccttttcaacctaaccagccacagccaagggcccaagcagaagtacacccacaagcaaggccttggatttctggctcccagaccacctgcttttgttctgagtttgtggatctcttggcaagccaactgtgcaggtgctggggagtgggaggctcccctgccctccttctccttaggagtggaggagatgtgtgttctgctcctctacgtcatggaaaagattgaggctcttgggggtcactgctctgctgccccctgcaacctccttcaggggcctctggcaccagacatttgcagtctggaccagtgtgaccttacgatgttccctaggccacaagagaggccccccatcctcacacctaacctgcatggggcttcgcccacaaccattctgtaccccttccccagcctgggccttgaccgtccagcattcactggccggccagctgtgtccacagcagtttttgataaaggtgttctttgcttttttgtgtggtcagtgggagggggtggaactgcagggaacttctctgctcctccttgtctttgtaaaaagggaccacctccctggggcagggcttgggctgacctgtaggatgtaacccctgtgtttctttggtggtagctttctttggaagagacaaacaagataagatttgattattttccaaagtgtatgtgaaaagaaactttcttttggagggtgtaaaatcttagtctcttatgtcaaaaagaagggggcgggggagtttgagtatgtacctctaagacaaatctctcgggccttttattttttcctggcaatgtccttaaaagctcccaccctgggacagcatgccactgagcaaggagagatgggtgagcctgaagatggtccctttggtttctggggcaaatagagcaccagctttgtgcataatttggatgtccaaatttgaactccttcctaaagaaacccagcagccaccttgaaaaaggccattgtggagcccattatactttgatttaaaataggccaagagaatcaggcctggagatctagggtcttgtccaaagtgtgagtgagtcaatgagagggaaccaacatttgctaagtctctactgtatgccagggatcatgcttggcactttccataggacatttcacacagtccttagaacccccaggagagagctactgacttgttatcatctccatttgatcatctcctccaatgaggaaacccacgcaccttccttagtaatgaaatcctgggttccaaaggggcaggtaatggcaatgagacttctccgtgctgttttcttcatcttctctaagccaagcaattattttatggagggaaaataaggccagaaacttctgagcagataactccacaaatggaaatttagtactttcttcctgatgccagttcttctgggaagcgcagaatttcagatatattttagtaacacattcccagctccccaggaaagccagtctcatctaatttcttagtcagtaaaaacaattccctgttccttcaggctatgaatggaccagccagggaaactctcgaccttgatctctagccagtgcttaggcccaatatctgacagcctcaggtgggctgggacctaggaagctccatcttgaaggctggtctagccccagacagggcatgaggggcagagaattcaagaaggtacagctttggccctcaagagcccactgtatgctggggaaatggaaccatggtgcagtagtgtggagtggatgagtgttccatgagcctaggagcaagaaagtctcttcggcctcgggcttcctggagaaggggacgtccattcctgctgggtcttaacaagcataaaaaggaaaaaaaggaaactcaggcaaagggatccatatgtgcaatggcaaagaaatgtgaaaaggcattgggagaagcagtctgggggaggccagcccagtgcgggcacagcacaacacggggagcagcaagagatgagccagggtccaggagacagatgcccatcgcgagtacagactttgtcctattggcaacaaggagtccatggagctttagagagatgcactcagcttcgtgttggccaagactccttctgggccaatggggctgcctcttttcctttcatcagacactgtgaaaacattcccttaagcgtgcactttttaatatcacatctatttgtctgtctgctcattgttttgttgctggaactaaatatgcaatggatcatgagactcagattctatgagaaacccagggtctctgctttaccacggagcagggtcaccaacccagatctccaggcccatgaggatggaacatgaaaggagccgacaaaagttgcttccattggcatgggctctggagctgtccagaagtccagggacaccagacttgatcaaggaagggctgtcactttagaggttcaaaaggaagtgcctcaaagcaaaggcaagcaaaggaaccccacgatgaacttgctcttttcctttgatgagcctctccccaggtgtatttcagcagaccccggggacccacccccactgggcctgctggcctccctcggctccagcccaatgccccagctggccttccccagcctgcaaggagcctgtagcatggcaaatctgcctgctgtatgctattttcttagatcttggtacatccagacaggatgagggtggagggagagctatttaacacaaatcctaagatttttttctgctcaggaaggggtgaaatagctggcagatacaaaagacagtggcttttatcattttaaatggtaggaatttaaggtgtgacttcagggagaaacaaacttgcaaaaaaaaaaaatctcaggccatgttggggtaacccagcaagggccagtgatgatttcccccagctcatccccttattttcccacaacccaaccattctctaaagcaggacagtgaataggtcttaggccagtgcacacaggaagaaattgaggcttatggatggggatgacttccctaagatcccatgggacaaggatgtggcaaggcttggatgagatggggcaccagtgcccaggaatttgaacattttcctttacccaggaaatctccggagccaacaccaccacccccagggggtctccccaccccaccccatttacagggtgagctcagcctgtcatgagcagaggaaaatattattaatgctctctgagtctttacaacaggagctcttacctcatagatgtgggctctgtttggggaagatgcaaggaagtaatgagaagcccaggaaatttctccacctgtgtttatggcctaaatagcttcaggatgtatcttagctgcactccaacattgcatcctttctggggtgaagaatctgggccaaccaggggtccttgggcctctagaaggccacagtaggcctctctttgtgggaatggaaggggacagtttgcttttagtgctggccctctctgtgggtgtggcctgcaaaggaaccaacagaccctatgctggggactctaacatgtgagctcattaaattcttccagcattctaaaggagggtttgtgattgtcaccatttactgatgaggaaactaaggctcctaggggagaaatcacttgcccacagttccacagctagtgagtgaatgaaccaggatttaaaccggttttttctcactacagagacaatatttttccaccattgtatctcacatttttcccaggaggttacccataacagaagagactagagtggaacagatacgtcagtggataaagctcaaagcaaacaacagtaagcttaaaattccttcatagtctcatgttttacgttcacaattcatgcaaaatttgcattccactttctgatttagccttgttggttttaatatgactctatgaatatttcaaaaaaaaatgtgctctgttcctcatgttgttctgttctgttcaccccgctatgacggaccctaggtcagctggtcttcagcttgaccctagaattgactctaggagcagtgaccctgctgcctcccagagccagttataggctcaagatcaagaccaactgaccttctcctaggcagctcctttggtgtgtgggtgctctgacctcactgttcatgaggggacctcaactaaggcatcttccagttgggtgctggaaggaacccattaactcacactagaatgatgaggatttgctcatctggcgtggagaaggatgagcccacaaaaccctaaagggaaaagagaagctggacacagctgtactcagcagattcctgaatgctaggctggaaagtggtgcctgttgtccaagtggagtcacatggttgctaatgtgggcaagtctgaggacacacttcatgagcagctggggtctggaaggctcctcactttaccctagccacacataattactgggtgcctacagcacctagcaccttggagggggcactattaggaaatcgagattactatggcacaattaattcctgggtaaggcatggggttgtggtggacagagctcagtctttagtttgaacgaaaacatacatacatgaaaaacatacatgaaaaaaggaccctcatcaacattagaaggggtagatttggagcactttaggcaggaaaacaggaacgcaaggccaggaaactggaacccagtgaatactcagaaccgaggatgcagatgacttatttagcaaaatggtcacttctgtgacatagctggagaaaggatgggtaacagcttgccagagccacttggaacaagggcaaatctcagtgtctggggcaaaagatgatgcatttccctctgacccatcatgtttattcatcctccactccccattgccacactagctcttgctgtaagtcctcaccaggatctacatttcctcgtcgctggtgggaaccccttagagtacatagaggtatcagtccagtaagactgctctacacaacagaagtgaggcccagggagtagcagccaggcccttatcctgttacctctgcaggagtgactgcccaacccagatccagagacattgaaggaaatgataattccttggtacctcactgccttgggacaaaatgaagaaagccacccttccttaggctgcagcttgccactcctgggctgggtaaacaggtcatcagcaccaagctcaaccaggagtaacactctggaagacatgggtgagcccaagaggaagcatgaacaggacgctgttcctaagtcatgtcaacaggttgtgctgggccaggatccccagggaaaaaaatggtcaacccaactggagggtaggttagaagaaaaaaaacataaacgtggatagtcatgtcatctcaaatccctgacttggcttccccattacttaacagtctgagctccttcttagcctgtgaccagcttcaaatcacagccaagtaaaacaaggaaataggaaaagtaaatccaactagaagagacaagctgagattcagatttgtttactcctcccatgcaaagtttccctgttggaggttttccatgtatacatgtctagaagtgatagaatgcaaggccttggctttgtcttgcagggatctgcctttgaggtcatagactgaacagcagggagagaggttagtggtggagtgtggggggagctgttctagctccagtttcttctgacacatttttcaggatcatggatctgatcctccgaagcacagcagagatatctaagccatatttgtgcacatgagcagactcttctagttttttagtaaccagggatgggcttttgcatggcactgactatagagatgtcttgtagagatcaagccagtcttttgcatcccacctgcccacctccagaagagatgggaaaaggtcatcaaagggcattcaccaactgaaatccactcatgaatgttaggtctctaaaaggaggcatcaacactcacaatggtagcctccaaacctagcatcccacctatctaagagctcaggggtggtccactggggcagatacaagggaagtgcaagggctcaggatgaaagaaaatctattgggaagagttttaggggcttgatcattatggggcttccttctatatctgagaactgctctgggtggtgagatgtggactctgatccttaattggaatgttcggagaatgagtgtctggtggccttgaagtgttggacagaaaagtatcagtataaaagcctggagctcagggtaattaatgtagttcatggttccttagtgagcaggactcttggatgtggaggagaaagggtcataggaagtaaaccaccaaaattacaaaattgagtctctgtacaattacttcagtgcctttgggcttatgaatacaaatcagtgggccttctctatgatggtccaacaaactctcagtgtccaccctgtccctgtatctcccatggaagatgaataatgtcaggtgttctttgggtcaaaggccccagggcagtctggaggcttagagggcagagtggtgtcattccatgtaaagttaggcttctgaggggtcaggcagaatatggtgtccatatcttccatagctctgcagattcttggatgaagtcaagcacagtttgctagacccaggtcactcctctgagtataactaggacccatgagtgaaacttaatagctgtaaggaagaacctgctgtctgccagagaggataagctgcccatctcagcagctgtctaaaagaaggcaggtgtctctttaaagggaagagaagcattggtgaaatggatttcaggtcacttccattccagatgggtgagatcttgtggagctgggatcatgtttgaactcattcatacctgtagagcacgaatccaagtagattgtgtttggtctgtacaggctgaagccccctgctctcccacccaagtgcccccactgagcaggccaacatgctgttgtggccacatatactgggctgatccaggctggttatcaccaaacagcaaaccatagggaacagctgctttgccatagacccaatacccatgtagatctctcatgagagcagccataactcagacccactgaccaacagggccatgagtgacagccagaaccagtgaaggtccaagtaggacacagagcagggcttttcttaccatacacattatctccagaggttatttctaccccactccctattcaaggcctgttggagcacactgcaaaagcaaaagcacagtaactcaatttacacatgattataatcatttccagtgcacacatttcatcaccaggtggatcctgagctagcccatgtaaatccgggttaacccatattggtaatcatactcaaaagcacttttcaccctacattctactagccaatcaaagacaaagagttgtggcctctaccattgccttggcttctggacaccctcacaagctatcccaaggttcccgctcaactccagggaggctgacatcttcacatccactgggcatataatattgcatgagaccaaagtctccacactctttgcagcctcctccatgaatcccaatggcctgcacttgtacagtttgggtgtttgatagataaagcacgtatgagaagagaaaacaaaataaatcaactttttaaaaaagccagcactgtgctgtcaatgttttttttttcttttcaattctagctcagaaaagcagaaggtaaataatgtcaggtcaatgaatatcagatatattttttgactgtacattacagtgaagtgtaatctttttacacctgcaagtccatcttatttattcttgtaaatgttccctgacaatgtttgtaacatggctgtgttaaaaaatctatacaataaagctgtgaccctg

SEQ ID NO: 17046 - DNA, 8175 bp, Homo sapiens
  ENST00000393386
aggagccgcggcgcgcacagccgggctggagcgcgcacccggcactgaggcttcgctgctctcggagcgctcagaccgcggccgccgcagccggcgaaagaggcaaagtcccgcacgccggaggacatgcgcctcggctagcggccccgggccccaccaccgtgcggctttctccagattattcctctctcgctgtctctgactgtctctctctgtctctgtctctgtctctctctctctcacacacacacacacacacacaaacacacatacgcacgcacgatctcacttcgatctatacactggaggattaaaacaaacaaacaaaaaaaacatttccttcgctccccctccctctccactctgagaagcagaggagccgcacggcgaggggccgcagaccgtctggaaatgcgaatcctaaagcgtttcctcgcttgcattcagctcctctgtgtttgccgcctggattgggctaatggatactacagacaacagagaaaacttgttgaagagattggctggtcctatacaggagcactgaatcaaaaaaattggggaaagaaatatccaacatgtaatagcccaaaacaatctcctatcaatattgatgaagatcttacacaagtaaatgtgaatcttaagaaacttaaatttcagggttgggataaaacatcattggaaaacacattcattcataacactgggaaaacagtggaaattaatctcactaatgactaccgtgtcagcggaggagtttcagaaatggtgtttaaagcaagcaagataacttttcactggggaaaatgcaatatgtcatctgatggatcagagcatagtttagaaggacaaaaatttccacttgagatgcaaatctactgctttgatgcggaccgattttcaagttttgaggaagcagtcaaaggaaaagggaagttaagagctttatccattttgtttgaggttgggacagaagaaaatttggatttcaaagcgattattgatggagtcgaaagtgttagtcgttttgggaagcaggctgctttagatccattcatactgttgaaccttctgccaaactcaactgacaagtattacatttacaatggctcattgacatctcctccctgcacagacacagttgactggattgtttttaaagatacagttagcatctctgaaagccagttggctgttttttgtgaagttcttacaatgcaacaatctggttatgtcatgctgatggactacttacaaaacaattttcgagagcaacagtacaagttctctagacaggtgttttcctcatacactggaaaggaagagattcatgaagcagtttgtagttcagaaccagaaaatgttcaggctgacccagagaattataccagccttcttgttacatgggaaagacctcgagtcgtttatgataccatgattgagaagtttgcagttttgtaccagcagttggatggagaggaccaaaccaagcatgaatttttgacagatggctatcaagacttgggtgctattctcaataatttgctacccaatatgagttatgttcttcagatagtagccatatgcactaatggcttatatggaaaatacagcgaccaactgattgtcgacatgcctactgataatcctgaacttgatcttttccctgaattaattggaactgaagaaataatcaaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagatctggaaatgccacattattctacctttgcctacttcccaactgaggtaacacctcatgcttttaccccatcctccagacaacaggatttggtctccacggtcaacgtggtatactcgcagacaacccaaccggtatacaatggtgagacacctcttcaaccttcctacagtagtgaagtctttcctctagtcacccctttgttgcttgacaatcagatcctcaacactacccctgctgcttcaagtagtgattcggccttgcatgctacgcctgtatttcccagtgtcgatgtgtcatttgaatccatcctgtcttcctatgatggtgcacctttgcttccattttcctctgcttccttcagtagtgaattgtttcgccatctgcatacagtttctcaaatccttccacaagttacttcagctaccgagagtgataaggtgcccttgcatgcttctctgccagtggctgggggtgatttgctattagagcccagccttgctcagtattctgatgtgctgtccactactcatgctgcttcagagacgctggaatttggtagtgaatctggtgttctttataaaacgcttatgttttctcaagttgaaccacccagcagtgatgccatgatgcatgcacgttcttcagggcctgaaccttcttatgccttgtctgataatgagggctcccaacacatcttcactgtttcttacagttctgcaatacctgtgcatgattctgtgggtgtaacttatcagggttccttatttagcggccctagccatataccaatacctaagtcttcgttaataaccccaactgcatcattactgcagcctactcatgccctctctggtgatggggaatggtctggagcctcttctgatagtgaatttcttttacctgacacagatgggctgacagcccttaacatttcttcacctgtttctgtagctgaatttacatatacaacatctgtgtttggtgatgataataaggcgctttctaaaagtgaaataatatatggaaatgagactgaactgcaaattccttctttcaatgagatggtttacccttctgaaagcacagtcatgcccaacatgtatgataatgtaaataagttgaatgcgtctttacaagaaacctctgtttccatttctagcaccaagggcatgtttccagggtcccttgctcataccaccactaaggtttttgatcatgagattagtcaagttccagaaaataacttttcagttcaacctacacatactgtctctcaagcatctggtgacacttcgcttaaacctgtgcttagtgcaaactcagagccagcatcctctgaccctgcttctagtgaaatgttatctccttcaactcagctcttattttatgagacctcagcttcttttagtactgaagtattgctacaaccttcctttcaggcttctgatgttgacaccttgcttaaaactgttcttccagctgtgcccagtgatccaatattggttgaaacccccaaagttgataaaattagttctacaatgttgcatctcattgtatcaaattctgcttcaagtgaaaacatgctgcactctacatctgtaccagtttttgatgtgtcgcctacttctcatatgcactctgcttcacttcaaggtttgaccatttcctatgcaagtgagaaatatgaaccagttttgttaaaaagtgaaagttcccaccaagtggtaccttctttgtacagtaatgatgagttgttccaaacggccaatttggagattaaccaggcccatcccccaaaaggaaggcatgtatttgctacacctgttttatcaattgatgaaccattaaatacactaataaataagcttatacattccgatgaaattttaacctccaccaaaagttctgttactggtaaggtatttgctggtattccaacagttgcttctgatacatttgtatctactgatcattctgttcctataggaaatgggcatgttgccattacagctgtttctccccacagagatggttctgtaacctcaacaaagttgctgtttccttctaaggcaacttctgagctgagtcatagtgccaaatctgatgccggtttagtgggtggtggtgaagatggtgacactgatgatgatggtgatgatgatgatgatgacagaggtagtgatggcttatccattcataagtgtatgtcatgctcatcctatagagaatcacaggaaaaggtaatgaatgattcagacacccacgaaaacagtcttatggatcagaataatccaatctcatactcactatctgagaattctgaagaagataatagagtcacaagtgtatcctcagacagtcaaactggtatggacagaagtcctggtaaatcaccatcagcaaatgggctatcccaaaagcacaatgatggaaaagaggaaaatgacattcagactggtagtgctctgcttcctctcagccctgaatctaaagcatgggcagttctgacaagtgatgaagaaagtggatcagggcaaggtacctcagatagccttaatgagaatgagacttccacagatttcagttttgcagacactaatgaaaaagatgctgatgggatcctggcagcaggtgactcagaaataactcctggattcccacagtccccaacatcatctgttactagcgagaactcagaagtgttccacgtttcagaggcagaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgagacactgaaagagttttaccaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaacacagaaaggggtgggggaactcacatctgagcattgttttcctcttcctaaaattaggcaggaaaatcagtctagttctgttatctgttgatttcccatcacctgacagtaactttcatgacataggattctgccgccaaatttatatcattaacaatgtgtgcctttttgcaagacttgtaatttacttattatgtttgaactaaaatgattgaattttacagtatttctaagaatggaattgtggtatttttttctgtattgattttaacagaaaatttcaatttatagaggttaggaattccaaactacagaaaatgtttgtttttagtgtcaaatttttagctgtatttgtagcaattatcaggtttgctagaaatataacttttaatacagtagcctgtaaataaaacactcttccatatgatattcaacattttacaactgcagtattcacctaaagtagaaataatctgttacttattgtaaatactgccctagtgtctccatggaccaaatttatatttataattgtagatttttatattttactactgagtcaagttttctagttctgtgtaattgtttagtttaatgacgtagttcattagctggtcttactctaccagttttctgacattgtattgtgttacctaagtcattaactttgtttcagcatgtaattttaacttttgtggaaaatagaaataccttcattttgaaagaagtttttatgagaataacaccttaccaaacattgttcaaatggtttttatccaaggaattgcaaaaataaatataaatattgccattaa

SEQ ID NO: 17047 - DNA, 568 bp, Homo sapiens
  ENST00000471837
agaccgcggccgccgcagccggcgaaagaggcaaagtcccgcacgccggaggacatgcgcctcggctagcggccccgggccccaccaccgtgcggctttctccagattattcctctctcgctgtctctgactgtctctctctgtctctgtctctgtctctctctctctcacacacacacacacacacacaaacacacatacgcacgcacgatctcacttcgatctatacactggaggattaaaacaaacaaacaaaaaaaacatttccttcgctccccctccctctccactctgagaagcagaggagccgcacggcgaggggccgcagaccgtctggaaatgcgaatcctaaagcgtttcctcgcttgcattcagctcctctgtgtttgccgcctggattgggctaatggatactacagacaacagagaaaacttgttgaagagattggctggtcctatacagaaagaaaagcattcagaagaatataaaatgaaaactacactgccactcctttcttccttgtgatggccatggaaatgctagcgtttaaccagagacttggactct

SEQ ID NO: 17048 - DNA, 4627 bp, Homo sapiens
  ENST00000449182
cgcacgcacgatctcacttcgatctatacactggaggattaaaacaaacaaacaaaaaaaacatttccttcgctccccctccctctccactctgagaagcagaggagccgcacggcgaggggccgcagaccgtctggaaatgcgaatcctaaagcgtttcctcgcttgcattcagctcctctgtgtttgccgcctggattgggctaatggatactacagacaacagagaaaacttgttgaagagattggctggtcctatacaggagcactgaatcaaaaaaattggggaaagaaatatccaacatgtaatagcccaaaacaatctcctatcaatattgatgaagatcttacacaagtaaatgtgaatcttaagaaacttaaatttcagggttgggataaaacatcattggaaaacacattcattcataacactgggaaaacagtggaaattaatctcactaatgactaccgtgtcagcggaggagtttcagaaatggtgtttaaagcaagcaagataacttttcactggggaaaatgcaatatgtcatctgatggatcagagcatagtttagaaggacaaaaatttccacttgagatgcaaatctactgctttgatgcggaccgattttcaagttttgaggaagcagtcaaaggaaaagggaagttaagagctttatccattttgtttgaggttgggacagaagaaaatttggatttcaaagcgattattgatggagtcgaaagtgttagtcgttttgggaagcaggctgctttagatccattcatactgttgaaccttctgccaaactcaactgacaagtattacatttacaatggctcattgacatctcctccctgcacagacacagttgactggattgtttttaaagatacagttagcatctctgaaagccagttggctgttttttgtgaagttcttacaatgcaacaatctggttatgtcatgctgatggactacttacaaaacaattttcgagagcaacagtacaagttctctagacaggtgttttcctcatacactggaaaggaagagattcatgaagcagtttgtagttcagaaccagaaaatgttcaggctgacccagagaattataccagccttcttgttacatgggaaagacctcgagtcgtttatgataccatgattgagaagtttgcagttttgtaccagcagttggatggagaggaccaaaccaagcatgaatttttgacagatggctatcaagacttgggtgctattctcaataatttgctacccaatatgagttatgttcttcagatagtagccatatgcactaatggcttatatggaaaatacagcgaccaactgattgtcgacatgcctactgataatcctgaacttgatcttttccctgaattaattggaactgaagaaataatcaaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagatctggaaatgccacattattctacctttgcctacttcccaactgaggtaacacctcatgcttttaccccatcctccagacaacaggatttggtctccacggtcaacgtggtatactcgcagacaacccaaccggtatacaatgaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaacacagaaaggggtgggggaactcacatctgagcattgttttcctcttcctaaaattaggcaggaaaatcagtctagttctgttatctgttgatttcccatcacctgacagtaactttcatgacataggattctgccgccaa

SEQ ID NO: 17049 - DNA, 593 bp, Homo sapiens
  ENST00000483028
ctgaggtaacacctcatgcttttaccccatcctccagacaacaggatttggtctccacggtcaacgtggtatactcgcagacaacccaaccggtatacaatggtttgaccatttcctatgcaagtgagaaatatgaaccagttttgttaaaaagtgaaagttcccaccaagtggtaccttctttgtacagtaatgatgagttgttccaaacggccaatttggagattaaccaggcccatcccccaaaaggaaggcatgtatttgctacacctgttttatcaattgatgaaccattaaatacactaataaataagcttatacattccgatgaaattttaacctccaccaaaagttctgttactggtaaggtatttgctggtattccaacagttgcttctgatacatttgtatctactgatcattctgttcctataggaaatgggcatgttgccattacagctgtttctccccacagagatggttctgtaacctcaacaaagttgctgtttccttctaaggcaacttctgagctgagtcatagtgccaaatctgatgccggtttagtgggtggtggtgaagatggtgacactgat

SEQ ID NO: 17050 - DNA, 571 bp, Homo sapiens
  ENST00000489114
agccacagtggaagaatatgtagggcattgaggtttcctatattaacaaagtatcactttgaacccagctacaacttcaaattctgtctgtgcttttagcatgcctgatatctacttgctcttctgcatctgctacaggtaaaactgagataaattttataatttaacatcttgtgacttgttaaaatggatgtagatccagcaatccctcttctgggtatatacctgcttttgttttaattctggagatttctatcaaaattttcaagcagctcagaaattgtcttattttccatagcaactagtagtataaattgtgttcttttatttccaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgaggaagtgcagagctgtactgttgacttaggtattacagcagacagctccaaccacccaga

SEQ ID NO: 17051 - DNA, 817 bp, Homo sapiens
  ENST00000483995
ggtatatacctgcttttgttttaattctggagatttctatcaaaattttcaagcagctcagaaattgtcttattttccatagcaactagtagtataaattgtgttcttttatttccaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgaggtatgattttaatatgtctattttaaataatatagaaaatagtaaaatttaaaagattcagcaataggctatttcttgacctaaagacagtgcaaccatttgcacttctagtaaaaatatgagttccataattacatatgtgtttaggagatgtgttatagttactatataatttagacaattggttttctattttaaaagccaagttgtactggtggaaacataaaaaacattgttcattttcttccataaagtacaaatctttaatattcttttttaaaatctgaattaataacaatgattctttttaattttctaaattctataaattatactaaactactaaatttcatgatttccagccaaattacataaaaattcttaactgtgatttgtacaccagtgttaatgcaaaagcatttagataacacttacattataccaggtaaaaatgtatcttcttttcaagaaaatatgcatttctaaaaaaaatttgaacttcaaaatcagtaagttttttc

SEQ ID NO: 17052 - DNA, 554 bp, Homo sapiens
  ENST00000468641
atctccttttaaaagtgttatgttttcttttacataattttaaagttccaaattattagacattttgatttgcatgcaactgtttgaaacattctgttgtgttagtatttgacaaatgtatttattgcatgatcatagttttccattgtaaacctaatatgaacgcttttttttctcatttgtcgtgtgctgtggaatttgatttctttacttttttggcattcattccctcattagacactgaaagagttttaccaggtaaggcattatttcactgcattttcttttagccaagaagtagttgtaacttttaaaaaatttcatttgatagattattttgtttgttttgtcttcgttattatattttaaggcacgttgtttgaaagaatgtgtgttaaaatgatttacatataattttttacaggaagtgcagagctgtactgttgacttaggtattacagcagacagctccaaccacccagacaacaagcacaagaatcgatacataaatatcgttgcctatgatcatagcagggttaagctagcacagcttg

SEQ ID NO: 17053 - DNA, 549 bp, Homo sapiens
  ENST00000470504
aatatgaacgcttttttttctcatttgtcgtgtgctgtggaatttgatttctttacttttttggcattcattccctcattagacactgaaagagttttaccaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaa

SEQ ID NO: 17054 - DNA, 1128 bp, Homo sapiens
  ENST00000474500
ctgaacttatgttataaatatataaaatacagtttgttatatatgtatttatacattatattatatgtgtattatacatgtctttatatgatactctcaggttttttttattattgccaactcctttcatagtatacaaataataaaccataagcaaatactaaacttctgtaaagtattccactattgatatcatgaacacttggcaatatttcagattaaatcatagttctttgtgcaaaaagcgaagagagacaattcattaaaagtttcagtgttttcactgcaaagttgtcaaggctatatgctttgtgagttctaaatgtgagtggtgcatctcaatggagtctttgttccttttcttttttttttttacaaggcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaacacagaaaggggtgggggaactcacatctgagcattgttttcctcttcctaaaattaggcaggaaaatcagtctagttctgttatctgttgatttcccatcacctgacagtaactttcatgacataggattctgccgccaaatttatatcattaacaatgtgtgcctttttgcaagacttgtaatttacttattatgtttgaactaaaatgattgaattttacagtatttctaagaatggaattgtggtatttttttctgtattgattttaacagaaaatttcaatttatagaggttaggaattccaaactacagaaaatgtttgtttttagtgtcaaatttttagctgtatttgtagcaattatcaggtttgctagaaatataacttttaatacagtagcctgtaaataaaacactcttccatatgatattcaacattttacaactgcagtattcacctaaagtagaaata

SEQ ID NO: 17055 - DNA, 1070 bp, Homo sapiens
  ENST00000393964
cgcgggtggttagttgagccggctccggcggggaaggaggcgggctgcggctgcggctggggctgaagctggggctggggttgggggactgcccggggcttagatggctccgagcccgtttgagcgtggtctcggactgctaactggaccaacggcaactgtctgatgagtgccagccccaaaccgcgcgctgctcgggaccttagagcctctgactcaggctggaagatttgagagctggattaagtacttgttggctcacgcccgtgactgttccgctgtttagctcttgttttttgtgtggacactcctaggatagaaagtttggtatgttgctatacctttgcttctcccaccttccccaatatctaatatgtatttctcattcttagaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctccttcaagcattctgtcgaccctggatgttgaattgccacctgtttgctgtgacatagatatttaaatttcttagtgcttcagagtttgtgtgtatttgtattaataaagcattctttaacaga

SEQ ID NO: 17056 - DNA, 670 bp, Homo sapiens
  ENST00000519287
tgtgtggacactcctaggatagaaagtttggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctccttcaagcattctgtcgaccctggatgttgaattgccacctgtttgctgtgacatagatatttaaatttcttagtgcttcagagtttgtgtgtatttgtattaataaagcattctttaacaga

SEQ ID NO: 17057 - DNA, 895 bp, Homo sapiens
  ENST00000520452
gagggtcgcgggtggttagttgagccggctccggcggggaaggaggcgggctgcggctgcggctggggctgaagctggggctggggttgggggactgcccggggcttagatggctccgagcccgtttgagcgtggtctcggactgctaactggaccaacggcaactgtctgatgagtgccagccccaaaccgcgcgctgctcgggaccttagagcctctgactcaggctggaagatttgagagctggattaaaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctccttcaagcattctgtcgaccctggatgttgaattgccacctgtttgctgtgacatagatatttaaatttcttagtgcttcagagtttg

SEQ ID NO: 17058 - DNA, 851 bp, Homo sapiens
  ENST00000523659
tgaatgcggctgttaagacctgcaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctaggtagtatcttttgcaattgcgaaaagtgcttttggcctttagtttcttagtattcagctcagctgtaacttgttatgaatataatatatgaccaaaaactatgatgagactgtctgaatctgggttgctttggacaagtgtacttgttgatggaattatttgcaaggtatcatcttaggtcaggaggggaataggaacaaagatgtagaagacattgttcctgtctgtaaaagcttatcacctagaggaggtaagatgtattcatgaacattgaataagtcccattgtggacagtctttctcacaaggcttttagaagtgagctttatgtcaagttgagcaatgcctgagagtaatttggtaggattatttctttggtttgaaaaatctacataagacagtgaagacatgtttttcaaatttcttcaacctgctacatgtatctgaa

SEQ ID NO: 17059 - DNA, 684 bp, Homo sapiens
  ENST00000517480
gcggcctcagatgaatgcggctgttaagacctgcaataatccagaatggctactctgatctatgttgataaggaaaatggagaaccaggcacccgtgtggttgctaaggatgggctgaagctggggtctggaccttgtaagtatacaaggctgcagtcggatacactggtattgtggacgtggcctggagctggacgagacatttagtgtactttttgggcaattggagtcgtttgttattggtcctttttcatttttaatatcttaatgagatgatttaaggaagttactgaatctctgctattaggcctatcatagccatgccactaccaaaagtggggggtgggtttgggggtgagaggtcaagtttatatacacagtatttaagttgtacaggtattttgctgctggaatattcttatggtaagactttttcttcagcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatc

SEQ ID NO: 17060 - DNA, 753 bp, Homo sapiens
  ENST00000352433
gtggtttaaaccaggagtgcgccgcgtccgttcaccgcggcctcagatgaatgcggctgttaagacctgcaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctccttcaagcattctgtcgaccctggatgttgaattgccacctgtttgctgtgacatagatatttaaatttcttagtgcttcagagtttgtgtgtatttgtattaataaagcattctttaacagattctt

SEQ ID NO: 17061 - DNA, 434 bp, Homo sapiens
  ENST00000524244
accgcggcctcagatgaatgcggctgttaagacctgcaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaaggtaagtgttggctataaagacactgtttaaacacttaagcacttttgactcttaaaatgactattggcatcatcctacgtagctttcttccctctgagtagaagggaaat

SEQ ID NO: 17062 - DNA, 2140 bp, Homo sapiens
  ENST00000381077
ctcagtgcgcgtgcgcggggcgggcgggtgcgcgcgcacttcctcctcgcccccacccagacccagaaggcgccaccatggcggcgcccccgcagcccgtcacccacctcatctttgacatggacggacttcttctggatactgaacggctgtattcagtggtgtttcaagaaatatgtaatcgctatgacaagaaatacagctgggatgtaaagtccctggttatgggtaagaaggcattagaggcggcacagattataatagacgtcttgcagctcccgatgtccaaagaggagctggtggaagaaagccaaacgaagttaaaggaagtgttccccacggctgcgctcatgccaggggcggagaaactcatcatccacctgcggaaacatggcatcccctttgcactggccaccagctcggggtccgcgtcgttcgatatgaagacaagccgccacaaggagttcttcagcttgttttcccacattgtgctgggagatgaccccgaagtgcagcatggcaagccagacccggacatcttcctagcttgtgccaagaggttctctccccctcctgctatggagaagtgccttgtctttgaagatgctcccaatggggtggaggcggccctggcagctgggatgcaggtggtcatggttcctgacggaaacttgagccgagatctgacaacaaaggccaccctggtgctgaattccctgcaggacttccagcccgagctgtttggtttgccctcctatgagtgagagggagggcctcagtcttccgcccccagcccactctcatggtccacactgctgggggaaagggaaaggaaatcagcaactcttcaatcccaacctgcgctgtgattttagcctcctgagattggagtttccatcccatgttggtttgtcccagtctaacgtgttgataaaatgtgacttgacggttgagacaaaaaatacagtagagacagaaacgaagcccagaacaaagatgaaacttgaattaccatctcagaagtcaagctgatggagtatgtgataaagtgaatgtacatgtatatacacacacacctccatatatacatgtgtgtatcagtttggtaatatgcaggtaggcattacatgcatatgtatgtagacatatgcatgcatgtatatgtaaaatatatacttttccaagacaaaatggaacatcacttctctcttctagtttttctgaacactggctgggaaatgtaaactgtgtatgcatataagtatatgctttatgtatgcatatgtatgtagatatgtttatatctatcgtctgcatcactctcctcagtgttgatgtcaacatgcaatgacaactgataaagcgagatggtagttctgcctggtttgcagtctgagtgggaaagtcctgtttttgatgagcactccttgttagctaacatttaaattctttttgtgacctcagaatgtctctggatctttcctcattgactgactctgtgccacgtcatccatagtttattgttagtatgaacacaactgtaacatttacctggtatctacatccttacctgcattggaaaatgtttgctacctcacaacaaccatttgcctcctttaagaacactgatgggctgcactttttggatagaaatagaatttgatttcagaatgtatgcttggtgagtctcagtgcccaggaacacttttggaataatttatcagacattgaacttctgtgattaatcgcttttatagatttactcagtctttaaaattcgtctctgatttgccagagaaaaacggtggtagccatggaaatcgggagtgaaggagcactgcttcattgtggctcagcccttcctaggggcctctgccctttgatgtccttgagctactcttcagctctggaagttgtggacaaaccgtaggaatgtatgtgtgcgtgtggtggagtgattgtctgtgaatgacaggccctggctattgattgatgttgcatcaatttagcaaattcatttcctcattcttgatggcctgaatatatgtctgcacttttaatgctcctcttaaccagttgtaacatcttaccatttccctaacaaattgaattagtttaataaaatcttttgacacatgtt

SEQ ID NO: 17063 - DNA, 1376 bp, Homo sapiens
  ENST00000412827
acttcctcctcgcccccacccagacccagaaggcgccaccatggcggcgcccccgcagcccgtcacccacctcatctttgacatggacggacttcttctggatactgaacggctgtattcagtggtgtttcaagaaatatgtaatcgctatgacaagaaatacagctgggatgtaaagtccctggttatgggggcggagaaactcatcatccacctgcggaaacatggcatcccctttgcactggccaccagctcggggtccgcgtcgttcgatatgaagacaagccgccacaaggagttcttcagcttgttttcccacattgtgctgggagatgaccccgaagtgcagcatggcaagccagacccggacatcttcctagcttgtgccaagaggttctctccccctcctgctatggagaagtgccttgtctttgaagatgctcccaatggggtggaggcggccctggcagctgggatgcaggtggtcatggttcctgacggaaacttgagccgagatctgacaacaaaggccaccctggtgctgaattccctgcaggacttccagcccgagctgtttggtttgccctcctatgagtgagagggagggcctcagtcttccgcccccagcccactctcatggtccacactgctgggggaaagggaaaggaaatcagcaactcttcaatcccaacctgcgctgtgattttagcctcctgagattggagtttccatcccatgttggtttgtcccagtctaacgtgttgataaaatgtgacttgacggttgagacaaaaaatacagtagagacagaaacgaagcccagaacaaagatgaaacttgaattaccatctcagaagtcaagctgatggagtatgtgataaagtgaatgtacatgtatatacacacacacctccatatatacatgtgtgtatcagtttggtaatatgcaggtaggcattacatgcatatgtatgtagacatatgcatgcatgtatatgtaaaatatatacttttccaagacaaaatggaacatcacttctctcttctagtttttctgaacactggctgggaaatgtaaactgtgtatgcatataagtatatgctttatgtatgcatatgtatgtagatatgtttatatctatcgtctgcatcactctcctcagtgttgatgtcaacatgcaatgacaactgataaagcgagatggtagttctgcctggtttgcagtctgagtgggaaagtcctgtttttgatgagcactccttgttagctaacatttaaattctttttgtgacctcagaatgtctctggatctttcctcattgactgactctgtgccacgtcatccatagtttattgttagtatgaacacaactgt

SEQ ID NO: 17064 - DNA, 1334 bp, Homo sapiens
  ENST00000424830
cgcgcacttcctcctcgcccccacccagacccagaaggcgccaccatggcggcgcccccgcagcccgtcacccacctcatctttgacatggacggacttcttctgggttatacaggaagcatagtggcagctgcttcgggggagtcctcaagaggcttacaatcacggtggacggatactgaacggctgtattcagtggtgtttcaagaaatatgtaatcgctatgacaagaaatacagctgggatgtaaagtccctggttatgggtaagaaggcattagaggcggcacagattataatagacgtcttgcagctcccgatgtccaaagaggagctggtggaagaaagccaaacgaagttaaaggaagtgttccccacggctgcgctcatgccaggggcggagaaactcatcatccacctgcggaaacatggcatcccctttgcactggccaccagctcggggtccgcgtcgttcgatatgaagacaagccgccacaaggagttcttcagcttgttttcccacattgtgctgggagatgaccccgaagtgcagcatggcaagccagacccggacatcttcctagcttgtgccaagaggttctctccccctcctgctatggagaagtgccttgtctttgaagatgctcccaatggggtggaggcggccctggcagctgggatgcaggtggtcatggttcctgacggaaacttgagccgagatctgacaacaaaggccaccctggtgctgaattccctgcaggacttccagcccgagctgtttggtttgccctcctatgagtgagagggagggcctcagtcttccgcccccagcccactctcatggtccacactgctgggggaaagggaaaggaaatcagcaactcttcaatcccaacctgcgctgtgattttagcctcctgagattggagtttccatcccatgttggtttgtcccagtctaacgtgttgataaaatgtgacttgacggttgagacaaaaaatacagtagagacagaaacgaagcccagaacaaagatgaaacttgaattaccatctcagaagtcaagctgatggagtatgtgataaagtgaatgtacatgtatatacacacacacctccatatatacatgtgtgtatcagtttggtaatatgcaggtaggcattacatgcatatgtatgtagacatatgcatgcatgtatatgtaaaatatatacttttccaagacaaaatggaacatcacttctctcttctagtttttctgaacactggctgggaaatgtaaactgtgtatgcatataagtatatgctttatgtatgcatatgtatgtagatatg

SEQ ID NO: 17065 - DNA, 586 bp, Homo sapiens
  ENST00000486446
gaaggcgccaccatggcggcgcccccgcagcccgtcacccacctcatctttgacatggacggacttcttctggatactgaacggctgtattcagtggtgtttcaagaaatatgtaatcgctatgacaagaaatacagctgggatgtaaagtccctggttatgggtaagaaggcattagaggcggcacagattataatagacgtcttgcagctcccgatgtccaaagaggagctggtggaagaaagccaaacgaagttaaaggaagtgttccccacggctgcgctcatgccaggggcggagaaactcatcatccacctgcggaaacatggcatcccctttgcactggccaccagctcggggtccgcgtcgttcgatatgaagacaagccgccacaaggagttcttcagcttgttttcccacattgtgctgggagatgaccccgaagtgcagcatggcaagccagacccggacatcttcctagcttgtgccaagaggttctctccccctcctgctatggagaagagctccatccatagacctcgtctgctcaccgcacagaaatgccagggctgccgggatcccttct
